United States Patent 11,098,302 (IDENTIFICATION OF POLYNUCLEOTIDES ASSOCIATED WITH A SAMPLE) - sequence listing, part 23

SEQ ID NO: 75697 - DNA, 504 bp, Homo sapiens
  misc_feature: GYAE6OF02FF2BV.17.39.D06.1.454.CMB.1.raw
  modified_base (204)..(204): a, c, t, g, unknown or other
  misc_feature (204)..(204): n is a, c, g, or t
  modified_base (373)..(373): a, c, t, g, unknown or other
  misc_feature (373)..(373): n is a, c, g, or t
  modified_base (406)..(406): a, c, t, g, unknown or other
  misc_feature (406)..(406): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaacctggccaggctcccaggctcctcatgtatggtgcatctaccagggcccacgtggtcgtcccagcccaggttcaggtggcaggtgggtctggggacaggagtttcnctctcatcatcagcagcctgcagtctagaagtnttttgcgttttatactgtcagctagttataatcagtcgccttcggtggtacgttcggccgaagggaccaagggtgaatacgaacgactgagctgctac

SEQ ID NO: 75698 - DNA, 530 bp, Homo sapiens
  misc_feature: GYAE6OF02FGPFF.17.39.D06.1.454.CMB.1.raw
  modified_base (204)..(204): a, c, t, g, unknown or other
  misc_feature (204)..(204): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaacctggccaggctcccaggctcctcatgtatggtgcatctaccagggcccagtggtcgtcccagccaggttcagtggcaggtgggtctgggacaggtagttctcgtctcatcatcagcacgcctgcagtcgtagtagtgttttaaaagtcgtttattacttgtcagctagtataatactagtcgccgttcgtcggtacgttcggccgtaacgggaccgaacggtaggtaacgtacgaacgacgtacggtacggcgtcgctaccg

SEQ ID NO: 75699 - DNA, 521 bp, Homo sapiens
  misc_feature: GYAE6OF02HUN4W.17.39.D06.1.454.CMB.1.raw
  modified_base (204)..(204): a, c, t, g, unknown or other
  misc_feature (204)..(204): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaaacctggccaggctcccaggctcctcatgtatggtgcatctaccagggccacgtggtctcccagcccaggttcagtggcaggtgggtctggggacagagttctctctcatcatcagcagtcctgcagtctagaagtatttttgcggttttattactgtcagcagttataatctagtcgacctcgtggtacgttcggaccgaagggtacccaagggtaggaaactcgaaacggacttggtaggctggacctaaccg

SEQ ID NO: 75700 - DNA, 547 bp, Homo sapiens
  misc_feature: GYAE6OF02FTF1Z.17.39.D06.1.454.CMB.1.raw
  modified_base (379)..(379): a, c, t, g, unknown or other
  misc_feature (379)..(379): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagcgtgttggcagcaacttagcctggtatcagcagaaacctggccaggctcccaggcctcctcatgtatggtgcatctaccgagggccctacgtggtccgtcccagcccgtaggtttcaggtcgggctagggttcgggtcgtggggacnggtacgttctctctcatcatcagcacgcctgctagtctagacgttagtttcgtacgttttaattaccgtgtacagtctaagttataatcgagtcgtcctcggtggtaccgttcggaccgaacgggtacaagggtagaactacgaaacgtactggcgactcgactaccg

SEQ ID NO: 75701 - DNA, 516 bp, Homo sapiens
  misc_feature: GYAE6OF02GZFDD.17.39.D06.1.454.CMB.1.raw
  modified_base (204)..(204): a, c, t, g, unknown or other
  misc_feature (204)..(204): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (407)..(407): a, c, t, g, unknown or other
  misc_feature (407)..(407): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaacctggccaggctcccaggctcctcatgtatggtgcatctaccgagggcctacgtggtcgtcccagccgaggttcaggtggcaggtgggtctggggacnggtagttcnctctcatcatcagctagcctgcagtctgaagtnttttgcgttttatctgtcagtcagttatatctagtcgcctcgtgtacggttcggaccgtaagggacctaagggtagaaactacgaaacgtactggtacggctagctacg

SEQ ID NO: 75702 - DNA, 506 bp, Homo sapiens
  misc_feature: GYAE6OF02HM39G.17.39.D06.1.454.CMB.1.raw
  modified_base (204)..(204): a, c, t, g, unknown or other
  misc_feature (204)..(204): n is a, c, g, or t
  modified_base (403)..(403): a, c, t, g, unknown or other
  misc_feature (403)..(403): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgatgcagtctccagccaccctgtctgtgtctccaggggaaanagccaccctctcctgcagggccagtcagagtgttggcagcaacttagcctggtatcagcagaacctggccaggctcccaggctcctcatgtatggtgcatctaccgagggcccagtggtcgtcccagccaggttcaggtgcagtgggtctgggacaggagtttctctctcatcatcagcagcctgcagtctagaagttntttgcgttttattacgtgtcagcagtatatcagtcgcctcggtggtacgttcggacgaacgggacctaagggtaggaaatcgaaacgacgtggtcggctgacc

SEQ ID NO: 75703 - DNA, 539 bp, Homo sapiens
  misc_feature: GYAE6OF02GEKZD.17.39.D06.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (407)..(407): a, c, t, g, unknown or other
  misc_feature (407)..(407): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaacctggccaggcctcccaggctcctcatgtatggtncatcctaccgagggccagtggtctcccagccaggttcagtggcaggtgggtctgggacaggtacgttctctctcatcatcagcacgctgctagtctagtaagttnttttggacgttttatacgttgtcagtctaagttataacgtctaagtcgtccgttcggtggtaccgttcggaccggaagggtacccgaagggtacgaaacgtacgaaacggtacgtcggtagcctagctaccg

SEQ ID NO: 75704 - DNA, 553 bp, Homo sapiens
  misc_feature: GYAE6OF02F8SR8.17.39.D06.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccacctgtctgtgtctccaggggaaangccaccctctcctgcagggccagtcagngtgttggcagcaacttagcctggtatcagcagaaacctggccaggcctcccgaggcctccgtcagtgtatggtgcatcctaccgagggccacgtggtcgtccccagccctaggtttccaggttcgggctaggtcgggtctaggggactaggtacgtttctcgtctcatcatcgagcagccctgctagtctagaagttgttttgcgtttatcgtgtcagctagttatatcgagtcgtccgtcgtggtaccgttcggaccgtaagggaaccgtaagggtacgtaaacgtacgaaacggtacgttggtacggcttagactaaccg

SEQ ID NO: 75705 - DNA, 568 bp, Homo sapiens
  misc_feature: GYAE6OF02HUDAL.17.39.D06.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (384)..(384): a, c, t, g, unknown or other
  misc_feature (384)..(384): n is a, c, g, or t
  modified_base (414)..(414): a, c, t, g, unknown or other
  misc_feature (414)..(414): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccacctgtctgtgtctccagggggaaangccaccctctcctgcagggccagtcagcgtgttggcagcaacttagcctggtatcagcagaacctggccaggctcccgaggcctcctcatgtatggtncatctacgagggccacgtggtcgtcccagccgtaggttcaggtcggctaggtggggtctaggggactaggtcgttctctctnatcatcagcagcctgctagtctagaagttnttttgcgttttaatacgttgtacgtagtcgtaagttactaatcgtacggttcgcccgttcggtacggtaccgtttccgggaccgtaaacggggtacctaagggtacgtaaacgtaccggaaacgtacggttggtacggacttacggacctaacg

SEQ ID NO: 75706 - DNA, 513 bp, Homo sapiens
  misc_feature: GYAE6OF02H72GS.17.39.D06.1.454.CMB.1.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
  modified_base (406)..(406): a, c, t, g, unknown or other
  misc_feature (406)..(406): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccagggggaaangccaccctctcctgcagggccagtcagagtgttggcagcaacttgcctggtatcagcagaaacctggccaggctcccaggcctccncatgtatggtgcatctaccgagggccacgtggtcgtccagcctaggttcaggtggcaggtgggtctagggacagtagttctctctcatcatcagcagcctgctagtctagaagtnttttgtgtttatacgtgttcagtcagtataatgagtcgcctcgtggtacgtcggacgaacgggtaccgaaggtcgtaaactacgaacgacgtgtaggctcgactacg

SEQ ID NO: 75707 - DNA, 535 bp, Homo sapiens
  misc_feature: GYAE6OF02HGZGL.17.39.D06.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
  modified_base (406)..(406): a, c, t, g, unknown or other
  misc_feature (406)..(406): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttggcagcaacttagcctggtatcagcagaacctggccaggcctcccaggcctcctcatgtatggtncatctaccgngggccagtggtctcccagccaggttcaggtggcaggtgggtctggggacaggtcgttcctctctcatcatcagcagcctgcagtctagaagttnttttggcgttttatcgtgtcagtctagttataagtcgtagtcggtaccttcggtaggtaccgttcggaccgtaagggtaccgtaagggtagaaactacgaaacgtacgtggtacggctagacctaaccg

SEQ ID NO: 75708 - DNA, 530 bp, Homo sapiens
  misc_feature: GYAE6OF02F3DXM.17.39.D06.1.454.CMB.1.raw
  modified_base (205)..(205): a, c, t, g, unknown or other
  misc_feature (205)..(205): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
tcagcgtagactagcacgaccggtgctcgatttagtgacatctcgcagttctttgggggaggaactgctcagttaggacccagacggaaccatggaagccccagcgcatcttctcttcctcctgctactctggctcccagataccactggagaagtagtgatgacgcagtctccagccaccctgtctgtgtctccaggggaaagngccaccctctcctgcagggccagtcagagtgttggcagcaacttagcctggtatcagcaagaaacctggccaggcctcccaggcctcctcatgtatggtgcatcctaaccgagggccacgtggtcgtcccagccaggttcaggtggcaggtgggtctgggacagngttctctcncatcatcagcagcctgctagtctgaagttgtttgtacgttttatctgtaccagtctagtataatcgaagtcggtaccttcggtgtaccgttcggacgaacgggacctaagggtacgaaactaccgaaacgtacgtaggtggactgactacc

SEQ ID NO: 75709 - DNA, 513 bp, Homo sapiens
  misc_feature: GYAE6OF02HMO1T.17.39.D06.1.454.CMB.1.raw
  modified_base (309)..(309): a, c, t, g, unknown or other
  misc_feature (309)..(309): n is a, c, g, or t
  modified_base (406)..(406): a, c, t, g, unknown or other
  misc_feature (406)..(406): n is a, c, g, or t
  modified_base (438)..(438): a, c, t, g, unknown or other
  misc_feature (438)..(438): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgatgcagtctccagccaccctgtctgtgtctccaggggaagagccaccctctcctgcagggccagtcagagtgttggcagcaacttagcctggtatcagcagaacctggccaggcctccaggctcctcatgtatggtgcatctaccngggccacgtggtcgtcccagcctaggttcagtggcagtcgggtctgggacagtgtttctcgtctcatcatcagcagtctgcctagtctagtaagttnttttgcggttttatctagtcagctagtaatancgtagtcgctcgtggtaccgttcggcaagggtaccaagggttgaaactcgaaacgtacgtgtacggctagacccg

SEQ ID NO: 75710 - DNA, 526 bp, Homo sapiens
  misc_feature: GYAE6OF02F0U7O.17.39.D06.1.454.CMB.1.raw
  modified_base (204)..(204): a, c, t, g, unknown or other
  misc_feature (204)..(204): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcaagaacctggccaggctcccaggctcctcatgtatggtgcatctacagggccagtggtctcccagccaggttcagtggcaggtgggtctggggacaggtagttcctctctcatcatcagcacgcctgcagtctagaagttatttcgcgttttatactgtacagtctaagtataatcgagtcgtcctcgtggtaccgttcggaccgtaagggaccaagggtagtaaactacgaaacgtacgttaggtacggctacggctaaccg

SEQ ID NO: 75711 - DNA, 591 bp, Homo sapiens
  misc_feature: GYAE6OF02FIYYZ.17.39.D06.1.454.CMB.1.raw
  modified_base (205)..(205): a, c, t, g, unknown or other
  misc_feature (205)..(205): n is a, c, g, or t
  modified_base (370)..(370): a, c, t, g, unknown or other
  misc_feature (370)..(370): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttggcagcaacttagcctggtatcagcagaacctggccaggctcccaggcctcctcatgtatggtgcatcctaccgagggcctacgtggtcgtcccagcctaggttcagtggcaggtgggtctggggacaggngttctctctctatcatcgagcacgtcctgacctagttctaggtaacgttgtttttcggtacggttttaattacgttgtactagtctaaggttaataagttcgtagttacggtcccttacggttggtaccggttcggacccggtaaacggggaacccgtaaagggtacggtaaaagtaccgtaaaacgtaccggttaggtcggaccgttaggaccctaaccg

SEQ ID NO: 75712 - DNA, 562 bp, Homo sapiens
  misc_feature: GYAE6OF02G0CGG.17.39.D06.1.454.CMB.1.raw
  modified_base (204)..(204): a, c, t, g, unknown or other
  misc_feature (204)..(204): n is a, c, g, or t
  modified_base (368)..(368): a, c, t, g, unknown or other
  misc_feature (368)..(368): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaaacctggccaggctcccaggcctcctcatgtatggtgcatctaccgagggccagtggtctcccagccaggttcagtggcaggtggtctgggacagtgttccnctctacatcattcagcagcctgaccgagttctaggtaacgttattttcggtaggttttaacttacgtgttacgagtctaagttacttaagtcgaggttcgtaccttcgggtggtaccgttaccggaccggtaaacggggtaaccaagggtaaggaaacttacgaaacgtcgttaggtacggctacggactaccg

SEQ ID NO: 75713 - DNA, 596 bp, Homo sapiens
  misc_feature: GYAE6OF02FJABK.17.39.D06.1.454.CMB.1.raw
  modified_base (204)..(204): a, c, t, g, unknown or other
  misc_feature (204)..(204): n is a, c, g, or t
  modified_base (401)..(401): a, c, t, g, unknown or other
  misc_feature (401)..(401): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctccctgccagggcccagtccagagtgttggcagcaacttagcctggtatcagcagaaaccctggcccaggcctcccaggcctcctcatgtatggtgcactcctaccgagggccctacgtggtcgtaccccaggcccgtaggtttccaggttcggcgtaggttcggggtctggggaccaggtacgttcnctctcatcatcacgcacgcctgcagtctgagtatttcgcgtttatactgtcagtctagtataatcgaagttcggccgttccggtaggtaccgtttaccgggacccggtaaacggggtaacccgtaacggggtaacggtaaaccgtaaccgaaaaccggtaacggttacggtacgggtacctacggacctaacccg

SEQ ID NO: 75714 - DNA, 691 bp, Homo sapiens
  misc_feature: GYAE6OF02IFE9F.17.39.D06.1.454.CMB.1.raw
  modified_base (211)..(211): a, c, t, g, unknown or other
  misc_feature (211)..(211): n is a, c, g, or t
  modified_base (325)..(325): a, c, t, g, unknown or other
  misc_feature (325)..(325): n is a, c, g, or t
tcagcgtagactagcacgaccggtgctcgatttagtgacatctcgcagttctttgggggaggaactgctcagttaggacccagacggaaccatggaagccccagcgcagcttctcttcctctgctactctggctccagataccactggagaagtagtgactgacgctagtctccagcccacccttgtctgtcgtacctccgaaggggaaancgcccaccctctccgtgacgagggtccagtcaaggtgttgtcggacagcaattcgcctaggatcgagcaagaacctggccaggcctcccgacggtctccgatatgtatcggtcnctattccgaccgagggtccagttggcctaccgacggccgtaaggttccgaggttccggacgtagggttggggttccgaacggggtacctaaggttaccgggttccttgtccgttacactcgtataccgacggacctggtacctggacctaggttcctaagggtaactttaggtttcgttacgttttaacgtcgttacgtacgtacgttacgtaaactttaagtaacgtacgtaacggttcgtacccgttcgggtacgttacccgggtactaacccgggtaaacgggtaccgtaaagggttaaggtaaaaccctaagggttaaaacccgacgggttaacgtaccgggtctaccggtaccctaaccgg

SEQ ID NO: 75715 - DNA, 524 bp, Homo sapiens
  misc_feature: GYAE6OF02F5V9W.17.39.D06.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (369)..(369): a, c, t, g, unknown or other
  misc_feature (369)..(369): n is a, c, g, or t
  modified_base (404)..(404): a, c, t, g, unknown or other
  misc_feature (404)..(404): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctntcctgcagggccagtcagagtgttggcagcaacttagcctggtatcagcagaacctggccaggctcccaggcctcctnatgtatggtncatctaccngggccacgtggtctcccagccaggttcagtggcaggtgggtctggggacaggtagttcnctctcatcatcagcagcctgctagtctaggaattntttggacgttttatactgtcagctagtatatcagtcgcctcgtcggtacgttcggaccgtaagggacctaagggtacgaaacgtaccgaaacgtacgtaggtacgcgttagacctaaccg

SEQ ID NO: 75716 - DNA, 582 bp, Homo sapiens
  misc_feature: GYAE6OF02G66LA.17.39.D06.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
  modified_base (363)..(363): a, c, t, g, unknown or other
  misc_feature (363)..(363): n is a, c, g, or t
  modified_base (387)..(387): a, c, t, g, unknown or other
  misc_feature (387)..(387): n is a, c, g, or t
  modified_base (403)..(403): a, c, t, g, unknown or other
  misc_feature (403)..(403): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcaggccagtcagngtgtggcagcaacttgcctggtatcagcagaacctggccaggcctacccgaggctccgtcatgatggtncattcaacgnggccacgtggtactccgagtccgtaggttcgagtggccgtaggtgggtacnggggtacagtacgttctctcgtanactcaagtcaacgtcncggccttgcgtagttcgagttaaagttcttttggtacttttaatcgtgtacagttaccgagttaagtactcggtacgtcgtcccgttaggtcgtacgttccggaaccgtaaagggtaccgtaaagggtacgtaacgttaccgaaacggtacgtggaacggtccgtacgacccttaaccg

SEQ ID NO: 75717 - DNA, 605 bp, Homo sapiens
  misc_feature: GYAE6OF02IBB6J.17.39.D06.1.454.CMB.1.raw
  modified_base (309)..(309): a, c, t, g, unknown or other
  misc_feature (309)..(309): n is a, c, g, or t
tcagcgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtcctccagccaccctgtctgtgtctccgaaggggaaagcgccaccctctcctgcagggccagtcagagtgttggcagcaacttgcctggtatcagcagaacctggccaggcctacccgaggccctcctcatgtatggtnctactcctaccgacgggcctagtggtcgtccagcccgtaggttcaggtcggctagggtcgggtcgtagggactaggtacgttctcctctacatcatcagcgtacgtcctagctagtcgtagtaagttagttttgtacgttttatacgttcgtactagtctaagttattaacgtcgtagtcggtcccgttacggtacggttaccggttaccgggaaccggtaacggggaaccgtaaaggggtacgtaaaacgtaccgtaaacggtacgttgggtacggccgttacggacctaacccg

SEQ ID NO: 75718 - DNA, 513 bp, Homo sapiens
  misc_feature: GYAE6OF02HB4TV.17.39.D06.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
  modified_base (408)..(408): a, c, t, g, unknown or other
  misc_feature (408)..(408): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaacctggccaggcctcccaggcctcctcatgtatggtncatcctaccgagggccactggtctcccagccaggttcagtggcaggtgggtctggggacaggtacgtttctcgtctcatcatcagcagcctgcagtctgaagttnttttggtcgtttattacgtgtacagtctagttatactcagtcgcctcgtggtacgtcgacgaacgggacaaggtagaatacgaacgtactgtacggctgcctacg

SEQ ID NO: 75719 - DNA, 627 bp, Homo sapiens
  misc_feature: GYAE6OF02F5OBE.17.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagagtgttggcagcaacttgcctggtatcagcagaaacctggcccaggctcccaggcctcctcatgtatggtgcatctaccgagggccacgttggtcgtcccgacggccgtaggttcgaggtgggcgtagggtgggtacgtggggactagggtacgtttcctcgtctacatctaactcgagtcacgggcctggcctacggttcgtagtaacgttatttttcggtacgtttttaacttacgttcggtacctaagtcgtaagttaacttaacttcgtaacgttcggtacccgtttcgggtacggtaccggttccgggaaccgtaacggggtaaccgttaaagggtacggtaaaacttacggaaacggtaacgttcgggtacggaccgttcgacctaaccg

SEQ ID NO: 75720 - DNA, 575 bp, Homo sapiens
  misc_feature: GYAE6OF02IBH2A.17.39.D06.1.454.CMB.1.raw
  modified_base (310)..(310): a, c, t, g, unknown or other
  misc_feature (310)..(310): n is a, c, g, or t
  modified_base (437)..(437): a, c, t, g, unknown or other
  misc_feature (437)..(437): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaagacgccaccctctcctgcagggccagtcagagtgttggcagcaacttagcctggtatcagcagaaacctggccaggcctcccgaggcctcctcagtgtatggtcncacttccaccgacgggccagtcggtcgtcccaggccgtaggtttccaggtcggcgtaggtcgggtctagggactaggtcgttctctctacacttcgactcagcacgcctgctagtctaggtaagttnttttggacgttttataccgtgttacgaagtcaagttataacgtcgacgtcgccttcggtaggtaccggttcggaccgaagggtacctaagggtacgtaaactacgaaacggacgttggtacggactacgacctaaccg

SEQ ID NO: 75721 - DNA, 684 bp, Homo sapiens
  misc_feature: GYAE6OF02F2XDD.17.39.D06.1.454.CMB.1.raw
  modified_base (205)..(205): a, c, t, g, unknown or other
  misc_feature (205)..(205): n is a, c, g, or t
tcagcgtagactagcacgaccggtgctcgatttagtgacatctcgcagttctttgggggaggaactgctcagttaggacccagacggaaccatggaaaccccagcgcagcttctcttcctcctgctactctggctcccagataccactggagaagtagtgatgacgcagtctccagccacctgtctgtgtctccgaggggaaagngccaccctcgtcctgcgagggccagtcagcgtgtgcagcaacttgcctggtatcagcagaacctggccaggctcccgaggcctccgtacagtgtagtggtgactatcgaccgagggcctacgttggtctacccgagtccgtagggttccaggttcggacgtagggttcggggttaccgtaggggaacctaggttacgtttccgtccgtcgttacacttccgtaatccgaaggtccaagtccctagccgtaggtactaggtaacgttagtttttcggtacggttttaataccgttagtactaggtactaggtttaactaacgttcgtaacgggttccggtacccgttaccgggtacgggtacccgggtttaccgggaaccggtaaccgggggtaaccgtaaggggttaacggtaaaaccgttacccgaaaaacggtacggttacggtacgggaccgtttacggtacccgaacgttaccgg

SEQ ID NO: 75722 - DNA, 635 bp, Homo sapiens
  misc_feature: GYAE6OF02G2JPW.17.39.D06.1.454.CMB.1.raw
  modified_base (207)..(207): a, c, t, g, unknown or other
  misc_feature (207)..(207): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagngcccaccctctcctgcagggccagtcagagtgttggcagcaacttgccgtgtatcagcaagaacctgccaggcctccaggcctcncagtcgtatggtncagtcctaccgagggtcctacgtcggtcgtcccagcccgtaggttccaggtcggactagggtcggggtctaggggacctaagggtcgtttcctctatccgtatcaacgttcacgcctaagcccttagccgtagtcgtaaggtaacgttagttttcggtacgttttacttcggttacgtacgtacgtacgttaagttaacttaaacgttcggtaacggttccggcccgttacgggtcgggttaccggttacggaccggtaaacggggtaccgtaagggtaaacgtaaaccgtaagaacggttacgtggtaccggtacctacggacctaacg

SEQ ID NO: 75723 - DNA, 538 bp, Homo sapiens
  misc_feature: GYAE6OF02IQBZB.17.39.D06.1.454.CMB.1.raw
  modified_base (204)..(204): a, c, t, g, unknown or other
  misc_feature (204)..(204): n is a, c, g, or t
  modified_base (416)..(416): a, c, t, g, unknown or other
  misc_feature (416)..(416): n is a, c, g, or t
  modified_base (462)..(462): a, c, t, g, unknown or other
  misc_feature (462)..(462): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttggcagcaacttgcctggtatcagcaagaacctggccaggctcccgaggcctcctcagtgtatggtgcatcctaccgagggccacgtggtcgcccgagccgtaggttcaggtggctaggtcgggtctggggactaggtgttctcgtctcatcatcgagcagcctgcagtctaggaagttntttggcgtttatactgtcagctagtatagtgcgtcggcccttcggnggtcgttccggaccgtaaagggaccctaagggtacgaaacgtaccgaaacggtacgtggtacggctcgactaaccg

SEQ ID NO: 75724 - DNA, 577 bp, Homo sapiens
  misc_feature: GYAE6OF02GIAUV.17.39.D06.1.454.CMB.1.raw
  modified_base (205)..(205): a, c, t, g, unknown or other
  misc_feature (205)..(205): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgccagggccagtcagagtgttggcagcaacttagcctggtatcagcagaacctggccaggcctcccaggcctccgtcatgtatggtgcactctaccgagggcccacgtggtcgtcccagcccgtaggttccaggtcggctaggtcggggtctggggacaggtacgtttctcgtcgtctaatcgtatcagcacgtccctgaccgtagtcctaggaagttgttttgcggttttaattcgttgtacgtagtactagttatagtcgtaggtcgtccgttcgggtcggtacgttcggaccggaaggtaacccgaagggtacgtaaacgtacgtaaacgtacgtggtacggacttggactaaccg

SEQ ID NO: 75725 - DNA, 789 bp, Homo sapiens
  misc_feature: GYAE6OF02GP5TC.17.39.D06.1.454.CMB.1.raw
tcagcgtagactagcacgaccggtgctcgatttagtgacatctcgcagttcgtttggggaggaactgctcagttaggacccagacgggaaccatggaacgccccagcgcacgcttctacttcctcctgctacgtctggctcccagataccactggagaagtagtgatgacgtcagtctaccagccaccctgtctgtgtctccgaggggaaagcgccaccctctccgtgcgagggccagtcgagtacgtggttggactagactaacttagcctaggtaactcgaacgaccaacgtaaaccgtcggaccacggtaccctaccccggaggcccttccgtaccgtacgttacggttaacgttcgggtaccactaacgttaccgttaacccgagggtccctaacggttcgggtaccctaccccgaaggtaccccgtaaagggtttccgaaggttacgggactaacggggttcggggttactaagggggtaactagggttactttccgacttacgtacgtacgttacaagttccaacggtcctaacgtccgtacggtacctagttacgtaacggttaacgttttacgttttcggaaccgttttaagttttacgttaacccgttcgttaacgacggttaaccgttaagtaacgttaaacgcggttaaacggttccgggtccgttacgggttacgggtaaccggtttccgggaaacccggttaaacgggtaaccggtaaagggttaacgtaaactaaccggtaaacggtaccgttaggtacggttacaggtaacccg

SEQ ID NO: 75726 - DNA, 724 bp, Homo sapiens
  misc_feature: GYAE6OF02JBXDX.17.39.D06.1.454.CMB.1.raw
  modified_base (206)..(206): a, c, t, g, unknown or other
  misc_feature (206)..(206): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctaccgaggggaaanagcccaccctctcctgcgacgggccagtcagagtggttggcagctaacttagcctggtatcagcaagaaacctggccaggcctcccaggcctcctctagtgtagtggtcgctatccgaccgacggcctaacggtcggtcgtacccaggtacccgtaggtttcgacggtgggacctagggttcgggttctaggggaacctaggtacgtttcctaccgtcgtaccgtatccagttccgaaggtacctacggcccgttaggaccctaaggttcctaaggtaaacgtttgtttacggtacttaacggttttacttaccgttgtacgtaacgtacgttaagttaacgttaacgtcggtaacggttcgggtttaccccgttaccggttacggggttaccgtttacccggggaaaccggttaaaccggggtaaacccggttaaagggggttaccgtaaaaaccggtttacccggaaaaacgggttaaccgttacggggtaccggttacccgtacggtaaccccgg

SEQ ID NO: 75727 - DNA, 290 bp, Homo sapiens
  misc_feature: GYAE6OF02I9TTN.17.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagagtgttggcagcaacttagcctggtatcagcagaactggcagctccagctcncntgtag

SEQ ID NO: 75728 - DNA, 623 bp, Homo sapiens
  misc_feature: GYAE6OF02JNERD.17.39.D06.1.454.CMB.1.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (269)..(269): a, c, t, g, unknown or other
  misc_feature (269)..(269): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (516)..(516): a, c, t, g, unknown or other
  misc_feature (516)..(516): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgaatgacgcagtcctccagccaccctgtctgtgtcctcaaggggaanacgccacctctccngacaggccagtcagagtgtggcagcaattgcctgtatcagcaagaaccngccaggcctaccgagctcgcatgtactggcaccatccgtaaccgaggggtccctacggttcggtccgtaccccgaggacctaacgggtttcaacggtgggtcctaagggttcgggtcgtagggacctaggtcgtttcncgttcnctatcatccgatcacgtcctagctacgacttggtaaacttgttttgtaccggtttaattcgttcgtacaaggtcttaaagtactttaacgctaacgggttccnccgttaccggtaggtacccggtaccggacggtaaaccgggtaacgtaagggttaacgaaaccgttacgaaacccggttaggtcgtacgggacttcgaccttaaccgg

SEQ ID NO: 75729 - DNA, 750 bp, Homo sapiens
  misc_feature: GYAE6OF02GK2JW.17.39.D06.1.454.CMB.1.raw
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgccaccctctcctgcagggccagtcagagtgttggcagcaacttgcctggtatcagcaagaacctggccaggcctccgacggctcctcattggtatggtcgctagtcctaccgagggtccctacgttggtccgtaccccgaggtcccgtaacgggtttcaggtcggcgtagggttcgggttacgtggggacgtaggtacgtttcctacgttctcgtaactcgtacgtccgaggtccgaacgtcccttaggcccgtaagttcgttaggtaaacgtttgtttttacgggtacggttttttaactttaccgtacggtttccgaacggttacgttaacggttaaactttaacggttaaccgtacggggttacccgggttacccgttaccgggtttacggggttaccccggttttaccgggggaaacccgtaaaacgggggggtaacccgtaaaaggggggttaaggttaaaaacccttaaccgggtaaaaacgggttaaccgttcggggttaaccgggtaccgtttaccgggacccttaaccccggg

SEQ ID NO: 75730 - DNA, 557 bp, Homo sapiens
  misc_feature: GYAE6OF02F5Q3N.17.39.D06.1.454.CMB.1.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (375)..(375): a, c, t, g, unknown or other
  misc_feature (375)..(375): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggcccagtcagagtgttggcagcaacttagcctggtatcagcagaacctggccaggcctcccaggctcctnatgtatggtgctatcctaccgagggcccatcggtcgtcccagcccaggttcaggtgcaggtgggtctgggactaggcgttcnctctcatcatcagcagcctgcagtctagacgttgtttcgcgttttataccgtgtacagtctaagttaattagtctaaggtcgtacccgttccgggtggtaccggttccggaccgaaacggggtaaccctaaggggttacgaaataaccgaaacggtacgttgggtacgacttggactaaccg

SEQ ID NO: 75731 - DNA, 644 bp, Homo sapiens
  misc_feature: GYAE6OF02GJQYG.17.39.D06.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (303)..(303): a, c, t, g, unknown or other
  misc_feature (303)..(303): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccacctgtctgtgtctcaggggaanagccacctntcctgcagggccagtcagagtgttggcagcaattcgcctggtatcgagcagaacctggccaggcctacccgaggcctcgtcagtgtatcggtnctatccgtaaccgagggtcccacgttggtcgtcccagccgtaggttcaggtcggctagggttcgggtctaggggaacctaggtactttcctcctcgtactacgtcatcgtacgcctacgcccttgaccgtagttcgtaaggtaagtttagtttttcggtacggtttttacttacggttacgttaccgaagtcggtaaatttaattacggtacctacggttaggtcccgttacgggttaccggtaccggtttaccggaacccggtaagggtaacccgttaaggggttaacgaaacgttaacgaaacgttacggttacggtacggtcgtacgtaccgtacccg

SEQ ID NO: 75732 - DNA, 572 bp, Homo sapiens
  misc_feature: GYAE6OF02JERK0.17.39.D06.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (365)..(365): a, c, t, g, unknown or other
  misc_feature (365)..(365): n is a, c, g, or t
  modified_base (417)..(417): a, c, t, g, unknown or other
  misc_feature (417)..(417): n is a, c, g, or t
  modified_base (433)..(433): a, c, t, g, unknown or other
  misc_feature (433)..(433): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagngtgtggcagcaacttgcctggtatcagcagaaacctggaccaggctcccaggcctctcatgtagtggtgcatctaccagggcctagtggtctccagcccaggttcagtggctagtgggtactggggacaagngttcctgtctcatccatcgagcagctgcagtctagatctttgcttaagtttnttactgtacacgttanacgtttaataacgtcgtacggttacggaccctttacgggtcggttaaccggtttacccgggaaccggtaaccggggtaaacctaacggggtaggtaaacgtaccgaaacgttaccggtagtcgggtacgtcgtaacccg

SEQ ID NO: 75733 - DNA, 636 bp, Homo sapiens
  misc_feature: GYAE6OF02IH2UO.17.39.D06.1.454.CMB.1.raw
  modified_base (208)..(208): a, c, t, g, unknown or other
  misc_feature (208)..(208): n is a, c, g, or t
  modified_base (306)..(306): a, c, t, g, unknown or other
  misc_feature (306)..(306): n is a, c, g, or t
  modified_base (379)..(379): a, c, t, g, unknown or other
  misc_feature (379)..(379): n is a, c, g, or t
tcagcgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagcccaccctgtctgtgtctccgaaggggaaangccaccctctcctgcagggccagtcagagtgttggcagcaattgcctggtatcagcagaacctggccaggcctcccgagcctcctcagtgtactggtnacatctaccgagggccacgtggtctcccagcctaggttcaggtggcaggtcgggtctgggacaggtacgttcnctctacatcatcagctagcctgctagtctagaagttacgttttggacgttttaataccgttggtaccaaggtctaaagtttaactaaacgttcgtaacggttcgggtaccccgttacgggttacgggtaacccgtttccggggaacccggtaaaacggggtaacccgttaaagggggttaacggtaaaaacctaacccggtaaaacgggttaaccgttaggggttaccgggtaacgttaccggaacccgttaacccg

SEQ ID NO: 75734 - DNA, 751 bp, Homo sapiens
  misc_feature: GYAE6OF02H6H4S.17.39.D06.1.454.CMB.1.raw
  modified_base (212)..(212): a, c, t, g, unknown or other
  misc_feature (212)..(212): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggcctcccagactacccactggagaagtagtgatgacgcagtctccagccctacctgtctgtgtctccgaagggggaaacncgccaccctctctgcacgggcagtcagagtgttggcagctaacttgcctggtaatcagcaagaaacctggaccagctacccgaggtccctcctacagttcggtagtcggtcactaacgttcccgtaccgagggtccctaggttcgggtccttacccgacggtcccgtaagggtttaccagggttacggcgtacgggttcggggtcctagggggaactacgggttacttcgtttaccgtcgtactactacgtaacttccgaaggacctacggtaccgtacggcgttaacggttccgttaagggttaaacgtttggtttttaccgggttacggttttaacttaccggttgtaccgtacgttacgtaaggtttaactaacgttaccgtaacgggttcggtaccccgttaccgggttacggggtacccgtttaccggggaacccggtaaacggggtacccggttaaaaggggtaccggttaaaactaaccggtaaaacggttacggtacgggttacggtaaccgttccggaaccggtaacccg

SEQ ID NO: 75735 - DNA, 536 bp, Homo sapiens
  misc_feature: GYAE6OF02FWNTU.17.39.D06.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
  modified_base (414)..(414): a, c, t, g, unknown or other
  misc_feature (414)..(414): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttggcagcaacttgcctggtatcagcaagaacctggccaggcctcccgaggcctcctcatgtatggncatcctacgngggcctactggtctcccagccaggttcaggtgctaggtcgggtctagggacaggtacgtttcctcgtctcatcatcagtcacgcctgctagtctagtagttnttttgggacgttttattacgtgtctagtactagttatagtcagtcggccgtcggttgcgttcggacgtaacgggtaccgtagggtacgaactacgaacgtactggcgtacgtacgctaaccg

SEQ ID NO: 75736 - DNA, 597 bp, Homo sapiens
  misc_feature: GYAE6OF02IRVN4.17.39.D06.1.454.CMB.1.raw
  modified_base (205)..(205): a, c, t, g, unknown or other
  misc_feature (205)..(205): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagngccaccctctcctgcagggccagtcagagtgttggcagcaacttagcctggtatcagcaagaaaccctggaccaggctcccgaggcctcctcatgtagtggtgcatcaccgagggccacgtggtcgtcccagccaggttcaggtggcgtaggtgggtcgtggggactaggtacgtttcctctcgtctactcatcagcctagccctgctagtcttagaacgttgttttcggtacggtttttaactacgtgtactaagtactaagttaattaacgttacgtaacggttccggtccgttccgggttacggtaccggttaccggaccggaaaccgggtacctaagggtaaggtaactaaccgaaacgtacgtggtacggccgtacgacctaacccg

SEQ ID NO: 75737 - DNA, 772 bp, Homo sapiens
  misc_feature: GYAE6OF02JTYYI.17.39.D06.1.454.CMB.1.raw
  modified_base (231)..(231): a, c, t, g, unknown or other
  misc_feature (231)..(231): n is a, c, g, or t
  modified_base (337)..(337): a, c, t, g, unknown or other
  misc_feature (337)..(337): n is a, c, g, or t
tcagcgtagactagcacgaccggtgctcgatttagtgacatctcgcagttctttgggggaggaactgctcagttaggacccagacggaaccatggaacgccccagcgcagtcttctcttcctcctgctactctggcctcccagactaccagtggagaagtgtgatcgacgctacgtcctccacggccctccgttgttctggtacgtaccgtaccgggaaagggaaactccnccctacccgttctccggtaggaccggtacggttacccaaggtccggtaggtacggttcgggttaccgacgtaacgtaccttaacggtccggtacgttacggtaacnccggaacgtaccgaacggtaccccgccggccgtacggtccctacgcgtactctagtcgtagtcgtcgactcgtacgccgtacggtcgacctacggtaccgtcctaccggagtccgggttacgacggtcgggacgttcgtacggggtacgtacgttcggaacttacgttcgttccctaaacggtctacgtaaccgtccgttaacgtcggtacgtaccgtacgtcgttacgtacggttacgttacttaagggtttcctttacggtttacgttacgtactcggtacgtaccgtaagtaccgttaattccggaggttacccgttacgggttccgtaaccggtttccggggaacgttacggtaacgggtaacggtaacggtaacggttaacggaacttacgtaacggtacggtacgtccgtacgtactccgtacgttacg

SEQ ID NO: 75738 - DNA, 663 bp, Homo sapiens
  misc_feature: GYAE6OF02JAR28.17.39.D06.1.454.CMB.1.raw
  modified_base (205)..(205): a, c, t, g, unknown or other
  misc_feature (205)..(205): n is a, c, g, or t
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
tcagcgtagactagcacgaccggtgctcgatttagtgacatctcgcagttctttgggggtaggaacgtgctcagttaggacccagacggaaccatgaagccccagcgcagcttctcttcctcctgctactctggctcccagataccactggagaagtagtgatgacgcagtctccagccacctgtctgtgtctccgaaggggaanagccacctctcctgcagggcccagtcagagtcgttggcagcaactttagcctggtatcgagcaagaaacctggacctagcctccgaggctcctcntagtactgggtnacacttccgtaccgacgggtcccaacggttggtacgtcccaacggccctaagggtttcgacttggggcctagggtcgggtactaggggacctaggtacgtttcnctcgtacacgttcagtcacgnacgtccgtgactacgtcgtagtaaacgttgttttcggtacggtttttatacggttcgtacgtaagtacgtaacggttaattaaacgtcttaacggtccgttaccggttcgtacgggtaaccgtttcgggtaacccgaaacggggttaacccgtaaggggtaacggtaaacgtaaccggtaaacgttaccggttagggtaccggtaccgtacggtaccctaaacccg

SEQ ID NO: 75739 - DNA, 817 bp, Homo sapiens
  misc_feature: GYAE6OF02GE9RN.17.39.D06.1.454.CMB.1.raw
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
  modified_base (267)..(267): a, c, t, g, unknown or other
  misc_feature (267)..(267): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagcccaccctgtctgtcgtctccgaaggggaanacgcccaccctctcctgcacgggccagtcagngtgttggcagctaacttagcgtaggtancgagcaagaacctggaccaggcctacccgacggtcctcctcagttgtacgtggtcgactactaccgtaaccggagggtccctacggttcggtccgtaccccacgggtccgtaacgggtttaccaggggttcggacggtaggggtttcggggtacggtaggggaacctagggttacgtttccttccgttaccgtcgtaaacgttcctaacgtaccgaacggtccgtacgggtacccgttcggaacgtacggtttacggtaacggttaaaggtttttaccggtttttacggggttaaccgggttttttaacttaccgttacggttaccgtaagggttacctttaaaggtttaaaacgttaaccgttacgttaacggggttccccggttaccccgtttacgggggttaccgggttacccgggttaccgggtaaacccgggtaaacgggggtaaacccgttaaagggggttaaacccggtaaaacgtaaccccgggtaaaacggttacgggttaaccgggttccgggtaaccggttaccgaacccgttaaccgg

SEQ ID NO: 75740 - DNA, 567 bp, Homo sapiens
  misc_feature: GYAE6OF02FMIQE.17.39.D06.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (423)..(423): a, c, t, g, unknown or other
  misc_feature (423)..(423): n is a, c, g, or t
  modified_base (451)..(451): a, c, t, g, unknown or other
  misc_feature (451)..(451): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagngtgttggcagcaacttagcctggtatcagcagaaacctggaccaggcctacccgaggcctcctcattgtatggtgcatcctaaccgagggcccacgtggtcgtcccagcctaggttcagttggcaggtgggtctggggaccaggtacgtttctcgtctctatcatcaagcagcctgcaggtctagaagttntttcggcgttttattacgtgttacagtntaagttataacttcgtaggttcggtcccgttcggttacgggtaccgttcggaccggtaacgggtaacgaacgggtaggtaactacgaaaacgtacgtaggtagcgtacgctaaccg

SEQ ID NO: 75741 - DNA, 758 bp, Homo sapiens
  misc_feature: GYAE6OF02FFDTP.17.39.D06.1.454.CMB.1.raw
  modified_base (205)..(205): a, c, t, g, unknown or other
  misc_feature (205)..(205): n is a, c, g, or t
  modified_base (326)..(326): a, c, t, g, unknown or other
  misc_feature (326)..(326): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctgctcccagataccactggagaagtagtgatgacgcagtctccagccacctgtctgtcgtctccgaggggtaacncgccaccctctccctgcagggccagtcagagtgttggcagctaacgttacgccgtaggtactcgagacaacggtaaacctcgggaccctaacgggccctaccccgacggtccttcccgtanacgttacggttagtacgggtctaccgtacgtacccgtaccggaacgggtccctacggttcggtcccgttacccggacggtaccggttacggtacgtagggtccggacgtacgggttcgggtacgtaggggaccgtaggtcgtttacctcgtaccgttacactacgtacgtacgacgtaccaccggtccgtaggaccgtacgttaggtagttaaacgttttcggtttaccgtacgtttttaactccggtacgtacgacgttaacgtacgttaaacgtacgttacgggtaccggttccggttaccgttaccggggtacgggttaccgaacccggaaccgggttaaaccggggtaccgttaaacggggtaaccttaaaccgaaaccgttaacgggacggttaccggtcgggtaacctaccggtaacccttaccgg

SEQ ID NO: 75742 - DNA, 721 bp, Homo sapiens
  misc_feature: GYAE6OF02HYGDS.17.39.D06.1.454.CMB.1.raw
  modified_base (204)..(204): a, c, t, g, unknown or other
  misc_feature (204)..(204): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaancgccctaccctctcctgcgacggccagtcgaggtacgttggttcggcacgacctaacgttcgtcccgttaggttactacgacgacgaaacggtaaaccccgtgggacccgagggtcccttaccccggaggtcccttcccgtactagtaggttaggtcggtgcctaacttccgtaaccggacgggccctacggtcggtcgtccccgacgtaccgtagggttccagggtcggtacgtagggttcgggtacgtacggggacgtacggtagtttcccgtctcctacgtactctaacgtaccgacgcgaacgtcctcgacctacgttagtacggtaagtttacggttttcggttacgtttttaacgtccgtttcgtaagtacgtaacgttagttaactacgtgtaacggtcgtccgttaccggtaggttaccggtaccggtacggaaacgggtaccggtaaggtaacggtaaaccgtaacggtaaccggtaagttcggtacggtacgtacggtactaaccgg

SEQ ID NO: 75743 - DNA, 753 bp, Homo sapiens
  misc_feature: GYAE6OF02H5EJK.17.39.D06.1.454.CMB.1.raw
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaagagccaccctctcctgcgacgggccagtcgagagtgttggcagcaacttagcctggtactcagcagaaacctggaccaggcctcccaggcctcctacagtgtatggtacgctactacctaccgacgggtccacgtcggtcgtacccgaggcccgtagggttcaggttcgggaccgtagggtcggggtcgtacggggaactaggttacggtttctaccgttctaccgtacttaccgtaagttccgaacggtactaccggtcccgttacggtaccgtacggttaaccgttagggtaaaacggtttacgttttttcgggttaacgggttttttaactttaccgggttacggttacgtaaaccggtcgttaaaacggttaactttaaacggttccgttaaagggttccgggttaccccgtttacggggttaccgggtacccgggttttacccgggaacccggttaaaacgggggtaacccgttaaaggggtaaccggtaaaacgttaaccgaaacggttaacgtcgggttaggtaccgtacggtaccctaacgg

SEQ ID NO: 75744 - DNA, 506 bp, Homo sapiens
  misc_feature: GYAE6OF02G94HP.17.39.D06.1.454.CMB.1.raw
  modified_base (206)..(206): a, c, t, g, unknown or other
  misc_feature (206)..(206): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (389)..(389): a, c, t, g, unknown or other
  misc_feature (389)..(389): n is a, c, g, or t
  modified_base (441)..(441): a, c, t, g, unknown or other
  misc_feature (441)..(441): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccaccctctcctgcagggccagtcagagtgttggcagcaacttagcctggtatcagcaagaacctggcaggctccagctcnatgtatggncatcacaggccacgtgctccagccagttcagtgcngtgggctgggacngngttcnctctnatcatcgagcagcctgctagtctaggtagttnttttgtcgtttattacctgtctagctaagtattaatcaaggtcgccgttcgnggtacgttcggacggtaacggaccaagggtagaactacgaacggtactggaggcctagcctaacg

SEQ ID NO: 75745 - DNA, 619 bp, Homo sapiens
  misc_feature: GYAE6OF02GVTIR.17.39.D06.1.454.CMB.1.raw
  modified_base (205)..(205): a, c, t, g, unknown or other
  misc_feature (205)..(205): n is a, c, g, or t
  modified_base (457)..(457): a, c, t, g, unknown or other
  misc_feature (457)..(457): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactcttgctcccagataccactggagaagtagtgatgacgcagtctccagccacctgtctgtgtctccgaaggggaaancgccaccctctcctgcagggccagtcagagtgttggcagcaacttagcctggtatcgagcagaacctggccaggcctcccgaggtcctccgtacagttcgtagtcggtacgcctagttcctaaccgagggtccctacggtcggtaccgtaccccgaggtcccgtacgggtttaccaggtcgggacgtagggttcgggtcgtaggggaactaggtacgtttctcgtctactactctactcgacgcacgtccgngctagtacgtagtaagttgttttcgtacgttttagtacgtgtacgtagtctaagttaactagtcgtacggtcggtcccgttcggtaggtaccgttcgggaccgtaagggaccgtaagggtacgtaagtaccgaaacgtcgtaggcggtactacgactaaccg

SEQ ID NO: 75746 - DNA, 657 bp, Homo sapiens
  misc_feature: GYAE6OF02FI40L.17.39.D06.1.454.CMB.1.raw
  modified_base (204)..(204): a, c, t, g, unknown or other
  misc_feature (204)..(204): n is a, c, g, or t
  modified_base (309)..(309): a, c, t, g, unknown or other
  misc_feature (309)..(309): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaaacctggaccaggcctcccgaggcctcctcatgtactgggtcnctactctaaccgaggggtcccaacggttggtactcccaggccctagggtttcaggtcggcgtaggtcggggtctaggggaacaggtacgtttcctacttcgtacgtatcctaatcgaacgccacggtcccttggactacggttctaggtaaaggttacttttggaacggtttttattaaccgtcgttacaggtctaaggttaattaactcgtaagttcggtcccgttaccgggttagggtacccggtttacgggaccggtaaacggggtacccggtaaagggttaaccggaaacgtaacccggaaaacggttaccgttagggtacggtacgttacggacccttaaccg

SEQ ID NO: 75747 - DNA, 701 bp, Homo sapiens
  misc_feature: GYAE6OF02IG3KM.17.39.D06.1.454.CMB.1.raw
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (280)..(280): a, c, t, g, unknown or other
  misc_feature (280)..(280): n is a, c, g, or t
  modified_base (386)..(386): a, c, t, g, unknown or other
  misc_feature (386)..(386): n is a, c, g, or t
tcagcgtagactagcacgaccggtgctcgatttagtgacatctcgcagttctttgggggaggaactgctcagttaggacccagacggaaccatggaacgccccagcgcagcttctcttcctcctgctactctggcctcccagactaccactggagaagtacgtgatgacgcagtcctccagcccaccctgtctgtgtcctaccgaggggaaancgccaccctntcctgcgacgggccagtcagagtgttggcacgactaattcgccgttaggtactacgngacaacgtaacccgtggacccaggccctcccggaacggtcccttcctaccagttgagtcggtcacgtactccgtaccgcggtacccctagttcggtccggtacccncgacgttaacgggtttcacgggttcggacggtacgggttcgggtcgtaaggggaacctaggtttccgtttcgtccgtaactcgtaccgtcgtacgtacgtacgtcgacgtcgtacgcgtacgttcgtaaggttaacgttgttttacggttacgttttacacgtttcgtacgtacgtacgtaaggttaacttacgtacgtcggtcggttacccgtggttcggtaccggttaccggtaaccgaacgggtacccggtaaggtaacgtaaaccgttaacgtaaccgtaggttacggaacgggtcttacgacccgttacg

SEQ ID NO: 75748 - DNA, 693 bp, Homo sapiens
  misc_feature: GYAE6OF02IKM63.17.39.D06.1.454.CMB.1.raw
  modified_base (205)..(205): a, c, t, g, unknown or other
  misc_feature (205)..(205): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcagggccagtcagagtgttggcagctaacttagcctggtactcagcaagaaacctggaccaggcctcccgaggccctcctcagttacgtagttcgggtacgctactcctaacccgacgggaccctacgttcggtcgtcccaggtcccgtaggtttcgaggttcggacgtaggtcgggtcgtagggactaggtacgttctctctcactcgactcgagtcacgtcccgtagcgtacgtacttacggttaatttacgtttttacggtacgggtttttaacttaccgttagtcgtaacgtactaagttaaacttacgtacgttaacgggtccgggttacccgttccgggttacggggttacccgggttaccgggtaacccgggtaaacggggtaacccggtaaagggttaacgggtaaaacctaaacccggtaaacgtacggttagggtacccggacgttccgaaccgttaacccg

SEQ ID NO: 75749 - DNA, 756 bp, Homo sapiens
  misc_feature: GYAE6OF02IVXOF.17.39.D06.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcacggccagtcagngtgttgcagcaattagctggtatcagcaacgaaccgtggaccaggcctcccgaggtccctacctcagtcgtagtggtcacacgttccacggtacggtcccgtacgttacggtccgtacccgaacggcccgttagggttccaggtcggtacgtagggttcggggtactcggggaactacggttacgtttcctcttcgtactacgttccgtactccggaagcccgttaacgtccgtcgtaacgtacgtttacgaaggtttaacgttacgtttttcggtaaccgggttttttactaccggtttgtaccgttaacccggtagtttaaacggtttaaactaccggtttaaccggtaacggggtttcccggtacccggttttaacgggtaccggggtttaccggtttacccggggaacccggttaaacggttaaccccgggtaaaggggttaaacccggtaaacgttaacccggaaacggtttacccggtaagggttccggtaacccgtcggttaaacccttacccgg

SEQ ID NO: 75750 - DNA, 650 bp, Homo sapiens
  misc_feature: GYAE6OF02H7PT8.17.39.D06.1.454.CMB.1.raw
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
tcagcgtagactagcacgaccggtgctcgatttagtgacatctcgcagtttctttggggggaggaactgctcagttaggacccagacggaaccatggaagccccagcgcagcttctcttcctcctgctactctggctcccagataccactggagaagtagtgatgacgcagtctccagcccaccctgtctgtgtctccgaaggggaaagacgccaccctctcctgcgagggccagtcaggagtgttggcagcaacttagcctggtactcagcaacgaaacctggccaggcctcccgaggcctccnctatgtatggtcnctactccgtaccgacgggcctacgtggtcgtacccgagcccgtagttcaggttcggacgtaggtcgggtcgtagggtacgtaggtacgtttcctaccttctactatccaagttccgacgtccgagtcccgtaggtcgtaaggttccgttaaggtaaacgtttagttttcggtttaacgttttaataccgttggtaccgtaacggtctaagttaacttaacgtcgtaaggtcggtcccgttcggtacggtaccggttaccggtaccggaagggtaccgtaagggtaacgtaaacgtaccgaaacgtacgtggtacggacgttacgacctaccg

SEQ ID NO: 75751 - DNA, 739 bp, Homo sapiens
  misc_feature: GYAE6OF02GGPHY.17.39.D06.1.454.CMB.1.raw
  modified_base (203)..(203): a, c, t, g, unknown or other
  misc_feature (203)..(203): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgagggaangccaccctctcctgcagggccagtcaggagtgttggcagactaacttcgcctggtactcgagcaacgtaaccgtggacctaggcctaccccgaggccttccgtactagttcggttagtcgggtcactacttacccgtaaccgacgggaccctacggtggtaccgtacccgagtcccgtaaggggtttcccagggttcggacgtacgggttcggggtaccgttggggactacgggtacgtttcccgttacgttacctcgtaacgttcacggttaccgacggtaccgtacgaccgttcggacttacggttcgttaacggttaagtttacggtttttaggttaccgtttttaatttaccggtagtttaccgaacggttattaaggtttaacttaacgttcggtacgggttacccgtcccggttacgggtttaccggtaccggttccgggaacccgggttaaacgggaccgttaaacgggggtaataaaacccgtccggaaacggtagttacggtaccggtacgtaccgacttaacccgg

SEQ ID NO: 75752 - DNA, 674 bp, Homo sapiens
  misc_feature: GYAE6OF02HC9IA.17.39.D06.1.454.CMB.1.raw
  modified_base (204)..(204): a, c, t, g, unknown or other
  misc_feature (204)..(204): n is a, c, g, or t
  modified_base (306)..(306): a, c, t, g, unknown or other
  misc_feature (306)..(306): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccacctgtctgtgtctccgaaggggaangcccacctctcctgcagggccagtcagagtgtggcagcaacttgcctggtactcagcaagaacctggaccaggcctcccgaggcctccgtcagtgtatggtncattacgtaccgacgggcctacgttggtctcccgaagtcccgtaggttccgaggttcggacgtagggttcgggtacgtcggggaactacggttacgtttcctacgtttcctactacttactaacgtaccgacgtaccacggtccgtgaccgtacgttcgttaagtaacgtttcggtttttaggtaccgtttttaacttaccgttacgtacgtaagttacgtaacgtttaaattaacgtgttaacggttccgtccgttacgggttcggtacggtttccgggaaccggtaaacgggtaaccgtaaagggtaacgaaacgttaaccggaaaccggtaacggttgggtaccggtcgttacggaccttaaccg

SEQ ID NO: 75753 - DNA, 605 bp, Homo sapiens
  misc_feature: GYAE6OF02G19QR.17.39.D06.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (330)..(330): a, c, t, g, unknown or other
  misc_feature (330)..(330): n is a, c, g, or t
  modified_base (420)..(420): a, c, t, g, unknown or other
  misc_feature (420)..(420): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccacctgtctgtgtctaccgaggggaangccacctctcctgcacggccagtcagngtgtggcagcaatcgctgtancancaagaccngccacggcctccgagtcctctcagtcgtagtggctactctacctaccgaggccctaggtcggtaccnccgaacgccggtaaggtttcagggtcggtctaggggttcggtcgtacgggacaggttactttctcctctcgtactcgacgtcacgtacgngctacgctagtctagtacgttagtttcgtagttttactacgttgtctacgtataagttacttaacgtacgtggtccgtcccggtacgggtacggttaccggtaccggtaacggtaacgggtaacgttaaacggacggttaaacgtacgaaaccggttaggtacggtacggacgtaccgactaccg

SEQ ID NO: 75754 - DNA, 647 bp, Homo sapiens
  misc_feature: GYAE6OF02JW9GC.17.39.D06.1.454.CMB.1.raw
  modified_base (210)..(210): a, c, t, g, unknown or other
  misc_feature (210)..(210): n is a, c, g, or t
  modified_base (497)..(497): a, c, t, g, unknown or other
  misc_feature (497)..(497): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
  modified_base (531)..(531): a, c, t, g, unknown or other
  misc_feature (531)..(531): n is a, c, g, or t
  modified_base (547)..(547): a, c, t, g, unknown or other
  misc_feature (547)..(547): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggcctcccagactaccactgggagaagtagtgatgacgcagtctccagccaccctgtctgtcgtctccgaaggggaaancgcccacctctcctggcagggccagtccagtagtgtggcagactaacttcgcctaggtactccgagtccaagaacctggaccaggcctcccaggtcctcctacgatgtaacgtgggtcacttacgtccgaacgacgggtacctacgtgggttaccacccgaggtcccgtaaaggtttacgaggttcgggactacggggttcgtacggacggggtaacctagggttaccgtttaccgcctttacacgtactaccgtaactcgaacgttcgacgtccgtggacttacgngtacgttatggtttcgtaacgttntaccngttanacgtactagtatactntcgggtcctaccgtacgacggttacctacggaccgtaaacggcggttaacgtaaggtaaacgactaaacggttcgcggttacgaggttcaccccgtaagg

SEQ ID NO: 75755 - DNA, 694 bp, Homo sapiens
  misc_feature: GYAE6OF02GSFTA.17.39.D06.1.454.CMB.1.raw
tcagcgtagactagcacgaccggtgctcgatttagtgacatctcgcagttctttgggggaggaactgctcagttaggacccagacggaaccactggaagccccagcgcagcttctcttcctcctgctactctggctcccagataccactggagaagtagtgatgacgcagtctccagccaccctgtctgtcgtctccgaggggaaagacgcccaccctctcctgccgacgggccagtcagtagtgtcggcagcaacttagccgtggtactcagaccaagaaccgtggaccaggcctacccgaggtccctacctcagttggtagtgggtcactacgtaccgtaaccggacgggaccctacggttcggtaccgtaccccgacggtaccgtacggggtttcgaggttcggacgtagggtcggggttcgtaggggtacgtaacgggtctttccgtcgttactcgtaacttccgaacttccgacgtccgaacgtcccgtagaccgttagttccggtaaggtaacgtttacgtttttcggtacgttttaacttcgtacgttcgaggttactaaggttactaagtccgtaggtccggtccttccgggtagtaccgggtaccggacggtaacggtaacggtaacggtaacgtaaacgtaaccgaaacgggtcgttaggtaccggtacgtacggcctaaccgg

SEQ ID NO: 75756 - DNA, 663 bp, Homo sapiens
  misc_feature: GYAE6OF02JOVD1.17.39.D06.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (434)..(434): a, c, t, g, unknown or other
  misc_feature (434)..(434): n is a, c, g, or t
tcagcgtagactagcacgaccggtgctcgatttagtgacatctcgcagttctttgggggtagggaacgtgctcagttaggacccagacggaaccatggaagccccagcgcagcttctccttcctcctgctactctggctcccagactaccactggagaagtagtgatgacgctagtctccagccaccctgtcngtcgtctaccgaaggggaaggtacncctacccgtcncctgcacgggccagtcgagtagtgttggctagactaacgttacgccgtggtatcagtacaacgaacctggaccaggtcctaccctacggctcctcgatacgtagtggtcgactacgtctacccggaagggcctagtcggtctacccgaggtacctaggttcgaggttcggcgaggttccggggtagtcgggacaggtaccgttcncgtactcgtactcactcgaacgtcacgtccgtagcgtactcggtagttacgttagttggttaccgttttatacgttacgtacgtacgacgtaagttacctaaggttctaacgggtcctaccgggttccgttagggtaccggtttacgggacccggtaacggggtaactaacggggtaacggtaactaacggtaacgtacggttagttacgggcctacggttacccacgg

SEQ ID NO: 75757 - DNA, 750 bp, Homo sapiens
  misc_feature: GYAE6OF02IUF4X.17.39.D06.1.454.CMB.1.raw
  modified_base (209)..(209): a, c, t, g, unknown or other
  misc_feature (209)..(209): n is a, c, g, or t
  modified_base (547)..(547): a, c, t, g, unknown or other
  misc_feature (547)..(547): n is a, c, g, or t
  modified_base (595)..(595): a, c, t, g, unknown or other
  misc_feature (595)..(595): n is a, c, g, or t
  modified_base (630)..(630): a, c, t, g, unknown or other
  misc_feature (630)..(630): n is a, c, g, or t
tcagcgtagactagcacgaccggtgctcgatttagtgacatctcgcagttctttgggggaggaacgtgctcagttaggacccagacggaaccatggaagcccagcgcagcttctcttcctcctgctactctggctcccagactaccactggagaagtagtgatgacgcagtctccagccaccctgtctgtcgtactccgagggggaaanacgtccaccctctcctgcgacgggaccagtccgagagttcggttgacgagaccaacgtttacggccgtacggttaatccgaagtcccaaaaggtaaaccccgttggaccacggggtccccttaccccaaagggtcccggttaccctctaaggttcggttacgttaagggttcgctaaactttccgttaacccgacggggtactacccgtggtacctcccggtaacgacctaacgggtttccgttaaggcgggactacggggttcggttccgggagggtacccaagggtcgtttttcccggattaccgtacgtacgtaccgtatacgacgtcacggtcncgtcacgtagtcgttagtagtttcgtacgggttttattacggtacgtntaccggtataccgttaaattagacgtttaaccggnggttacccgttacgttcgggaccctttcgggtaaccgaacggggtaacctacggggtaaaacggtacggtaaacctaacgggtaaccgttggtaaccggcgtaacccggtaccctaacgg

SEQ ID NO: 75758 - DNA, 806 bp, Homo sapiens
  misc_feature: GYAE6OF02GNRR5.17.39.D06.1.454.CMB.1.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangcccaccctctcctgccagggccagtcaggtagttggttggcagccaacgttagcctggtatcagcaagaacctggccaggcctccaggctccgtnatgatggngcatcgtacgcggcctacgtcggtcgtcccaggccctaggtttccaggttcggcgtaggttcggggtaccgttggggaaccctagggttacgtttacccgtcgttcctaccgtactaccgactaccgacgtaccgtaacggtccccgttcggtacgttaaccggttccgttaacggtaacgggttttaagtttttccgggttaacggttttttaactttaccggtttacggttaccgtaaacgggttacgttttaaacgttaaacgtttaaaccgtttaacggaaaccgggttttccgggtacccccgtttaaccggggttaccggggttaaccccggggtttaccggggaaaccccgggggtaaaaacccgggggttacccgggtaaaaacccggggggtttaaccgggaaaaaacccgtttaacccgggtaaaaaccgggttaccggtttaccgggtttacgggaaccccgttttacggaaccccgttaaccccgg

SEQ ID NO: 75759 - DNA, 746 bp, Homo sapiens
  misc_feature: GYAE6OF02G4SQ3.17.39.D06.1.454.CMB.1.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (395)..(395): a, c, t, g, unknown or other
  misc_feature (395)..(395): n is a, c, g, or t
tcagcgtagactagcacgaccggtgctcgatttagtgacatctcgcgaggttctttgggggaggaactgctcagttaggacccagacggacatggaagccccagcgcagcttctcttcctcctgctactctggctccagataccactggagaagtagtgatgacgcagtctccagccacctgtctgtgtctccagggaangccacctntccngcagggccagtcagagtgttggcagctaacttagcctggtatcagcagaacctggccaggcctcccaggccttacctcactggtactggtcgcatccttaccgaggggcccaacgttgggtacgtcccctaaggcccgaagggttttccaaggttcgggctagggttgggtactcggggaacngggtacgttctaccgtcgtcacttcaacgttcaacggtccaggtcccgttacgccgtacggttacgtacggtaaagtttacgttttttacgggacgggttttttaacttaccgggtttagttacccgttaagggtaccgttaagggttaacgttaaacgtttccgttaaagggttccgggtttaccccggtttacccgggttacgggggttacccggttacccggggttaacccggaaaacggggggtttaaccccgtaaacggggggttttaccgtaaaaacggtttacccggaaaaaccggttaccggtttaacggggccgggtaaccgttcgggtaccctaaacccgg

SEQ ID NO: 75760 - DNA, 770 bp, Homo sapiens
  misc_feature: GYAE6OF02H7LY7.17.39.D06.1.454.CMB.1.raw
  modified_base (208)..(208): a, c, t, g, unknown or other
  misc_feature (208)..(208): n is a, c, g, or t
  modified_base (605)..(605): a, c, t, g, unknown or other
  misc_feature (605)..(605): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggcctcccagataccacgtggagaagtagtgatgacgcagtctccagccacctgtctgtgtcctccgaaggggaaancgcccaccctctccagcagggccaggtcagaggttcgtggacagacaacgttacgccgtaggttatcgagacacgtaaaccgtggccaacggccttaccccgacgggtccctcccgtacctagttacggttaagttccgggtgaccgtaactttccgtaaacccggtacggggacccttaaggttccgggtacccgttacccgaacggtaccccgttaaaggttccgtacggttcgggaccgttacgggttcggggtacgtacggggaaactaagggttccggtttcttaaccgtcgtttaccaacgttcgtaacgttcgaacgtcgtaccgtccgttagaccgttaacggtcgtaaacggttaaaggttccgttttttaggttacccggtttttanaaccggtttgtacgtacgtacgtaagttaaacttaagtcgtaaccggtgtacccgttacggtacgggttaccgttacccggaacggtaacgggtaaaccggtacggtaacggtaaacgttaaccgaaacggttaccgacggttacgtacgtaccgtacgaacccg

SEQ ID NO: 75761 - DNA, 840 bp, Homo sapiens
  misc_feature: GYAE6OF02JLJKC.17.39.D06.1.454.CMB.1.raw
  modified_base (206)..(206): a, c, t, g, unknown or other
  misc_feature (206)..(206): n is a, c, g, or t
  modified_base (511)..(511): a, c, t, g, unknown or other
  misc_feature (511)..(511): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggcctcccagataccactggagaagtagtgatgacgcagtctccagccaccctgtctgtgtctccgaggggaaangccaccctctcctgcgacgggtccagtcaggtagtcggtttggcaggtacctaaacgttacgcccgttgggttaatccgaacgaccgaaacggtaaaaccccgttgggaccccgtaacgggtcccctaccccggaacgggtcccttaccccgtaccgtaatttcgggttaacgttcggggtcgtacctacgtacccgttaaccggacgggaccctcggtccgggttccggtacccacgtacccgtaggtttcgaggttcgggccgtaggttcggggtacgtacgggtaccaggtacggttttccncttacctcgtaactccgattaccgacgcgtacgtcggtctaccggtacggtttcgaaagggttaaacgtttacggtttttacgaccgttttaaacgtttttacggtttaccgttacggttaaccgttacggtaacgtttaacggttaaactttaaacgttaccggttaaggtttcccgggttacccgttaccgggttaccggggtttaccggttacccggggtaaacccgggttaacgggtaaacccgggtaagggttaaccggttaaaacgtaaacccggttaaacgggtaaaccggttcgggtaccggttaccggttaccgaacccg

SEQ ID NO: 75762 - DNA, 716 bp, Homo sapiens
  misc_feature: GYAE6OF02GM79X.17.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (308)..(308): a, c, t, g, unknown or other
  misc_feature (308)..(308): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangccaccctntcctgcagggccagtcagcgtgttggcagctaacttagcctggtatcagcagtaacctggccaggcctcccgaggtcctcctcatgtacgtggtnctacgtcctaccgagggtccctacgtcgggtctaccccgagccgtagggttcacggtgggctaggggttcgggtactacggggactagggttactttcgtcttcgtacctatctaagtcgacgcgtacgtccgtgtacctacggttcgtaaggttacgtttacgtttttcggtacgggtttttactttacggtcgttaacgtacggtacgtttaaggtaactttaacggtaccgtaagggttccggtaccctttccgggttacgggttacccgggtttaaccgggacccggttaaaacgggggtaacccgttaaagggggttaaacccggtaaaaccggttaacccggtaaaaccggttacggttaccggggttacgggtaccccggttacggtaccgtaaaccccgg

SEQ ID NO: 75763 - DNA, 791 bp, Homo sapiens
  misc_feature: GYAE6OF02GWD1Y.17.39.D06.1.454.CMB.1.raw
  modified_base (206)..(206): a, c, t, g, unknown or other
  misc_feature (206)..(206): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccacctgtctgtgtctaccgaaggggaaanagcccaccctctcctgcacgggccagtcaggagtgttcggcagctaacttacgccttggtaactcgagcaaacggtaaacctggacccagggcctacccgaggtccctcctcagtcgttacgtcgggtcgacctaagtcccgtaacccggacggggtaccctacggttcggggttaccgtccccgaaacggtccccggttaaacggggtttcgaacgggtcgggaccgtaggggttcgggggttacgtaagggggtaaacctaaggggttaccgttttcctaccgtttacgtaccggaactttccgaaacgttccgaaagggccctaaccggtcccgttaggaccctaaggttacggttaacggttaaacggtttacgtttttacgggttacgttttaactttaccggtacgttacgtaacggtacttaaacgttaacgtaaccgttacggtaacggttccggtacccggttggtaaccgggttaccgggtttccggaaccggggtaaacgggtaaccgtaaggggtaaccggtaaactaacccggtaaaacggcgttacggtcggtacttacggaccttaacgg

SEQ ID NO: 75764 - DNA, 694 bp, Homo sapiens
  misc_feature: GYAE6OF02IX9VG.17.39.D06.1.454.CMB.1.raw
  modified_base (203)..(203): a, c, t, g, unknown or other
  misc_feature (203)..(203): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttggcagcaacttagcctggtatcagcagaaacctggccgagcctccgagtcctcctctagtgtagtggtcgactactaccgtaaccggtacggacctacggttcggttaccgtacccgacgtaccgtaggttacgaggtcggacgttaggggttcgggttacggtacggggaacgtacggttacgtttcccgttccttccgttacgtacttacgtacgttacgacgtccgtaaccgtccgtagaccgtacggttcgttaaggtaagttttagttttacggttacgttttaacttacgttcgtacgacgtacgtaattaacttaacgttcgtaaggtccgtacccgttcgggtacggttaccggttaccggaaccggtaaccgggtaacggtaacgggtaacgtaaacgtaaccgaaacggttacggttacggtacggtaccgtacgtaccgtaacccg

SEQ ID NO: 75765 - DNA, 634 bp, Homo sapiens
  misc_feature: GYAE6OF02GZFNJ.17.39.D06.1.454.CMB.1.raw
  modified_base (203)..(203): a, c, t, g, unknown or other
  misc_feature (203)..(203): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctccagataccactggagaagtagtgatgacgcagtctccagccacctgtctgtgtctccgaggggaaangcccaccctctcctgcgagggccagtcagagtgtggcagcaacgttgccgtggtatcagcgaagaaacctggacccaggcctacccgaggtccctccctactagttcggtagttcgggtctactacttaccgtacccggacgggtccctacggttcgggtccgtaccccgacggtccgtagggtttcgacggtcggacgtaggggttcgggtacgtaggggactacgggttcgtttcctcgtcgtactatcctataccgagccgtcgccgtagacgtagttcgtaaggtaagtttgtttacggttacgttttactacgttgtactaggtactaagttactagtcgtaggtccgtaccgttcggtaggtaccgtcggaaccggaggaacgtaagggtacgaactacgtaacgtgtcgtggtactcgactacg

SEQ ID NO: 75766 - DNA, 704 bp, Homo sapiens
  misc_feature: GYAE6OF02FN53E.17.39.D06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (293)..(293): a, c, t, g, unknown or other
  misc_feature (293)..(293): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaancgccaccctntcctgcagggccagtcagngtgtggcagcaacttgccttggtatcagcaagaacctggccaggcctcccgaggtctccnctatggtatgggtctacactctaaccggagggtccctaacggttggtaccaccccgtaggtacccgtacggggttttcacggggttcggccgtaaggggttccggggttacggtaggggtaacctagggttacggttccttcgtacgtcgtactacgaatccgtagacctacggtcccgtcgaccgtacgtacgttaaggtaaacgtttagtttttacggttacgtttttaactttaccgttcggttacgacgttaacgtaagttaaatacgttacgtaggttccggtaccggttcccggttagggttaccgggtcggtaaaccggtaacgggtaaccgtaaaggggttaccgttaaaacgtaccgtaaacggtaccgttagggtaccggacgttaccgaccgttaaccgg

SEQ ID NO: 75767 - DNA, 686 bp, Homo sapiens
  misc_feature: GYAE6OF02FQ23E.17.39.D06.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (383)..(383): a, c, t, g, unknown or other
  misc_feature (383)..(383): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccacctgtctgtgtctccgaggggaaancgccaccctntcctgcagggccagtcagagtgtgcagcaattagctagtancancagaacctgcagcctccagctcnatgtatggtnctatcctacgagggcctcgtaggtctaccccgagtccgtaaggttccaaggttggacaacggggttcgggtagtacgggaagtaacgggttnttacctcgttacgtcctaactctaattacgacggtacctaacggcccttaggacctacggttaccgtaggttaacgttagtttttcgtacgggttttaattaccggtacgttacgtacggttaacgtaacgttaacgttaactacgaaaccggttcggtacccgttacgggttaccgggtaccgggtttcccggtaaccgggtaaaccgggtaaaccggttaacgggttaaacgggtaaacgttaaacccggaaaaccggttacgtaacggggtaccgtaccggttaccggaccgtaaccccg

SEQ ID NO: 75768 - DNA, 683 bp, Homo sapiens
  misc_feature: GYAE6OF02HT0HP.17.39.D06.1.454.CMB.1.raw
  modified_base (172)..(172): a, c, t, g, unknown or other
  misc_feature (172)..(172): n is a, c, g, or t
  modified_base (189)..(189): a, c, t, g, unknown or other
  misc_feature (189)..(189): n is a, c, g, or t
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtcnccagcccacctgtctgngtcctaccgaggggaancgccacccttctccngccgaggccagtcgagagtggtggacagactaacttcgccgttaggtactcgagacaacgaaccgtggaccgacggtcctacccgaggtcctacccgtctagttacgtacgttggcctaccgaatttaccgaacccgggaggtccctaacgttcggggttaccacccggaggtcccgtaggtttccgaggttcggaccgtagggttccgggtcgtacggggaattcgggttacgtttcgtccgtttcgtacacggttactaacgcgtacgacgtaccgtcctcgactaggtctaagttagttcgtttacgtaccgtttatccggtagtacgtagacgttaagttaagtacgtacgtcggttacggcccgttacgggaccgggttacgtacggaccggtaaacgggaacgtagggtaacgaaacgtccgaagttaccggaggttaccgacgtacgacctaacg

SEQ ID NO: 75769 - DNA, 732 bp, Homo sapiens
  misc_feature: GYAE6OF02IU7M4.17.39.D06.1.454.CMB.1.raw
  modified_base (205)..(205): a, c, t, g, unknown or other
  misc_feature (205)..(205): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttggcagcaacgttagccgtggtatcagcaagaacctggaccaggcctaccccgaggtccctccgtactagttacggttaacgtgggtcgtaccgtaatacccgtaacccgacgggtcccctacggttcgggttacgtaccccgagaccccggtagggtttaccgacggtgggtacgtaggttcggggtacgtgggggaaccagggtacgtttcctcgttacctcgtacttccgactacgacgtacgaccgtcctagggaccctaacgttccgttaaggtaacgttttaggtttttcggtaaccggttttttaacttaccggttcgttaccgtaacggtattaacggtttaattaacgttccgtaagggttcccgtacccgttccgggttacgggtaccggttacggaacccggtaaacggggtaaccgtaaggggtaacggaaacgtaaccggtaaacgttacgtacgggttcgtacgttacgacccgttaacg

SEQ ID NO: 75770 - DNA, 709 bp, Homo sapiens
  misc_feature: GYAE6OF02IJZT9.17.39.D06.1.454.CMB.1.raw
  modified_base (338)..(338): a, c, t, g, unknown or other
  misc_feature (338)..(338): n is a, c, g, or t
  modified_base (545)..(545): a, c, t, g, unknown or other
  misc_feature (545)..(545): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagactaccactggagaagtagtgatgacgcagtctccagccaccctgtctgtgtctaccgaaggggaaagagccaccctctcctgcgacgggccaggtcagtagtgttcggcagactaaacgtttacgccgttaggtactacaggcaaaggtaaacccctgggacccaacggggccctaccccgaacggtcccttacccncgaattggtacgtcggtcgactacgtttcccgtaaaccgcgggtccctaccgttgggttcccctacccacggtcccgtaacggttcggaaggttccggggactagggttcggggttacgtaggggtaacgaagtttcggttcctttacgtccgtactattccgagtacacgacgtcgccttggactagtacttaggaaacggttttnttttaccggttagttttactacgttagtcgtaagtcgtaaagtttatacgtgtcggtcgtacccgtaggttcggtaccggttcggaccggtaaacgggaccgtaaggttaacgtaaacggtaaccgtaacggtacggttcgacggtaccgtaccgaacctacgg

SEQ ID NO: 75771 - DNA, 676 bp, Homo sapiens
  misc_feature: GYAE6OF02IJN2I.17.39.D06.1.454.CMB.1.raw
  modified_base (80)..(80): a, c, t, g, unknown or other
  misc_feature (80)..(80): n is a, c, g, or t
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (419)..(419): a, c, t, g, unknown or other
  misc_feature (419)..(419): n is a, c, g, or t
tcagcgtagactagcacgaccggtgctcgatttagtgacatctcgcagttcttggggaggaactgctcagttaggacccngacggaaccatggaagccccagcgtagcttctcttcctcctgctactcgtggctcccagactaccactggagaagtagtgatcgacgcagtctccagcccacctgtctgtcgtctaccgaggggaaacncgcccaccctntcctgacgacgggcctagtcaggtacgtcggttcggcctagtcctaaacgtttacgccgttaggtactaccgaacggaccgtaaccgtaaaccggtcggaccgacggtccctaccggacggtcctccgtacgtacgtcgttagtcggtcactacgtccgtacggacggtcctcgtcggtctaccgacgtccgtggttcnggtcgtacgtacggttcggtcgtacggactacggttacgttcctacgtcctactacgtacgtacgtcacggcacgtcgtcgtacgtacgtcgtacgtaacgtttacgtttcgtacgtttactactcgtacgtacgtacgtaagtactacgtcgtacgtccggtcgtaccggttagtaccgtacgacggtaacggacgtaacggtaacgtaaccgttaacgtaacgtcggttcgtaccgacgtacgtaccgtacgtcg

SEQ ID NO: 75772 - DNA, 520 bp, Homo sapiens
  misc_feature: GYAE6OF02G5JHA.17.39.D06.1.454.CMB.1.raw
tcagcgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagccaccctgtctgtgtctccagggggaaagagccaccctctcctgcagggccagtcagagtcgttggcagcaacttagcctggtatcagcagaaacctggccaggctcccaggcctcctcatgtatggtgcatctaccagggccactggtcgtcccaggccaggttcagtggcagtgggtctggggacagagttctctctcatcatcagcagcctgcagtctgaagtattttgcgttttattactgtacagtcagtataatcagtcgcctccgtggacgttcggaccaagggaccaaagggtaggaaactacgaaaaccgaacgtaggtggactcgtcaacccg

SEQ ID NO: 75773 - DNA, 749 bp, Homo sapiens
  misc_feature: GYAE6OF02I4S0T.17.39.D06.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (259)..(259): a, c, t, g, unknown or other
  misc_feature (259)..(259): n is a, c, g, or t
  modified_base (299)..(299): a, c, t, g, unknown or other
  misc_feature (299)..(299): n is a, c, g, or t
tcagcgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagccacctgtctgtgtctccgagggaaancgcccacctctctgcgaggccagtcagngtgttggcagacaacttagctggtatnagacagaacctgacgaggtcctaccgacggctcctacgtntacggtagtcggtcgactactaccgtaccgacgggtaccctacggttcgggtcgtacccgaacgtacccgtagggtttaccacggtcgggtcgtacggttcggggtacgtacggggacgtacggtacggtttccttccgtacgtctacgtccgtaatccgaacggtctacggtccctggtaccgtacgttctaacggttaacgtttcgttttacggttacgtttttacgttaacggtttacgtaccgtaggtaaccgttagttaacccgtttaagtccgggttaaacggtcccggtttaccgtacccggggttcgggtttaccccgggttaggttaaccccggggaagggttaaacccggttaaacggggttaaccgaaaaacggtttaacccgtaaacggttaaccggtttacgggtaaccggttccgtacggtaaccccgtaacccgg

SEQ ID NO: 75774 - DNA, 751 bp, Homo sapiens
  misc_feature: GYAE6OF02HRYQ5.17.39.D06.1.454.CMB.1.raw
  modified_base (213)..(213): a, c, t, g, unknown or other
  misc_feature (213)..(213): n is a, c, g, or t
  modified_base (247)..(247): a, c, t, g, unknown or other
  misc_feature (247)..(247): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgcctactctggcctcccagactaccactggagaagtagtgatgacgcagtctccagcccaccctgtctgtcgtcctccgaagggggaaancgcccaccctctccgtgcgacgggccagtcaggngttgtggcagctaacttcgccttaggtactcgagcgaaacgtaacccgtgggacccagggtccctaccccgaacgggtccctcccgtactaagttggtacgtggtacgactacgttaccgacccggagggtccctacggttcgggtaccctaccccgtacggtcccgttaacggggtttccgaagggttccgggtacggttaaggggttccggggttacgggtacggggaaccgttagggttacccgtttcctaccgttccgtacgtaaccgttctaacgtaccgacgcgtaccgtaccgtcggacgttacggttacgtaaggtttaacgtttcggttttttacggtacgtttttaacttccggttacgttaccgtaggtaacctagttaactagttccgtacggtcggtaccgttcggtacgggtacgtaccggtaccggaacggtaaccgtaggtaagtaacctacgtaaaccggtgtacggtggtaccgtacgactaaccg

SEQ ID NO: 75775 - DNA, 801 bp, Homo sapiens
  misc_feature: GYAE6OF02H06R2.17.39.D06.1.454.CMB.1.raw
  modified_base (173)..(173): a, c, t, g, unknown or other
  misc_feature (173)..(173): n is a, c, g, or t
  modified_base (208)..(208): a, c, t, g, unknown or other
  misc_feature (208)..(208): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagactaccactggagaagtagtgatgacgcagtcnccagccaccctgtctgtgtcctccgaaggggaaancgccacccgtctctgccagggccaggtcaaggtgtgtggcagctaacttgccgtggtactcgaggacagaaaccgtcggacctaggcctacccgagtcccgtacctacgtattgtacgttggtacgaccgtaacttaccgaacccggtacggggtacccctaacggttccgggaccgttacccccgaaggtccccgttaacgggtttaccaacgggttcggcggtaaccgggttcgggggtaccgttaagggggaaacttacggggtttaccgtttaccgtttacccgttcgtaaccgtaacttcccgttaaacgttccgaacgggtaccctaccgggtaccccgttaggaacccgtttaacgggtaccgttaaagggtttaaacgtttaaggttttacggtttaaccggttttaacgttaaaccgttcggttaaccggacgttaacgtaaacgttacttaaacggtcgttacggtacggtaccgttaccgggttaacgggttacccgttccgggaaaccggtaacgggtaaaccggtacgggtaaaggtaaaccgaccgtaaacgtacggtggtccggactacgtaccaacg

SEQ ID NO: 75776 - DNA, 749 bp, Homo sapiens
  misc_feature: GYAE6OF02I8BL1.17.39.D06.1.454.CMB.1.raw
  modified_base (208)..(208): a, c, t, g, unknown or other
  misc_feature (208)..(208): n is a, c, g, or t
  modified_base (262)..(262): a, c, t, g, unknown or other
  misc_feature (262)..(262): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (612)..(612): a, c, t, g, unknown or other
  misc_feature (612)..(612): n is a, c, g, or t
tcagcgtagactagcacgaccggtgctcgatttagtgacatctcgcagtttctttggggggaggaactgctcagttaggacccagacggaaccatggaagccccagcgcagcttctctcctcctgctactctggctcccagataccactggagaagtagtgatgacgcagtctccagcccaccctgtctgtcgtctaccaggggaaanacgccaccctctcctaggcacgggcacggtcagagttgttggcagcaaacgttnccgtgtatcacgacaacgaaccgtcggacacggtccncccgaaggccctaccgtnacgttgtacgtcggtgacacttccgacccggaagggtccaaggttcgggtaccgtacccacggtaccgtacgggttccgaacggttcgggccgtaggggttgggtacccgttagggggaaacccgttagggttaaccggttcccttaccgggtacttaccggtacctttagacccgtacggacgtcgttaccgggacctcgggccgttaacgttcggtaacgttagggtttacggtttacgtttccggtttttaacgtaccgttacgtacgtaccgggttactaaagggttttanaacgtttccggttaagggtccgttcccggtaacggttcgggtaccgttaccgggtacggtaaaaccggggtacctaaggggtaacgtaactaaccggtaaacgacggtttacgcggtaacctcgggtaccctaacgg

SEQ ID NO: 75777 - DNA, 791 bp, Homo sapiens
  misc_feature: GYAE6OF02F1RDI.17.39.D06.1.454.CMB.1.raw
  modified_base (99)..(99): a, c, t, g, unknown or other
  misc_feature (99)..(99): n is a, c, g, or t
  modified_base (210)..(210): a, c, t, g, unknown or other
  misc_feature (210)..(210): n is a, c, g, or t
tcagcgtagactagcacgaccggtgctcgatttagtgacatctcgcagttctttgggggaggaactgctcagttaggacccagacggaaccatggaacnccccagcgcagtcttctcttcctcctgctactctggctccagactaccagtaggagaagtagtgaatggacgctagtctccagcctacctgtctgtcgtctccgagggaancgaccctacctctcgcgcgaggccagtcgagtagttgtagctagactaacgttcgcgttagatcacggactaacggaaacccgttcggaccgtaaccggcccgttaccccgaagggtcccctaccgttacctagttcgtacgttggagaccttacgtaccgtaaccggtggtacccgttcgttccggtcctacccgcgtactaccgggtttgaccggtcggtacgtcgggttaggtcggtaacggggactacggtttcgttacttccccgtagttactaccgttacgtacgtccggtactacggtaaccgttccggtacgtaacgttccgtagtaaggtttaacttttcggtttacggtttaaccgtttttacttaccggtttcggtaacgtaccggtttaacgttaacgtttaacggttacgtaacgggtttaccgggtccgtttaacccggtttccggttaaccggggtcggttttaaacccggaccgggtaaacggggtaacccgttaagggtaaccccgtaaacggtaaccgtaacggttacggccgggttacggttcccacgggtaaccctaccgg

SEQ ID NO: 75778 - DNA, 726 bp, Homo sapiens
  misc_feature: GYAE6OF02IU5OO.17.39.D06.1.454.CMB.1.raw
  modified_base (207)..(207): a, c, t, g, unknown or other
  misc_feature (207)..(207): n is a, c, g, or t
  modified_base (329)..(329): a, c, t, g, unknown or other
  misc_feature (329)..(329): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagngcccaccctctcctgcagggccagtcagagtgttggcagctaacgttagcctaggtactcgaagcaagaaaccgtggaccagggccctcccgaggtccctacctcaagttgtagtgggtacnccgtaacttccgtaaccggacgggtcctacggttcggttccgtacccgacggcccgtagggtttccgaggttcggacgtagggttggggttaccgtaggggaactacgggttacgtttccgtccttactacgtactctaaacgtccaacggtcctacggccttacggctacggttaccgttagttaacggtttattttcgtaacgtttaagttttacgttacgttgtacgtacgtacttaagttaattaccgtaggttacggtaccgttcccggttaccggttacgggttaccgggttccgggaaacccggttaaggggtaaccgtaaacgggttaaccggaaacgttaaacccggtaacggtaccggttagggtaccggtccgttaccgggaaccc

SEQ ID NO: 75779 - DNA, 771 bp, Homo sapiens
  misc_feature: GYAE6OF02IEKEN.17.39.D06.1.454.CMB.1.raw
  modified_base (204)..(204): a, c, t, g, unknown or other
  misc_feature (204)..(204): n is a, c, g, or t
  modified_base (756)..(756): a, c, t, g, unknown or other
  misc_feature (756)..(756): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccacctgtctgtgtctccgaggggaaancgccaccctctccgtgcgacgggccagtcagtaggtggttcggactaggactaacgttacgccgttaggtactccgagtacgaacgtaacctggacccgtaacggtcctaccccggaggtcccttaccctacgtaacgtttcgtacggttcggtcgtacctaactaccgtaaccggacggggtacctaccggttgggttacccgtcccgaacgtccgtaggttcgaggttcggacggtaggttcgggtacggaacgggactagggtaccgtttctccgttactacgtactaccgtaattccgaacgtctaccggtacccgttggtaccgtaggttaaccgtaggtttaacgttttcggttttaccggtttacgtttttagtacgtaggttaacctacgtaacgtacggtttaactaacgttcggtaacggttaccggccccggttttacggggccggtttaaccggttccggggaacccgtaaacgggggttaaccgtaaagggttaacggaaaaccctaacggtaaccggtaacggttcggaccggtttanaccgtaccgtaaccg

SEQ ID NO: 75780 - DNA, 766 bp, Homo sapiens
  misc_feature: GYAE6OF02G677M.17.39.D06.1.454.CMB.1.raw
  modified_base (203)..(203): a, c, t, g, unknown or other
  misc_feature (203)..(203): n is a, c, g, or t
tcagcgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagccaccctgtctgtgtctcgagggaanacgccaccctctcctgcgacggcagtcgagtagtgtggcagctaacgtagcctggtactcgagacacgaaccgtggccaggcctacccgagtcctacctctagttcggtagtcggtactactacgttccgtaccggacgggtccctacggttcggtaccgtacccgaacgtccgtacggttcagggtcggacgtagggtcgggtacgtggaaccgtaggttcgtttcctaccgttctactacgtaccgtaacttccgacgtaccgtaccgtcccgtacggtaccgtacgggttattaacggttaagtttttacgttttacgggtttaccgggtttttaacttaaccggtcgttacgtaaccggttacgttaagttaaaccttaacggtttcggtaacggtttacccggttcccggtttaccggggttaccggggtttacccggttaccggggaaacccggtaaacggggtaaccggttaaaacgggtaacggttaaaccggtaaacccgggttaacgttacgggttacggttcccgggtaacgtacccggtaaccctacccgg

SEQ ID NO: 75781 - DNA, 771 bp, Homo sapiens
  misc_feature: GYAE6OF02JDVND.17.39.D06.1.454.CMB.1.raw
  modified_base (166)..(166): a, c, t, g, unknown or other
  misc_feature (166)..(166): n is a, c, g, or t
  modified_base (204)..(204): a, c, t, g, unknown or other
  misc_feature (204)..(204): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccatggagaagtagtgatgacgnagtctccagccaccctgtctgtgtctccgaagggaaancgccaccctctcctgcagggccagtcgagagttgtggcagtcaacgttcgcctggtatcgagcaagaacctggccaggcctaccgaggcctccgtctatacgttagtggtcgactacttccgaccgacgggccctacggttacgggtccgtacccacggtacccgtagggtttaccgtaggtcgggtaccgtacggggtttcgggtacggtacggggtaaccgtaacgggttaccttttcccgttccgttaccttacgtaagtcccgtaattaccgaccggtacgtacgacccgttgggacccttaaggttacgttaaacgttaaggttttacgttttttacgggttaccggttttttaaagttcccgggtttagttaaacccgaggtttaaccgttaacgtttaaagttacgttaccgttaacggggttccgtaaccccgggtttcgggttaccggggtttaccggtacccggggtaaccggaaacggggttaaccggtaacgggttaaacggaaacgttaaccggtaaacggttaggttccgggtaacgtccgttagaccctacg

SEQ ID NO: 75782 - DNA, 862 bp, Homo sapiens
  misc_feature: GYAE6OF02FLM2S.17.39.D06.1.454.CMB.1.raw
  modified_base (212)..(212): a, c, t, g, unknown or other
  misc_feature (212)..(212): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtcctccacgcccaccctgtctgtcgtcctaccgaaggggaaancgccctaccctctcctgccgacgggccagtcagtgtggttggcagactaacttagccgtaggtactacagaccaagaaccgtggaccaggccctacccgaggtcccttcccgacgtagttcgtaagttcgggtacctacgtaacgtttcccggtaaccggaccgggtaccctacggtttccgggttccgtaccccgtaacgtacccggttaacggtttaccgacgggttcgggaccgtaacggggtttcggggtcgggtaacggggaaccgttacgggttacgtttcccgttaccgtaccttacgtacttaccgtaacgtaccgtaacgaccgttacgtcccgttaacgacggttaacgttccggtaagttaaacggttttcgtttttaccgggttaacgtttttacgtttaaccttcgggtaaccgttaacggtccgtttaaaggtttaaaccttaaggttaccgggttaccggttttaccccggggccgttttaacccggggttacgggttaaccccggtcggggtaaaacccccgggttaaaccggggtaccggttaaaaacgggggttaacccgttaaaaccggtaaaccggttaaaccggtacgggtttccggaaccgggtccttaccgggacccctttaaccgg

SEQ ID NO: 75783 - DNA, 792 bp, Homo sapiens
  misc_feature: GYAE6OF02GS20N.17.39.D06.1.454.CMB.1.raw
  modified_base (529)..(529): a, c, t, g, unknown or other
  misc_feature (529)..(529): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctccagataccactggagaagtagtgatgacgcagtctccagcctaccctgtctgtcgtcctaccgaagggaagcgcccaccctctcctgcgacggcagtcagagtgttcgcagactaacgtgccgtaggtactcgaaggcaacgtaaaccgtcggacccgacggtacccgtacccgacgggtcccttaccccgttacgtaacgttggttaacggtacggtacgtaccgtacgttacccgttaacccggaaccggggtacccgttaacggtttcgggtacccgtaccccgtacggttaacccggtacgggtttaccgagggtcggtaacggtcgggttcggggttacgtaacggggtacacggtttaacgttccgtaccgttacgtctaaccggtnaaccgtagtacggcctacggaccgtagtccgtacgtcgttaacggtaagttttccgttttagggtaaccttttagtttacgggtctaaacgtacggttacttaacgttaacgtacgttccggtaacggttaccggttacccgtacgggttacggggtacccgtttaaccggggaaccggtaacgggtaaccggtaaggtaaaccgggttaaacctaccgtaaacggttccgggtacgttacggtacctccggtaacttaccgg

SEQ ID NO: 75784 - DNA, 651 bp, Homo sapiens
  misc_feature: GYAE6OF02FMAFE.17.39.D06.1.454.CMB.1.raw
  modified_base (153)..(153): a, c, t, g, unknown or other
  misc_feature (153)..(153): n is a, c, g, or t
  modified_base (166)..(166): a, c, t, g, unknown or other
  misc_feature (166)..(166): n is a, c, g, or t
  modified_base (202)..(202): a, c, t, g, unknown or other
  misc_feature (202)..(202): n is a, c, g, or t
  modified_base (318)..(318): a, c, t, g, unknown or other
  misc_feature (318)..(318): n is a, c, g, or t
  modified_base (358)..(358): a, c, t, g, unknown or other
  misc_feature (358)..(358): n is a, c, g, or t
  modified_base (420)..(420): a, c, t, g, unknown or other
  misc_feature (420)..(420): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggcctcccagataccactgganaagtatgatgacnagtctccagccacctgtctgtcgtctccgagggaangccacctctcctgcacggccagcagagttgtcgcagctaacttacgctgtatcagacacgtaaccgtcggaccaggtcctaccggacggtcctccgtacgagttagtacgtcggtntactacgtccgtacgacggcctagtccggtccggtacccngtaccgtagttcgaggtcgcgtacggttgggtactgggactacggtgttcctcgtctcttancgtactcgtacgcctagtccgtgtacgtacgttcgtaggtactttagttcggtaactttgttacctttacggtcctagtcgtacgttaagttaacgtttccgtagttccgggtaccgtcgttaaccggttacggtaccggttacggtaaccggaaacggttaccggttaacggtaacgttaaacggtaacctaacggttaccggttaggtcccgtaggttcctaaacccgg

SEQ ID NO: 75785 - DNA, 664 bp, Homo sapiens
  misc_feature: GYAE6OF02HJPR5.17.39.D06.1.454.CMB.1.raw
  modified_base (239)..(239): a, c, t, g, unknown or other
  misc_feature (239)..(239): n is a, c, g, or t
  modified_base (524)..(524): a, c, t, g, unknown or other
  misc_feature (524)..(524): n is a, c, g, or t
  modified_base (550)..(550): a, c, t, g, unknown or other
  misc_feature (550)..(550): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgactactctggctccagataccactggagaagtagtgatgacgcagtcctccagccaccctgtctgtcgtctccgaaggggaaagcgcccaccctctcctgcacgggccagtcagngtgtgcagctaacttgcctggtactcagcaacgaaaccgtggacccagggtccctaccccagggtcccttcccgtactagttcgtaggtggttacgcctaattacccgaccgacggggaccctacggttcgggtcctacccgaacggtcccgtacggtttcgaagggttcgacgtagggttcgggtcgtagggacctaaggtcttacgttcgtactctactcagtccaagtcacgtccgtagcctagtaccgttaggttaacgttagttttcggttaacgttttntacgttcacgtacgtactaagtttanaacgttcgtaacgtcgtccgttcggtacggtccggttaccgggacgtaaaccggggtaactacggggtaactaaacgtagaaaccgttgtaggtccgtcgtacgacccttaacg

SEQ ID NO: 75786 - DNA, 718 bp, Homo sapiens
  misc_feature: GYAE6OF02GU4GY.17.39.D06.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangcccaccctctcctgcagggccagtcagagtgttggcagcaacttagcctggtatcagacagaaacttgccaggcctcccaggctctcatgtatggtncatctaccgagggcctacgtggtcgcccagtccaggttcaggtgcgtaggtcgggtacgtgggaactaggtacgtttcctcgtctacgtactacacttacgaacgtccgtacgtacccgttgacccgtacggtttacctacggttaaacgtttagtttttaccgggttacggtttttaaacgtttaccgttaggtttaaccaacggttaacgttaacggtttaaagttaaacgttaccggtaacggtttcccgggtacccgtttaaccggggttcgggtaacccgggtttaccgggaaccccgggtaaaaggggtaacccggttaaaacgggggtaacgggttaaaaccgttaaacccggaaaaccgttaaccggttaacgggtaccgggtaccgttaccggacccgttaaacccg

SEQ ID NO: 75787 - DNA, 787 bp, Homo sapiens
  misc_feature: GYAE6OF02IK1WX.17.39.D06.1.454.CMB.1.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (599)..(599): a, c, t, g, unknown or other
  misc_feature (599)..(599): n is a, c, g, or t
tcagcgtagactagcacgaccggtgctcgatttagtgacatctcgcagttctttgggggaggaactgctcagttaggacccagacggaaccatggaacgccccagcgcagcttctcttcctcctgctactctggctcccagataccactggagtaagtagtgagtggacgcagtcctccacgcccaccctggtctacggttgtcctaccggaaggggaaacncgcccctacccttcctccncggcgaaccggggcctaggtaccgaaggtacggttggttccgggacaacgtaccgtaaacgttacggcccgttaggtacacgaacgcgtaacgaaaccgtggaccgtaacggtcctcccgacggtcctacccgtagtcgtagtacgtggtcgcttaacgccgtaacggccggacctacggtggttaccgacccgaggtacccgtaggttcgaacggtcggtcgtacggtcggttaccgaggggtacacgtttcggttctaccgttgactacgtacagtactcggatacggctaggtaccttagaccgtttaaggaacggttttacgttttaccggttacggttttacttaacccgggngtttaaaccgtacggttaaccgttaaagtttaccgttaaacgggttctacccgggggtttaaccgtcccgtttaacgggttacccgggtacgtttaacggggtaacccgtaaacggggaaccggttagggtaaaacgtacggtaaccgtaaacgtaccgggttgaccggtcgttacggaacttacggg

SEQ ID NO: 75788 - DNA, 214 bp, Homo sapiens
  misc_feature: GYAE6OF01DBWF7.52.15.B04.1.454.CMB.1.raw
  modified_base (212)..(214): a, c, t, g, unknown or other
  misc_feature (212)..(214): n is a, c, g, or t
tcagcgcagtacgacacgaccggtgctcgatttagacagtatatatccgcgggcacgaccggtgctcgatttagacagtatatatccgcgggtatccgcggcacgaccggtgctcgatttagtcacgcgagaaggaaaggggctggccctgacgtgtttctgttcccgccctcctctatacgatcgctgagcgggctggcaaggcgcatagnnn

SEQ ID NO: 75789 - DNA, 133 bp, Homo sapiens
  misc_feature: GYAE6OF01DKN1I.52.15.B04.1.454.CMB.1.raw
  modified_base (133)..(133): a, c, t, g, unknown or other
  misc_feature (133)..(133): n is a, c, g, or t
tcagcgcagtacgacacgaccggtgctcgatttagacagtatatatccgcgggcacgacctgtgctcgatttagtgtgagtagttcccgccctcctctatacgatcgctgagcgggctggcaaggcgcatagn

SEQ ID NO: 75790 - DNA, 167 bp, Homo sapiens
  misc_feature: GYAE6OF01EGMQD.52.15.B04.1.454.CMB.1.raw
  modified_base (167)..(167): a, c, t, g, unknown or other
  misc_feature (167)..(167): n is a, c, g, or t
tcagcgcagtacgacacgaccggtgctcgatttagacagtatatatccgcgggcacgaccggtgctcgatttagtcacgcgagaaagggaaagggggctggccctgacgtgtttctgttcccaccctcctctatacgatcgctgagcgggctggcaaggcgcatagn

SEQ ID NO: 75791 - DNA, 216 bp, Homo sapiens
  misc_feature: GYAE6OF01DSWSY.52.15.B04.1.454.CMB.1.raw
  modified_base (215)..(216): a, c, t, g, unknown or other
  misc_feature (215)..(216): n is a, c, g, or t
tcagcgcagtacgacacgaccggtgctcgatttagacagtatatatccgcgggcacgaccggtgctcgatttagacagtatatatccgcgggtatccgcgggcacgaccggtgctcgatttagtcacgcgagaaagggaaagggggctggccctgacgtgtttctgttcccgcctcctctatacgatcgctgagcgggctggcaaggcgcatagnn

SEQ ID NO: 75792 - DNA, 552 bp, Homo sapiens
  misc_feature: GYAE6OF01DCW28.52.15.B04.1.454.CMB.1.raw
  modified_base (225)..(225): a, c, t, g, unknown or other
  misc_feature (225)..(225): n is a, c, g, or t
  modified_base (374)..(374): a, c, t, g, unknown or other
  misc_feature (374)..(374): n is a, c, g, or t
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttggtacttataactctgtctcctggtaccaacaataccccggcaaacgtccccaaactcatgatctttgagtcagtgatcgcccgcaggggtttctcatccgcttctccggctcctaagtctggcagcacggcctcccngaccatctcgtcggcctccaggctgacggacgaggctgattattactgcagctacatacgaacaaacagaaactacgttgggtcgttcgggcggacgggaacctaaacgtcgacccgtccgttccgtcacgcccgaagtccgtccgtccccctcggaccaccttcgtccgttcccccg

SEQ ID NO: 75793 - DNA, 617 bp, Homo sapiens
  misc_feature: GYAE6OF01CTJFN.52.15.B04.1.454.CMB.1.raw
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaacgtccccaaactcatgatctttgagtcagtgatcggcccgcgtacggggtttctcgattccgctttcctccggcctccaagtctggcagccaccgggtccctccctgaccctatctctcgggctcccgaggtctggacggacgaacggctagtatttacttacgtcgctagtctacaattaccgaaacaaaaccaacgaaaactacggttagggttcgttaccgggaccggtaccgggaacctaaaccgtcgtacccgttccgttcgtaccacggacccgaacggtccctccgtccccccgtacggttcctaaccgtccgttcccgttaccccccg

SEQ ID NO: 75794 - DNA, 540 bp, Homo sapiens
  misc_feature: GYAE6OF01DFA1M.52.15.B04.1.454.CMB.1.raw
  modified_base (225)..(225): a, c, t, g, unknown or other
  misc_feature (225)..(225): n is a, c, g, or t
  modified_base (373)..(373): a, c, t, g, unknown or other
  misc_feature (373)..(373): n is a, c, g, or t
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttggtacttataactctgtctcctggtaccaacaataccccggcaaagtccccaaactcatgatctttgaggtcagtgatcggccgcaggggtttctcgatcgcttctccggctccaagtctggcagcacggcctcccngaccatctctggctccgagctgagcgaggctgattatactgcagctcatacaacaaacagaaacagttgggtgttcggcggacgggaaccaaacgtcggaccgttccgttcgtacgacgcccgaaggcctaccgcccccgttacggtccaccttctcgttacccccg

SEQ ID NO: 75795 - DNA, 587 bp, Homo sapiens
  misc_feature: GYAE6OF01BK6NB.52.15.B04.1.454.CMB.1.raw
  modified_base (226)..(226): a, c, t, g, unknown or other
  misc_feature (226)..(226): n is a, c, g, or t
  modified_base (323)..(323): a, c, t, g, unknown or other
  misc_feature (323)..(323): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
tcagcgcagtacgacacgaccggtgctcgatttagacagtatatatccggcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcaatggacgttggtacttataactctgtctcctggtaccaacaactacccggcaaacgtccccaaactcatgatcttgaggtcagtgatcggccgngtagggtttctctatcgcttccgtccggtctaccgaacgtcgtcgggcacggccaccgggtccctcccgtgaccctatctcgtggcctccgaggctggacggacgaggtcctggtactttacgtacngacngcgtcataacaacaaacagaaactcggttagggtcgttcgggccggtacggaacctaacgtccgtacccggttccgttcgcgtacggcccgacggtcctcccgccccgtgtcccgactcgtcccgttcccccg

SEQ ID NO: 75796 - DNA, 639 bp, Homo sapiens
  misc_feature: GYAE6OF01CX3II.52.15.B04.1.454.CMB.1.raw
  modified_base (473)..(473): a, c, t, g, unknown or other
  misc_feature (473)..(473): n is a, c, g, or t
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
  modified_base (589)..(589): a, c, t, g, unknown or other
  misc_feature (589)..(589): n is a, c, g, or t
tcagcgcagtacgacacgaccggtgctcgatttagacagtatatatccggcggggggggtctcaggaggcagcgctctcgggacgtctccaccatggcctgggctctgctattcctcaccctcctcactcagggcacgagggtcctgggcccagtctcgccctgactcagcctgcctccgtgtctgggtctccgtggacagtcgatcaccatcctcctgcctacgtacggaaacccagacaagtcggtacggtttaggtaacttattaacctcttcgtccttccgtacggtaaccaaaccaaccgttaccccggaactaaaccgtaccccaaactctagtatacttctttaggacggtcagtcgtacgtccggccgtgtacgggtttctcgtacgtccgtcttccgtccgcctacgtacgtcgtcggcacgtccgaccgtccctacctgactctcgtcgcggcctcgagtcgngaacggcgaggtctntacttgtacgngactncctanaactaaacgacaaaacacgtagttaccggttgggtcgttacgggcggaaccgtaacgtacgcggtcccttcgtcggtacnccggtacacgtcccgcccgtccccgtgtcccaccgtccgtccggtccccc

SEQ ID NO: 75797 - DNA, 147 bp, Homo sapiens
  misc_feature: GYAE6OF01D8SGN.52.15.B04.1.454.CMB.1.raw
  modified_base (99)..(99): a, c, t, g, unknown or other
  misc_feature (99)..(99): n is a, c, g, or t
  modified_base (125)..(125): a, c, t, g, unknown or other
  misc_feature (125)..(125): n is a, c, g, or t
  modified_base (132)..(132): a, c, t, g, unknown or other
  misc_feature (132)..(132): n is a, c, g, or t
  modified_base (140)..(140): a, c, t, g, unknown or other
  misc_feature (140)..(140): n is a, c, g, or t
  modified_base (142)..(142): a, c, t, g, unknown or other
  misc_feature (142)..(142): n is a, c, g, or t
  modified_base (144)..(147): a, c, t, g, unknown or other
  misc_feature (144)..(147): n is a, c, g, or t
tcagcgcagtacgacacgaccggtgctcgatttagacagtatatatccgcgggcacgaccggtgctcgatttagctctacgctcagggcacgaccggtnctcgatttagcacgcgagaaaggganggcgtgngagagcanangnnnn

SEQ ID NO: 75798 - DNA, 109 bp, Homo sapiens
  misc_feature: GYAE6OF01BD0DQ.52.15.B04.1.454.CMB.1.raw
  modified_base (109)..(109): a, c, t, g, unknown or other
  misc_feature (109)..(109): n is a, c, g, or t
tcagcgcagtacgacacgaccggtgctcgatttagacagtatatatccgcgggcacgaccggtgctcgatttagacagtatatatgagcgggctggcaaggcgcatagn

SEQ ID NO: 75799 - DNA, 577 bp, Homo sapiens
  misc_feature: GYAE6OF01B2CRE.52.15.B04.1.454.CMB.1.raw
  modified_base (325)..(325): a, c, t, g, unknown or other
  misc_feature (325)..(325): n is a, c, g, or t
  modified_base (536)..(536): a, c, t, g, unknown or other
  misc_feature (536)..(536): n is a, c, g, or t
  modified_base (563)..(563): a, c, t, g, unknown or other
  misc_feature (563)..(563): n is a, c, g, or t
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaactaccccggacaaacgtccccaaactcatgatcttgagtcagtgagtccggcccgngtacgggtttctcatccgtcttccgtccggctaccgaagtctggcacgccgaccgggccctcccgagacccactcctacgtcgggccctcgacgggcgtaggacgggacgaggtcgttagtatttacgttaagtcgctagtctacaactacaacaaacacgaaactcgttgggtcgtcggcggaccgaaccaacgtcgaccgttcgtcganaccgccgacgcctccgcccgtgtaccnctccgtcgtacccc

SEQ ID NO: 75800 - DNA, 842 bp, Homo sapiens
  misc_feature: GYAE6OF01C2Q8S.52.15.B04.1.454.CMB.1.raw
tcagcgcagtacgacacgaccggtgctcgatttagacagtatatatccgcggggggggtctcaggaggcagcgctctcgggacgtctccaccatggcctgggctctgctattcctcaccctcctcactcagggcacgagggtcctgggcccagtctcgccctgactcagcctgcctccgtgtcgtgggtctccgtggacagtcgatccaaccatcctcctgcctacgtacggaacctagacctaagtcggtacggtttaggtaacttacttaacgtcgttacgttcctaccgttacggtaaaccctaaaccgtaaaccgttaaccccccgggaactaaaaccccggttacccccctaaaaaccttacaaccggtttagtaaaccgttttccttttaagggaccggttcgtaagggttacggtaccggttcccggggccccggtacgggtttacgggggttttacctacgtaacgttccgttccgtttcccggtcccggtaccctaaccgttaacggttccgtacgggaccaacggccgtaaccggtccctaccgtacggaactcgtccgttacggtcggtcctacggacggtccgtaggggaacggaccgtaggtcttaaggttaactttacgttaaccgtcgccgtacgtacctacgtaactaacccgaaacgtaaagtaaaccgtaacgttacggttacgggttcggttaacccggggccgggaaccggtaaacccgtaacgttccggtacccttccggtaccggtaacctacccgaacccggtacggcccgttccccgtacccgtacgttacccgtccctccgttccccgttacccccg

SEQ ID NO: 75801 - DNA, 805 bp, Homo sapiens
  misc_feature: GYAE6OF01EXKRN.52.15.B04.1.454.CMB.1.raw
  modified_base (195)..(195): a, c, t, g, unknown or other
  misc_feature (195)..(195): n is a, c, g, or t
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacngtcgatcaccatctcctgcactggaaccagcaatgacgttgtacttatactctgtctcctggtaccaacaactaccccggacaaacgtaccccaaactcatgatctttgaggtcaggtgagtccggcccgtcgtaggggttttcctctacgttccggtcctttccgtcccgggtccttaccgtaaacgttcgtacgggtccacggtccgaaccgggtccccttccccgtacggaccctaacttcccgttaccggttcgggtccccttacccggacgggtccgttaggggaacgggtaacccgggtacggggtccttagggtaacttttaacgtttaccgttacggaccctacgggtcccttaccgtaaccgttaaaccgaacctaaaaccgaaacggtaaaacccgttacggtttacgggggttcggttaccggggaccgggtaacccggggtaaaccggtaaacccgtccggttaacccggtttccccggttaccgttaccggaacccggtaccccggtaaccgggtccccgttaccccggtacccccccgggtttaccggtaccccggttacccgttcccggtttaccccggttttacccccccccgg

SEQ ID NO: 75802 - DNA, 692 bp, Homo sapiens
  misc_feature: GYAE6OF01CAWDK.52.15.B04.1.454.CMB.1.raw
  modified_base (412)..(412): a, c, t, g, unknown or other
  misc_feature (412)..(412): n is a, c, g, or t
  modified_base (537)..(537): a, c, t, g, unknown or other
  misc_feature (537)..(537): n is a, c, g, or t
  modified_base (542)..(542): a, c, t, g, unknown or other
  misc_feature (542)..(542): n is a, c, g, or t
tcagcgcagtacgacacgaccggtgctcgatttagacagtatatatccggcggggggggtctcaggaggcagcgctcgtcgggacgtctccaccatggcctggctctgctattcctcaccctcctcactcgagggcacgcgggtcctgggccctaggtctcgccctgactcagcctgcctcgtgtctgggtcctccgtgacagtcatcaccatctcctagcacgtcggaaccagctaagtcggtaacgttgttaacttaagtaccttcgtcggttcctccgttacggtaacctaaacgaaaccgttaccccggaactaaacccgttacccaaactctaattcgtaactttcctttaggacgtctaacggtcgttaacgcccgggtacccggtacggttacggggttttaccncgtaacgttccgttccgtttcccggtccggtacctcgttaacgtcgtcgaccgtaacggctacccggtcctaccgtgacctctcgtcgcgctcgcgcgtgacgagtcgtctagtattactacgtntacgntactgaactaacaacgtaaacacgaactcggttcggtacgtccgggaccggtaaccgaccgtaaacgtcccgttacgtccgttacgaccgacgtcccgaacgtcccgtcccgtcccggtacctcgtaaccttcccggtccttaccccccg

SEQ ID NO: 75803 - DNA, 846 bp, Homo sapiens
  misc_feature: GYAE6OF01C6RFX.52.15.B04.1.454.CMB.1.raw
  modified_base (250)..(250): a, c, t, g, unknown or other
  misc_feature (250)..(250): n is a, c, g, or t
tcagcgcagtacgacacgaccggtgctcgatttagacagtatatatccgcggggggggtctcaggaggcagcgctctcgggacgtctccaccatggcctggctctgctattcctcaccctcctcactcagggcacgagggtcctgggcccagtctgaccctgactcagccctccctcgcggtccgggtctccgtggactagtcacgtcacctatcctcctgcagtggactccgaagcagtgtacgttggntcttagtgttacttcgtccgtacctacggtaacctaaaccaccgtacccgtaggtaaccaaacccgaccccctaaacttctaacttccgttaatttttcggaacgttaccaacgttaaccggccggtccccgtacggtaccggggtccctaggtaccgttccgtccttcgtccgttcggtccgtacggtaacgttccgtacggaacccgtaaccggacccgtcccgttaccccgtacggtaacccggttccgttaccgggaccgggttaccctacccgggtagggtaacccgttaggggaaccgggttactacggggacgttaccgttaaggttaacctttacggtaccgttacgaacccgttaccgtacgaacgttcggtaccggaacccgtacggaaccgtaaaccgtaaacgggtttacggggtttttaccgggggtaccgggacggggttaaccggaacgggtaacccgggtttccgaaacccggttaccgtaaccggttaccggaacccggtaccggaaccggtcccgtaccccgttacccccggtacggtacccttaccgttccccgttccggttccccccgttacccgg

SEQ ID NO: 75804 - DNA, 759 bp, Homo sapiens
  misc_feature: GYAE6OF01D10NZ.52.15.B04.1.454.CMB.1.raw
tcagcgcagtacgacacgaccggtgctcgatttagacagtatatatccggcggggggggtctcaggaggcagcgctctcgggacgtctccaccatggcctggctctgctattcctcaccctcctcactcagggcacgagggtcctcgggcccagtctcgccctgactcagcctgcctcgtgtctcggtctcgtgacgtcgtcgatccactactctccgtgctacgtacggaaccagactaagtcggtacgttgtaacttaactactcttgtcctaccgtacggtaaccaaacgaactaccccggataaaccgtacccaaacgtcagttactacgttcgtttacggacggttacacggtcaacccggttccggaccccgggtggtttaacccgggttcacgtacgttcccggtaccgtttcccgcggttacccttaacgcgttcggaaccgggtcctaaacggtcccgtacccgttacccccgtacgtttaccgaaaccgttttccgtcggtcccggtccgggtacctacccggacgggtacgtacggggaaacgtaccgtcggtagtacgtttactaaccggttcgacggttcactacctacgaactaaccgaaacctaagtaacgtagttacggtcggtacgggtaccggacggtccgtaaacgaccggttaccgtacccgttgtacccggtcgtaccgaccggtaccggtccctaacccggtcccgttcaccccggttcccttcgtccccttacccg

SEQ ID NO: 75805 - DNA, 167 bp, Homo sapiens
  misc_feature: GYAE6OF01C67A7.52.15.B04.1.454.CMB.1.raw
  modified_base (160)..(160): a, c, t, g, unknown or other
  misc_feature (160)..(160): n is a, c, g, or t
  modified_base (165)..(167): a, c, t, g, unknown or other
  misc_feature (165)..(167): n is a, c, g, or t
tcagcgcagtacgacacgaccggtgctcgatttagacagtatatatccgcgggcacgaccggtgctcgatttagtcacgcgagaaagggaaagggggctggccctagcgtgttcctgttcccgccctctctatacgatcgctgagcgggctggcaaggcnatagnnn

SEQ ID NO: 75806 - DNA, 664 bp, Homo sapiens
  misc_feature: GYAE6OF01AEA1J.52.15.B04.1.454.CMB.1.raw
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
  modified_base (372)..(372): a, c, t, g, unknown or other
  misc_feature (372)..(372): n is a, c, g, or t
tcagcgcagtacgacacgaccggtgctcgatttagacagtatatatccgcggggggggtctcaggaggcagcgctctcgggacgtctccaccatggcctgggctctgctattcctcaccctctcactcgaggcacgaggtcctgggcccagtctgccctgactcagcctgcctccgtgtctggtctcgtggacagtcgatcacntcncngcncagacngctaatggtacttgtacttatactctgtccnctagaccaacactacccgnaaacgtcccaactctatgtattcgttagacgtcagtcgtacgtccggcccgtagtacgggttcactacgtccgtcttcgtcccgtctaccgtagtcgtcggacncgaccgcgtccctaccacgacctacgtctccggtacgccgttaccgacggtacacgggtaacggtacggacggtcgtaacgtcgttttaaacgtccgtagacctacgtactaccgtaactaaaccgaacctaaaacggaaccgttaacggttaacggttcgggttcgggtcccgggaaccgggtaaccggtaaccgtagttaccccgtacccggtttccgacgtaccgacccggtaccgtacgacccgttcccgaccccgttactacccgtactcccgttaccggtcccccc

SEQ ID NO: 75807 - DNA, 822 bp, Homo sapiens
  misc_feature: GYAE6OF01EP39A.52.15.B04.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (513)..(513): a, c, t, g, unknown or other
  misc_feature (513)..(513): n is a, c, g, or t
tcagcgcagtacgacacgaccggtgctcgatttagacagtatatatccggcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactcggaaccngcaatgacgttgtacttanaactctgtctcctggtaccaacaactaccccggacaaacgtccccaaaactcatgacttctttgacggtcaggtgacgtccgggcccgcgtacggggtttctcgtacgttccgtccttccgtcccggtcctaccgtaacgttcgtcgggtaccacggtcccgacgggtaccccctacccgttaccgacccgtaacttccgttccggttcggggtaccccgttacccggaaccgggtaccggtttacggggaaacggggtaacccgggngggttaaccgttacggtttaaactttaacgttttacgtaccgggtaactaccggtccttaaccgaactttaaccgaaaccgaaaacgtaaacggtaaaaccggtttacgggtttacgggggttacgggtttacccggggacccggggtaacccggggtaaacccgtaaaaccggttccgggttaaacccccggtttccggtttaaaccggtaccggaaacccgttaacccgggaaaccgggttccctacccccgggtaccccctttcccgggtaacccttcccgttccgttaccccggttacccccccg

SEQ ID NO: 75808 - DNA, 729 bp, Homo sapiens
  misc_feature: GYAE6OF01COAD8.52.15.B04.1.454.CMB.1.raw
  modified_base (296)..(296): a, c, t, g, unknown or other
  misc_feature (296)..(296): n is a, c, g, or t
  modified_base (522)..(522): a, c, t, g, unknown or other
  misc_feature (522)..(522): n is a, c, g, or t
  modified_base (543)..(543): a, c, t, g, unknown or other
  misc_feature (543)..(543): n is a, c, g, or t
  modified_base (668)..(668): a, c, t, g, unknown or other
  misc_feature (668)..(668): n is a, c, g, or t
tcagcgcagtacgacacgaccggtgctcgatttagacagtatatatccggcggggggggtctcaggaggcagcgctctcgggacgtctccacatggcctggctctgctattcctcaccctcctcactcgagggcagacgggtcctcgggcccagtctcgccctgacctcgacgcctaggccctccgtgtcgtcgggtcctccgtaggactacgttacgactccaccgtattcctacgtgactaacgtacggaaccaggactaacgttcgtacggtttcgtaaacttactaaccgtnttcgtcctaccgtacggtaaccaaactaaccgtacccggaactaaaccgtaaccctaaactctaatgtacttacgttagcgtacgagtcacggtccgaccgtcgttaggttccaacgtctccgtcgttccgtaccgtctacgtacgtcgtacgcgacgccgaaccggccctaccgcgaactctcgtaccgtccggctacgcgtcggacgaacggtagtaccggtanagttaccgtaattcggtaacnccgtacggtactaccgtaacgtaaaccaactaaaacgaacgtttaaccgtcgggttaagggtccggtaccgggtaaccggaaccggtaaacccgtaccgtacggttaacccgtcgtaaccggtanacccgtaaccgtaccgcccgttacccgtacccgacttacacccttccgttaccccgtaccc

SEQ ID NO: 75809 - DNA, 705 bp, Homo sapiens
  misc_feature: GYAE6OF01DABG3.52.15.B04.1.454.CMB.1.raw
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (378)..(378): a, c, t, g, unknown or other
  misc_feature (378)..(378): n is a, c, g, or t
  modified_base (473)..(473): a, c, t, g, unknown or other
  misc_feature (473)..(473): n is a, c, g, or t
  modified_base (482)..(482): a, c, t, g, unknown or other
  misc_feature (482)..(482): n is a, c, g, or t
tcagcgcagtacgacacgaccggtgctcgatttagacagtatatatccgcggggggggtctcaggaggcagcgctctcgggacgtctccaccatggcctgggctctgctattcctcaccctcctcactcgaggcacagggtcctgggcccagtctgccctgactcagcctgcctcggtgtctgggtctccgtggaccagtcactcaccatctccngcactcgaacngcaatgtacgttagtaacttacttaactctagttctccttacggaaccaaaactaaccgtacccggaactaaaccgtacccctaaaactctactaggtattaccgtttagacggtactagtgacggttccggccggtacgttacgggttacncgtactcgtcttccgccggtctacgacgtctggactacgccgacggtccctcctacgtactctcgtcgtacgtcctccgtaggcgtaggacggtnaaggtcgtnttacttaagttcgagcgtactctagaactaacgaaacaacgaacgtaacgtcggttcggggttacgtaccggggcccggtaacgtaaacccggtaaccgtaccgggtaaccctttcccggttacccgaccgggttaacccgaccgggttaccccggtcccgttacccccggttaccggtccccgttaagttaccccgttcgttttaacccccgttaccccccg

SEQ ID NO: 75810 - DNA, 940 bp, Homo sapiens
  misc_feature: GYAE6OF01EH8EC.52.15.B04.1.454.CMB.1.raw
  modified_base (139)..(139): a, c, t, g, unknown or other
  misc_feature (139)..(139): n is a, c, g, or t
tcagcgcagtacgacacgaccggtgctcgatttagacagtatatatccggcggggggggtctcaggaggcagcgctctcgggacgtctccaccatggcctggctctgctattcctccaccctcctcactcagggcacgngggtcctgggccagtctcgcctgactcacgcctgcctccgtgtctggtctcgtgactgtcgactccgacctactcctccgtgacctaccgtacggaaccagacctaagtcggtacgtttaggtaaactttaacgtaaccttcgttacgttacccgttaccgttaacggtaaaccctaaaaccgtaaacccggttaacccccggtaaaccgtaaaaacccggttaaccccccgtaaaacttccgtaacgttacggttactttacggttttacgggtaacggttaccgtagggttaccggtaaccggtacccgggtaccccgtacgggttaccgggttttaccaccgttacgtccgttccttaccggtcccgtacgttaccgtaacgtcgtcggaccgacgtacccgtaccgtccccgtaccgtaccgtaacccgtcgttacccggttaccggtccggtaccctaccgggtaacggtccggtaacgggtaacgggacggtacggtactttacggttaactttaccggttacccgtcgtaacgtaccgtacgttaaccaaccgtaaaccgaaaccgtaaacggtaaacgtaacccggtttaccgggtttacggggttacgggttacccggggtaacccgggtaacccgggtaaacccttaaccggttacccggttaacccgtttcccggttaaacccgtacgggtaaacccggtacccgttaaccccgggtccccggtttacccccggttccccgttaaacccgtccggttttccccgttacccgtttccccggttaacccccc

SEQ ID NO: 75811 - DNA, 560 bp, Homo sapiens
  misc_feature: GYAE6OF02HW3EU.52.15.B04.1.454.CMB.1.raw
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgacgttggtacttataactctgtctcctggtaccaacaataccccgcaaacgtccccaaactcatgatctttgaggtcagtgatcggccgcagggtttctcatcgcttctccggctcaagtctggcagcacggcctcctgaccatctctgggctccgaggctggaggacgaggctgtattacttactgcagctacactacaacaaacaagaaacctacgttgggtacgttccgggacggaccgggaacctaaacgtcgaccgttcccgttcgccacgacccgaacggcctaccggcccccgtcggtacccacttccgtccgttcccccg

SEQ ID NO: 75812 - DNA, 356 bp, Homo sapiens
  misc_feature: GYAE6OF02HR36C.52.15.B04.1.454.CMB.1.raw
  modified_base (348)..(348): a, c, t, g, unknown or other
  misc_feature (348)..(348): n is a, c, g, or t
  modified_base (354)..(356): a, c, t, g, unknown or other
  misc_feature (354)..(356): n is a, c, g, or t
tcagcgcagtacgacacgaccggtgctcgatttagacagtatatatccgcggggcagcttcagctgtggtagagaagacaggattcaggacaatctccagcatggccggcttccctctcctcctcaccctcctcactcactgtgcagggtcctgggcccggtctgtgttgactcagccaccctcaacgtctgggacccccgggcaaagggtcaccatgtcttgttctggaagcagctccaacatcggcactacttatgtgtactgacaccaggtcagcccaaggctgccccctggtcactctgttccccgccctcctctatacgatagctgagcgggctggcaaggcncatagnnn

SEQ ID NO: 75813 - DNA, 359 bp, Homo sapiens
  misc_feature: GYAE6OF02IADG0.52.15.B04.1.454.CMB.1.raw
  modified_base (344)..(344): a, c, t, g, unknown or other
  misc_feature (344)..(344): n is a, c, g, or t
  modified_base (350)..(359): a, c, t, g, unknown or other
  misc_feature (350)..(359): n is a, c, g, or t
tcagcgcagtacgacacgaccggtgctcgatttagacagtatatatccgcggggcagcttcagctgtggtagagaagacaggattcaggacaatctccagcatggccggcttccctctcctccccaccctcctcactcactgtgcagggtcctgggcccggtctgtgttgactcagccaccctcaacgtctgggacccccgggcaaagggtcaccatgtcttgtctggaagcagctccaacatcggcactacttatgtgtactgacaccaggtcagcccaaggctcgcccctgtccactctgttccccgcctctctatacgatcgctgagcggctggcaaggcncatagnnnnnnnnnn

SEQ ID NO: 75814 - DNA, 114 bp, Homo sapiens
  misc_feature: GYAE6OF02F6P3K.52.15.B04.1.454.CMB.1.raw
  modified_base (114)..(114): a, c, t, g, unknown or other
  misc_feature (114)..(114): n is a, c, g, or t
tcagcgcagtacgacacgaccggtgctcgatttagacagtatatatccgcgggcacgaccggtgctcgatttagacagtatatatcgaggcggcgtggacgaaggcgacatagn

SEQ ID NO: 75815 - DNA, 530 bp, Homo sapiens
  misc_feature: GYAE6OF02FXEZ2.52.15.B04.1.454.CMB.1.raw
  modified_base (250)..(250): a, c, t, g, unknown or other
  misc_feature (250)..(250): n is a, c, g, or t
  modified_base (420)..(420): a, c, t, g, unknown or other
  misc_feature (420)..(420): n is a, c, g, or t
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactntgtctcctggtaccaacaataccccggcaaacgtccccaaactcatgaatctttgagtcagtgatcggcccgcaggggtttctcatcgcttctccggctccaagtctggcagcacggcctcctgaccatctcgtgggctccgaggctgaggacgaggctgattattacgngcagctacactaacacaaacagaaactcgttggtgttcggcggcggtacaacgtcgaccgtcgttcgcacgaccagctacgccccgtcgtccacgttcctcgttcccccg

SEQ ID NO: 75816 - DNA, 567 bp, Homo sapiens
  misc_feature: GYAE6OF02IM2GA.52.15.B04.1.454.CMB.1.raw
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (454)..(454): a, c, t, g, unknown or other
  misc_feature (454)..(454): n is a, c, g, or t
  modified_base (463)..(463): a, c, t, g, unknown or other
  misc_feature (463)..(463): n is a, c, g, or t
  modified_base (514)..(514): a, c, t, g, unknown or other
  misc_feature (514)..(514): n is a, c, g, or t
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaactaccccggacaaaagtccccaaactcatgacttcttgaggtcagtgatcgcccgngtacgggtttcncatcgctttcgccgactccaagtctggcagccacggcctccctgaccatctcgtcgggctccgaggtctggaggacgaggtctgtattacgttacngtcagctanactanaacaaanacgtaaacncgtttgggagttccggcggtccggaacaacgtcgtaaccgtccgttcgacncggtaccgaaggcctacccggtcccctcggtacaccgttcctccggttccccg

SEQ ID NO: 75817 - DNA, 360 bp, Homo sapiens
  misc_feature: GYAE6OF02HR6H0.52.15.B04.1.454.CMB.1.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
  modified_base (350)..(360): a, c, t, g, unknown or other
  misc_feature (350)..(360): n is a, c, g, or t
tcagcgcagtacgacacgaccggtgctcgatttagacagtatatatccgcggggcagcttcagctgtggtagagaagacaggattcaggacaatctccagcatggccggcttccctctcctcctcaccctcctcactcactgtgcaggtcctgggcccggtctgtgttgactcagccaccctcaacgtctcgggacccccggnaaagggtcaccatgtcttgttctggagcagctaccaacatcggcactacttatgtntactgacaccaggtcagccaaggctcgcccctggtcactctcgttcccgccctctctatacgatcgctgaggcggctggcaagcgcatagnnnnnnnnnnn

SEQ ID NO: 75818 - DNA, 155 bp, Homo sapiens
  misc_feature: GYAE6OF02I9H1U.52.15.B04.1.454.CMB.1.raw
  modified_base (151)..(155): a, c, t, g, unknown or other
  misc_feature (151)..(155): n is a, c, g, or t
tcagcgcagtacgacacgaccggtgctcgatttagacagtatatatccgcgggcacgaccggtgctcgatttagctctacgctcagggcacgaccggtgctcgatttagtcacgcgagaaagggagaggcggctggacgaaggcgcatagnnnnn

SEQ ID NO: 75819 - DNA, 796 bp, Homo sapiens
  misc_feature: GYAE6OF02H15MO.52.15.B04.1.454.CMB.1.raw
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgtacttataactctgtctcctggtaccaactaactaccccggacaaacgtcccaaactcatgattcttttgaggtcaggtgactccgggcccgcgttacgggggtttctctacgtccgtcctttccgtcccgggtacctaccgtaacgttccgtcgggaccgacggccgaccggtccccttacccgtcgtaccctacgtttccgttccggtgggacccttccggacgggtcgttacgggaacgggtacggacgggtaccgttaggttaactttaacgtttaccgtaggtaccgtaccggttcctaacgtaaccgtaaacctaaaccgtaaaaaccgaacgtaaaacccgtttaaccggtttgggggttaccggtttacccgggggaccgggtaacccgggtaaaccctaaaccgggtttaccggtaacccccgggttttcccgttcggtaacccggtaacccggtaaccccgggttaaccgtcccggttaccccgggtaccccccgttcccgggttaaccctaaccccgttttcccggttaccccttttaccccccccgg

SEQ ID NO: 75820 - DNA, 642 bp, Homo sapiens
  misc_feature: GYAE6OF02GP7P8.52.15.B04.1.454.CMB.1.raw
  modified_base (227)..(227): a, c, t, g, unknown or other
  misc_feature (227)..(227): n is a, c, g, or t
  modified_base (327)..(327): a, c, t, g, unknown or other
  misc_feature (327)..(327): n is a, c, g, or t
tcagcgcagtacgacacgaccggtgctcgatttagacagtatatatccgcggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaccatctcctgcacgtggaaccngcaatgacgttggtacttatactctgtctcctggtaccaacaactaccccggacaaacgtaccccaaactcatgatcttgagtcagtgagtccggcccgngtacggggtttctctatccgtcttccgtccggtctaccgaagttcgtcggcacgccgaccggtccctcccgtacgacccattcctcgtcgggcctccgaggtctagggacggacggaggtctaggtattacttacgtgctagcctcaataacaacaaacaacgtaaacgtcggtttagggttcgttccgggacggtaaccgggaacctaaccgtcggtacccgttccggtttcccgtacgtaacccggacccgtaacggtccgtacccggtcccccgttccggtaccctaccgttccgttacccgttccccccgg

SEQ ID NO: 75821 - DNA, 170 bp, Homo sapiens
  misc_feature: GYAE6OF02FY7M7.52.15.B04.1.454.CMB.1.raw
  modified_base (167)..(170): a, c, t, g, unknown or other
  misc_feature (167)..(170): n is a, c, g, or t
tcagcgcagtacgacacgaccggtgctcgatttagacagtatatatccgcgggcacgaccggtgctcgatttagtcacgcgagaaagggaaagggggctggccctgacgtgtttctgttcccaccctcctctatacgatcgctgagcgggctggcaaggcgcatagnnnn

SEQ ID NO: 75822 - DNA, 815 bp, Homo sapiens
  misc_feature: GYAE6OF02GH7U8.52.15.B04.1.454.CMB.1.raw
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatctcctgcactggaaccagcaatgacgttggtacttataactctgtctcctggtaccaacaactaccccggcaaacgtccccaaactcatgatctttgagtcagtgacgtccggcccgcgtaggggttttcctctacgtccgtcctttccgtcccggtcctaccgtaaagttccgtaggcctacggcccgtaccgggtccccttcccgtacggaccctaactttccgttccgttcgggggacccttacccggacgggtcccgtagggtaacgggaacggtaacgggtcgtacggttaaactttaacgtttaaccgtcgtacgtacgtacccttacgaaacctaaaccgtaaccaaaaaccgtaacgtaaaaacccgttacgggttttacgggggtttacggtttacccgggggaccggggtaaacccggggtaaaccccttaaaaccgggttcccggttaaccccggtttcccggtttaacccggtaccgtaacccgggtaacccccggttaaacgggtaccccgtttaccccgggtacccccccggtttaccggggtttaccccctaacccggttttccccggtttacccgttttaacccccccccg

SEQ ID NO: 75823 - DNA, 119 bp, Homo sapiens
  misc_feature: GYAE6OF02GF9N5.52.15.B04.1.454.CMB.1.raw
  modified_base (110)..(119): a, c, t, g, unknown or other
  misc_feature (110)..(119): n is a, c, g, or t
tcagcgcagtacgacacgaccggtgctcgatttagacagtatatatccgcgggcacgaccggtgctcgatttagacagtatatatcgagcgggctggcaaggcgcatagnnnnnnnnnn

SEQ ID NO: 75824 - DNA, 689 bp, Homo sapiens
  misc_feature: GYAE6OF02FVZT1.52.15.B04.1.454.CMB.1.raw
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaacgtcccccaaactcatgatctttgaggtcagtgatcggccgnaggggtttcncatcgcttcnccgctcagtcnggcagcacgcctccctgacctatctcgtgggcctcgaggctggaggacgaggtcctggtactttacttactgactagcctacaacgttaaccaaacgaaaacctaacggtaaaaacctacggtttacgggggttacggtttacccggggacccggggtaccgggaaaccccgtaaaacggttcccgggtaaccccgtttaccccggttttaccggtaacccggtaacccggtaacccccggtaaccgggtccccgtttacccgggacccccccccgtttaccgggtaccccgttaaccccgtttacccggtttacccccggtttaaccccccccg

SEQ ID NO: 75825 - DNA, 696 bp, Homo sapiens
  misc_feature: GYAE6OF02J1EE5.52.15.B04.1.454.CMB.1.raw
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcaatgacggttggtacttataactctgtctcctggtaccaactaactaccccggcaaacgtccccaaactcatgactcttgaggtcagtgatcggcccgcgtaggggttctcatcgtcttctccgctaccaagtctcggctacgcaccggtccctccctcgacctactccgtacgtcgggcttaccgacggtcgtcggaacgggaccggaaggtaccgtagtaacgttagtttaccttcgactacgtcgtacctaactaaccaactaaaccgaacgtaaaccgtacggtttacggggttacggttccgggtaccgggaccgggtaacccgtaaacgtcccgggtacccgttaaccgtttccggtaaccgaccggtaaccccggtaaccgggttacccgtaccccgggttaccccccggtccgggtttaccccgtacccgtttccccggtttaccggtttccccccccgg

SEQ ID NO: 75826 - DNA, 902 bp, Homo sapiens
  misc_feature: GYAE6OF02HYHQA.52.15.B04.1.454.CMB.1.raw
  modified_base (187)..(187): a, c, t, g, unknown or other
  misc_feature (187)..(187): n is a, c, g, or t
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
tcagcgcagtacgacacgaccggtgctcgatttagacagtatatatccgcggggggggtctcaggaggcagcgctctcgggacgtctccaccatggcctgggctctgctattcctcaccctctcactcagggcacgagggtcctgggcccagtctgccctgactcagcctgcctcgtgtctgggtcncgtggacngtcgatccaccattctacctgactacgtacggaaccngacaaagtggtacggtttaggtaacttaactacttcgtcgtactcgtacggtaaccaacgtaaccgtaccccggactaaaccgtacccctaaactacgtaactagtactttacgtttacggacggtacgtaagttcggaccgtccgggacccggtacggttacggggtttcctacgtacgttccgtaccgtttccggcccgtaccctacggtaacgttcgtacggactacggaccgtacccgtcccgttccgtacgtaccctcgtccttacgggtcggtacctaccggtacggtacgtaacgggtaacgggtacgtacggttacgtttaacgggtaactttttaaccggaccggtacgttaaaccgtccggtaaccttaaacgtaaaccgttaaaccgaaaaccggtaaaaccgttaaaaccgggtaaacccgttttcggggttacgggggtttaacccggaccgggggtaaccgggtaaacccgggttaaaacctaaaccgggtttccccgttaaacccggttttacccgggttaaccggtaaacccggttacccggggtaaaacccggtttcccccgggtcccgtttaacccccccggggttccccgtttaaccggttaacccccggttaaccctttccccgggtttacccccgttaaacccccccgg

SEQ ID NO: 75827 - DNA, 746 bp, Homo sapiens
  misc_feature: GYAE6OF02IW5ZE.52.15.B04.1.454.CMB.1.raw
  modified_base (231)..(231): a, c, t, g, unknown or other
  misc_feature (231)..(231): n is a, c, g, or t
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctcgccctgactcagcctgcctccgtgtctgggtctctggacagtcgatcacctagtcctcctgactactcggaaccngnaagtgacgttgtacttanactctgtctctcgtaccaactacgtaccccgacaaacgtacccctaaacgtcacttagacttcgtttacgacggttacagtcgaccgtccgggacccgtacggtacggggtttctacgtacgttccgtccgttacgttcccggtaccgtacctaacggttcgtacggtacgtacgtaccgaacccgggtcccttcccgtccgaaccctacgttccgtcggttacgggaccctacgtacggcgttaacgggacggtaacggacggtacgttacgtaacgtttaacttacggtacgacgtaccggtctaacctacgaaacctaacgaaacgtaccgaaacgttccggttacgggttacggtaccgggtaccggaccggtaaaccgtaccggtaccgttcccgttacccggtccgtaacggtccggtaaacccgtacggtacccgtcccgtccccggttaccggttaaccctccgtttacccggcccgtttacccccg

SEQ ID NO: 75828 - DNA, 866 bp, Homo sapiens
  misc_feature: GYAE6OF02HSLQP.52.15.B04.1.454.CMB.1.raw
  modified_base (225)..(225): a, c, t, g, unknown or other
  misc_feature (225)..(225): n is a, c, g, or t
tcagcgcagtacgacacgaccggtgctcgatttagacagtatatatccgcggggggggtctcaggaggcagcgctctcgggacgtctccaccatggcctgggctctgctattcctcaccctctcactcagggcacgagggtcctgggcccagtctgccctgactcagcctgcctccgtgtcgtgggtcctcctggacagtcgatcacatctctgcacgtcggacngcaatgacgttgtacttatactctcgtctcgtacgtacaacaactacccggacaacgtacccaactcgatgtacttcgtttaggacggtctagtacgtacgtccgggtcccgtacgttacggggtttacctacgtaccgttcggtccgtttaccgtacccggtcccttaaccgtaacggttacgttccgggaccgtacggtaccccgtaccgggtcccctttaccccggtacggtaaacccgttacgtttcccggtttccgggtacggggttaccccgttaccgggtaccggggttaccgttacggggtaacggggtaacccgggtacgggttaccggttaacgggtttaaacgttttaaaccgtttaccggtaccggaccgttaacccgggttacctttaaccgtaaaccgttaaccgttaaaaccccgaaaaccgttaacccgtaaaccggtttaaccgggtttccggggtttacgggttaccccggggtacgggttaaaccccggaaacccgttaaaccggtcccggttaaccccggttacccgttcccggttaacgacccggtaacccggaaccggttcccgtaacccggtcccccgtaccgttaacccgtcctttacccggtcccttaacccccgg

SEQ ID NO: 75829 - DNA, 658 bp, Homo sapiens
  misc_feature: GYAE6OF02GIUQX.52.15.B04.1.454.CMB.1.raw
  modified_base (484)..(484): a, c, t, g, unknown or other
  misc_feature (484)..(484): n is a, c, g, or t
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaactacccccggacaaacgtacccccaaactcatgattcttgaggttcagtgagtccggccgcgtaggggtttctcagtcgtcttcgtaccggctaccgaacgtcgtcggctaacgccaccggtccctcccgtacgaccctactcgtccgtcgggtcctccgaacggtcgtcggacggacgtacgggtctaggaactttagttacctggtccacgtntcctaactaaccaacaaaacacgtaaacctaacggtttgggttaccggttacgggccgggtaaccggaaccgtaacctcggtaacccgtacccgttaacgtaccgaccggacccgtaacggtccttacccggcccccgtttcggtaccctccgttaccgttcccgttacccccc

SEQ ID NO: 75830 - DNA, 762 bp, Homo sapiens
  misc_feature: GYAE6OF02HQIPT.52.15.B04.1.454.CMB.1.raw
tcagcgcagtacgacacgaccggtgctcgatttagacagtatatatccgcgggggggggtctcaggaggcagcgctctcgggacgtctccaccatggcctgggctctgctattcctcaccctcctcactcagggcacagggtcctgggcccagtctgccctgactcagcctgcctccgtgtctggtctcgtgacagtcgatcacatctctgcacgtcggaaccagacatgacgttgtacttatactctgtctctcgtaccaacaactaccccgactaaacgtaccccaaactcatgattcttgaggtcgagtgacgtccggccgcggtagggtttctacgtacgtcgtccttccgtccggtcctaccgtaacgttccgtacgggaccaacggaccgtacccggtccccgtaccccgtacgtaccctacgtttcccgttccggtacgggtcccgtacccggtaacgggtccggtacgggaaccgggtaacgggtaacgggttaccgttaagttaacgttttaaacctttaccggtcgtacgtacgtacctacgtaaacctaaacgaaaccgtaaaacgaaccgtaaaacgttcggtttacggggtaccggttaccggggtaccgggaaccgggtaacctaaccggtccgtaacccggttttaccgtacccggtacgaacccggtacccgtaaccgggtcccgttacccggttcccccggtaccggttccctaaccgtttcccggttaccccggtttacccccg

SEQ ID NO: 75831 - DNA, 738 bp, Homo sapiens
  misc_feature: GYAE6OF02IYYZJ.52.15.B04.1.454.CMB.1.raw
  modified_base (190)..(190): a, c, t, g, unknown or other
  misc_feature (190)..(190): n is a, c, g, or t
tcagcgcagtacgacacgaccggtgctcgatttagacagtatatatccgcggggggggtctcaggaggcagcgctctcgggacgtctccaccatggcctgggctctgctattcctcacctctcactcaggcacagggtcctgggccagtctgccctgactcagcctgcctccgtgtctggtctcgtgacngtcgatcaccatctctgcactcggaaccagcaatgtacgttcggtaacttaatactctagtctccgtaggtaaccaactaacgtaccccggtacaaaccgtaccccaaactcaatcgtaattcgtttacggacggttcaggtcaacgtccggcccgtcgtacggggtttcacgtacgttccgtcttccgtaccgtctaccgtaacgtcgtcggaccaggacccgtaccggtaccccttaccgtacggtaacctcgtttaccgtccggttcgggtacccttaccggagtccgttagggaccggacggtaggtccgttagtaaacgtttacgtaacgtgtaccgtacgtcctaactaactaaacgaaaccctaaacgtaaccgtaaaccgttcggtttacgggttaccgggttaaccgggtacccgggaaccgtaaacccgtaacggttcccggtaacccgtttccgtaccggtaacgacccggtaacgtaccggtcccgtacccggtccccgttacggacccgttaccgttccggtacccttcccccgg

SEQ ID NO: 75832 - DNA, 843 bp, Homo sapiens
  misc_feature: GYAE6OF02HK8J2.52.15.B04.1.454.CMB.1.raw
  modified_base (230)..(230): a, c, t, g, unknown or other
  misc_feature (230)..(230): n is a, c, g, or t
tcagcgcagtacgacacgaccggtgctcgatttagacagtatatatccgcggggggggtctcaggaggcagcgctctcgggacgtctccaccatggcctgggctctgctattcctcaccctcctcactcagggcacgagggtcctcgggcccagtctgccctgactcagcctgcctccgtgtcgtgggtctccgtggacagtcgatccacatcctctgcacgtggaaccngacaagtcggtaccgttggtacttactacgttctgtccttccgtaggtaaccaactaacgtacccccggactaaaaccgtcccccaaatccaagtcgtaattcgtttaggacggttcaaggttcgacgtccggcccggacgttgggtttccacgtagttccgtccttccgtccggtctaccgacggttcgtcggacacggcctacccgggcccttccgtacgtaacctacttcccgttcggtccggtccgtacccgacgggtacgttacgggaaccgggtaaccggacgggtacgttacgttaacgttttaacggtttaccgtcgtaccgtacgtccgtaaccgttaacctaaaccgtaaaccgtaaaaccgtaaacgtaaaccgtttaacgggttacggggtttacgggttacccggggtaccgggtaaacccggggtaaccctaaaccggttaccggttaaccccggttttaccccgggtttaaccgttaccccggttaaccccggttaaccccgggtaacccgggttacccgttaacccccggttccccccggttaacccgggttacccccttacccggtttccccgttaccccgtttaccccccccggg

SEQ ID NO: 75833 - DNA, 686 bp, Homo sapiens
  misc_feature: GYAE6OF02JFZZV.52.15.B04.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
tcagcgcagtacgacacgaccggtgctcgatttagacagtatatatccgcgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctcctggacagtcgatcacatctcctgcactggaaccngcaatgacgttgtacttanactctntctctgtaccaacactacccgacaacgtacccaactcatgtattcttgacggtctaggtgacgtccggcccgtcggtacgggtttctactagtccgtcttccgtccggctaccgtaacggttcgtacggcgacggccgtaccggtccctacccgtacgtaaccctcgttccgtccggtacgggccctaccggaggtcgtaggacgggacggacggtcgtacgtatttacgttactcggcgtactactactaacaaccaaaccgtaaacgtaaacgtaacgttacgggtttaggggttccggttacccggggaccggaaccggtaaccgtaaccgttcccggtaccgtttcccggttaacgaccggaaccgacccggtaacgtcccgtcccggtccccgtccggttacctaccgttcccgttacccggttccccg

SEQ ID NO: 75834 - DNA, 841 bp, Homo sapiens
  misc_feature: GYAE6OF02IMZKW.52.15.B04.1.454.CMB.1.raw
  modified_base (260)..(260): a, c, t, g, unknown or other
  misc_feature (260)..(260): n is a, c, g, or t
tcagcgcagtacgacacgaccggtgctcgatttagacagtatatatccgcgggggggggtctcaggaggcagcgctctcgggacgtctccaccaatggcctgggctctgctattcctcaccctcctcactcagggcacagggtcctgggcccagtctgccctgactcagcctgccctccgtgtctgggtctccgtggacagtcgatcaccatcgcctgcacgtggaccagcaagtcgtacgttggtaattactaactctntctacgtggtaaccaaacgtaactaccccggactaaacgtacccccaaaacttcaagtacgtacttacgttttaggacggttacctaacggttgaaccgttcccgggtaccccggtacggttaacgggggttttaccctacgttaacgttccggttaccgtttacccggtaccccgggtcttaaccctaaacgggttcccggttagggtaacccgtaacggacccgtaacccggggtcccccttaccccggttaagtaccccgtaattcccgttccggttacgggtaccctttacccggaagggttccgtaagggaaccggaacggtaacggttccgtaggttaacttaacgttacggtacacgtagtctactaacgttaacgaaaccaaagaacgtaaccgtacggttacgggtacggttaccgggacgggtaaccgggaaacctaaccgttaccgggtaacccgttttcccggttaaccggtaaccggttacccggaaacccggtacggtacccgttaccccgggtaccccccgttacggttacccgtaaccgttcccgttaccccggtttccccccgg

SEQ ID NO: 75835 - DNA, 694 bp, Homo sapiens
  misc_feature: GYAE6OF02GKQ5F.52.15.B04.1.454.CMB.1.raw
  modified_base (226)..(226): a, c, t, g, unknown or other
  misc_feature (226)..(226): n is a, c, g, or t
tcagcgcagtacgacacgaccggtgctcgatttagacagtatatatccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttggtacttatactctgtctcctgtaccaacaacgtacccggacaaacgtaccccaaactcatcgtacttcgttggacgtacgaggtcgacgtccggcccgtacgtacgggtttctcgtacgtccgtcgttccgtccggtcctaccgtaacgttcgtacggacacggtaccgaccggtccctacccgtacgtaccctacgtccgtacggtcgggtacctccgtacggtcgtaggacgggacgacggtctacgtaacttacgttacgcgtactacgactactaataacgttaacaaacgtacggtaaaccgttcggttacgggttacgttcgggtaccggtaaccggtaaccgtaaccggtacgtacccggttaccgtaccggtaccgtaccggtaccgtaccggtccttacccggtccccgttaccggtaccttacccttaccgttcccgttaaccccc

SEQ ID NO: 75836 - DNA, 826 bp, Homo sapiens
  misc_feature: GYAE6OF02G8WE9.52.15.B04.1.454.CMB.1.raw
tcagcgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtaggactagtcgatcaccatcctcctgccacgtacggaaccagacctaagtcggtacgtttggtaacttactaactctacgttctccgtaggtaaccaactaaccgtacccggactaaacgtccccaaaactcgatcgtactcgtttacgaggtactaggtagtaccgtccgggtacccgtcggttacggggttcctacgtaccgttacgtccgttaccgtccggtcctaaccgtacggtcgtacggtacacggacccgtaaccggtccctacccgtacgtaccgtaccttccgttccggtcgggttaccctacccggtacggtacggtacggtaaaccgggtacgggaggttacctaagttaacgttttaacgttaccgtacgtaccgtcgtacccttaacgtaccgttaaaccaaaccggaaaaccgtacggttaaacccgtttaggggtttcggggtttaacccggtacccgggggaccggtaaaccgggtaaacccgtaacgggtcccggttaaccccggtttaccgtacccggtaaccggaacccggttaacccgacccggttacccgtccccgggtaaccccgtttccgtaacccggtttacccgtcccggttaccccgttaaccccccg

SEQ ID NO: 75837 - DNA, 841 bp, Homo sapiens
  misc_feature: GYAE6OF02F2WWI.52.15.B04.1.454.CMB.1.raw
tcagcgcagtacgacacgaccggtgctcgatttagacagtatatatccggcggggggggtctcaggaggcagcgctctcgggacgtctccaccgatggcctgggctctgctattcctcaccctcctcactcagggtcacagggtcctgggccctagtctcgcccgtgacctcgaacgccgtgtcccttccggtggttccttggggtacctcccgtgggaacaggtccaattccaacctagttcctaccgtgcctacgtacgggaaacccaggtactaaacgtcgtacggtttggtaacctttaataacctcgtcgtacctccgttacggtaaccaaacgtaaccgtaaccccggacgtaaaaccgtaccccgaaactaccgtaagttacgtacgttacgtttacggtacggtaccgtaggttacggtaccggtccgggtacccgtacgggttaccgggggttttacctaccgtaacgttcccgttccgttacccggttccccggtacgttaacccgtaaaggtccggttacgggaccgtaccgacccgggtacccgtacccgtcccgtacggtacccgtacgtttaccgtaccggtacgggtacctacgggtaccggtacggtaacgggacggtaccggtaagggtcgttaacggtacgttttaacgttagaccgtacgaccgttactaaccgaagtaaccaaacgaaaccgtacgtaaacgttccggttaggggtaccggttccgggacggtaaccggttacaacgtccgtaccggttacttcggacgtaccgaccgacggtaccgtccgacccgtacgctacccttcgtacccgtaccc

SEQ ID NO: 75838 - DNA, 581 bp, Homo sapiens
  misc_feature: GYAE6OF01CUA8K.5.34.D01.1.454.CMB.1.raw
tcagatcagacacgcacgaccggtgctcgatttagatcgtctgtgttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagctggtatcagcagaaaccagggaagcccctaagctcctgatctatgctgcatccagtttgacgaaagtcggggtacccaagtccgaaaggttcagtcggcaggtggatcgtgggactagatttcactctcaccatcagcagcctgcagcctagaatatttgactaacttactattgtaccaagtacggtacttaaacgtacgttttaccccgacccgtaccgtttacccgggaccgtaaacggggacctaaccgggtaaccgtacgggtaaacgtaacgtttaaaaaccggacgttacgggttacggtaccttacggaccctaaccgttaacg

SEQ ID NO: 75839 - DNA, 504 bp, Homo sapiens
  misc_feature: GYAE6OF01AZSAB.5.34.D01.1.454.CMB.1.raw
tcagatcagacacgcacgaccggtgctcgatttagatcgtctgtgttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttagcctggtatcagcagaaaccagggaaagcccctaagctcctgatctatgctgcatccagtttgcaaagtgggtcccatcaaggttcagcggcagtgatctggacagatttcactctcaccatcagcagcctgcagcctgaagattttgctaaacttactattgtacaaactaggacttaactacgtttcccctaccgtaccttcggaccaaagggaccacgtactaggagaattaaacgaactgtaggctgcactac

SEQ ID NO: 75840 - DNA, 665 bp, Homo sapiens
  misc_feature: GYAE6OF01AQ70C.5.34.D01.1.454.CMB.1.raw
tcagatcagacacgcacgaccggtgctcgatttagatcgtctgtgttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtccaccatcctacttcggtccgggacgagtacgaaggggttattaggcgagtcgttaggttacgtccgtaggtactcgagacgaacgaaaccgaagggaaaccgacccctaagcctacctgactactagtcgctcgctactaccgtagttagacgtaaaggttccgggtacctagtaccgtaaggttacgacggtccggacgtaggtcgggactcggtagggaccgtagttactttaccaccttcctaccaacctatccgaacgaccgacgtcccgtagaccgtacgtacccgtaagtaacgtttattttacgaaccttaacctttaattactttacgtaacctaacgtacggtaccttaacgttaccgtttacccctccgtacccgtccggaacgaacgggtacctacggtacgtacggaagtaacgttaaacgacgtaggtcgacgtcgaccgtctaacg

SEQ ID NO: 75841 - DNA, 637 bp, Homo sapiens
  misc_feature: GYAE6OF01EEPL3.5.34.D01.1.454.CMB.1.raw
  modified_base (199)..(199): a, c, t, g, unknown or other
  misc_feature (199)..(199): n is a, c, g, or t
  modified_base (415)..(415): a, c, t, g, unknown or other
  misc_feature (415)..(415): n is a, c, g, or t
  modified_base (452)..(452): a, c, t, g, unknown or other
  misc_feature (452)..(452): n is a, c, g, or t
tcagatcagacacgcacgaccggtgctcgatttagatcgtctgtgttgggtttggggggagtcagacccagtcaggacacagcatggacatgagggtccccgctcagctcctggggctcctgctgctctggttcccaggttccagatgcgacatccagatcgacccagtctccatcttccgtgtctgcatctgtagganacagagtcaccatcacttggcgggcagtcagggttatagcagctggttacgccgtggtatcagacaagaaaccgagggaaacgccctaagcctcgtgattctatcgctgctacttccgtagtttcgacgtaacgggtcggtacccagtacgtaagggttcgaggcggagtaggtaggactcggtagggaactagttactttcacctctaccaactntacacgcgtacgccgtacgaccagtcctagtaacttnttttacgaacttaactttactagtttacgactaagtaccgtacttaacccgttccgtttacccctacccggttaccgttacccgggaaccgtaacgggtacccgtaaccggtacgtaacgggtaaacttaaaccggtttaaacgaacggtttcggtacggtaaccgtaccgccgtaacgttaccg

SEQ ID NO: 75842 - DNA, 610 bp, Homo sapiens
  misc_feature: GYAE6OF01CIKWZ.5.34.D01.1.454.CMB.1.raw
  modified_base (200)..(200): a, c, t, g, unknown or other
  misc_feature (200)..(200): n is a, c, g, or t
  modified_base (365)..(365): a, c, t, g, unknown or other
  misc_feature (365)..(365): n is a, c, g, or t
tcagatcagacacgcacgaccggtgctcgatttagatcgtctgtgttgggtttggggggagtcagacccagtcaggacacagcatggacatgagggtccccgctcagctcctggggctcctgctgctctggttcccaggttccagatgcgacatccagatcgacccagtctccatccttccgtgtctgcatctgtagganacagagtcaccatcacgttggcgggcgagtcgagggtattagcagcgtggttagcctggtatcgagacaacgaaaccgagggaaaccgaccctaagcctcctgactctatgctgactactccgtagttcgacgtaaggtcgggtaccagtacgaagtcgaggcgnaggtgagtcgtaggactagtacttacactctacacatacgacgcgacgtcctcgcacgtactagtaagttactttacgacttaactttacttagttacgtactaacgtacgttacctaacgttccgtttaccccgtcccggtacccgttaccgggaaccgaaacgggtaccgtaacggtacgtacggtaaacgttaacgttaaacggacgttacgggtacgtaccgttacgaccctaacgtaccg

SEQ ID NO: 75843 - DNA, 665 bp, Homo sapiens
  misc_feature: GYAE6OF01BHF8T.5.34.D01.1.454.CMB.1.raw
  modified_base (265)..(265): a, c, t, g, unknown or other
  misc_feature (265)..(265): n is a, c, g, or t
  modified_base (301)..(301): a, c, t, g, unknown or other
  misc_feature (301)..(301): n is a, c, g, or t
tcagatcagacacgcacgaccggtgctcgatttagatcgtctgtgttggggtttggggggagtcagacccagtcaggacacagcatggacatgagggtccccgctcagctcctggggctcctgctgctctggttcccaggttccagatgcgacatccagatcgaccctagtcctccatcttccgtgtctgcatcgtgtaggagacagtacgtcaccatctacgttggtcgggcgagtcgtagggtattacgcagtcgtaggttanccgtggtatacagacaacggaaaccgagggaaaccncccgtaagcctcctgatctagtcgctgctactcgtagttcgacgtaaggtccggacctagtacgtacggtcaggcggagtacggtgacgtcgtacggactagttacttccgaacttctaccgacacgtccgaacgcgtaccgccgtacgacgtacgtaccgttaagttaacgttagttttaccaacgtttaaccttagtacgttaacgaacctaaacggtccgtaaaccttacgtttacccggtttacccctaccgggttacccggttacggacccggtaaacggtacccgtaacggttacgtaacggtaaacgtttaacggtaaacccgtaggttcggttacggcttacccgaactccgtacg

SEQ ID NO: 75844 - DNA, 648 bp, Homo sapiens
  misc_feature: GYAE6OF01ERYCG.5.34.D01.1.454.CMB.1.raw
  modified_base (456)..(456): a, c, t, g, unknown or other
  misc_feature (456)..(456): n is a, c, g, or t
tcagatcagacacgcacgaccggtgctcgatttagatcgtctgtgttggggtttggggggagtcagacccagtcaggacacagcatggacatgagggtccccgctcagctcctggggctcctgctgctctggttcccaggttccagatgcgacatccagatcgaccagtcctccattccttccgtgtctgcatctaggtaggagacaggacgtaccacctatctacgttggtccgggcgtaggtcgtaagggttattaggcgagtcgttaggttacgccgttaggtatcgagacaaacggaaaccgacgggaaaccgcccgtaagcctacctagactcgtatcgtctgcctactccgtagttacgaacgtaacgggtccggtacctagtacgtaaggtcgaggcgagtaggtcgtacgtcggaggactagttacttaccacctacgtacctaaccnctacgacgcgaccgtcgacgaccgacgttaccgtagttaacgttactttacggaaccttaacgtttactacgttaacgtaccgaacgttacgttaaccttaaccgttcccgttcccgtaccgtacccggtcgaccggaagtcgacgtaggacgtaacgtaacgtaacgacgttcggacgacacgtctcgtcg

SEQ ID NO: 75845 - DNA, 486 bp, Homo sapiens
  misc_feature: GYAE6OF02I6692.5.34.D01.1.454.CMB.1.raw
  modified_base (424)..(424): a, c, t, g, unknown or other
  misc_feature (424)..(424): n is a, c, g, or t
  modified_base (462)..(462): a, c, t, g, unknown or other
  misc_feature (462)..(462): n is a, c, g, or t
tcagatcagacacgcacgaccggtgctcgatttagatcgtctgtgttgggtttgggggagtcagacccagtcaggacacagcatggacatgagggtccccgctcagctcctgggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcgcagtggatctgggacagatttcactctcaccatcagcagcctgcagcctgaagatttgctaacttactattgtcaacaggactaacncgtttaccctcgaccttcgccaaggacacgactagganagttaacgactgtggctgcactac

SEQ ID NO: 75846 - DNA, 506 bp, Homo sapiens
  misc_feature: GYAE6OF02HIG25.5.34.D01.1.454.CMB.1.raw
tcagatcagacacgcacgaccggtgctcgatttagatcgtctgtgttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagccctaagctcctgatctatgctgcatccagtttgcaaagtggggtcccatcaaggttcagcggcagtggatctgggacagatttcactctcaccatcagcagcctgcagcctgaagtattttgctaactttactattgtacaactaggacttaaactacgtttccctccgtaccttcggccaagggaccaacggactggaagattaaacgactggtaggctgcacctacg

SEQ ID NO: 75847 - DNA, 560 bp, Homo sapiens
  misc_feature: GYAE6OF02JCKS8.5.34.D01.1.454.CMB.1.raw
tcagatcagacacgcacgaccggtgctcgatttagatcgtctgtgttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtcggggtccatcaaggttcaggcggcagtggatcgtgggacagtatttcactctcaccatcagcagcctgcagcctgaatatttcgactaactttactattcgtacaacgtaggaccttaacgtacgtttcccctaccgtaccctttaccgggacccgtaacgggtacctaaccggtaaccgttaggggaaacgtaacgttaaaaccggacgttacggttacggtcctacggtacctaccctacg

SEQ ID NO: 75848 - DNA, 619 bp, Homo sapiens
  misc_feature: GYAE6OF02F1PIA.5.34.D01.1.454.CMB.1.raw
  modified_base (385)..(385): a, c, t, g, unknown or other
  misc_feature (385)..(385): n is a, c, g, or t
tcagatcagacacgcacgaccggtgctcgatttagatcgtctgtgttgggtttggggggagtcagacccagtcaggacacagcatggacatgagggtccccgctcagctcctgggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccgagggaaacgcccctaagcctcctgatctatgctgcatccagtttgacgtaaaggtcggggtacccagtacgaaggttcaggcggcgagtggtatcgtgggacagtactttcacttcnccaccatcagcagccctagcacgcctaggtaacgttattttacgactaactttactagttacgtaccaaacgtacggtaccttaaaccgtaccgttttacccccgtaccgttacccgttaccgggacccgtaaacgggtaccgtaaaccggtaccgttaacgggtaaccgtaaacgtttaaaccggtaacggttacgggttacgggtaccgtcggtaacccacccgttaacccg

SEQ ID NO: 75849 - DNA, 734 bp, Homo sapiens
  misc_feature: GYAE6OF02GLFXN.5.34.D01.1.454.CMB.1.raw
  modified_base (306)..(306): a, c, t, g, unknown or other
  misc_feature (306)..(306): n is a, c, g, or t
tcagatcagacacgcacgaccggtgctcgatttagatcgtctgtgttgggtttggggggagtcagacccagtcaggacacagcatggacatgagggtccccgctcagctcctgggctcctgctgctctggttcccaggttccagatgcgacatccagatgacccagtcctccatccttccgtgtctgcatcgtggtaggagacgagagtccaccatctacgttggcgggcaggtcgagggtattagcagcgtggttacgccgtggtatcgagacaagaaaccgagggaaacgccctaagcctcctntactactatcgctgctacttacgtagttgaacgtaaaggtcggggtaccctaagtaccgtaaggttcgaacggtcggtacgtagggtggtaacgttaccggtacggggtaacctaacggttaaccgtttttacccgaaccgttacccgtacccaaacccgtagttaccgaacggtaccgacccgtccgtacgacccgtaacgggttcctaaggttaaacgttttaacgtttacgtaaacctttaaaccgtttaacgttaacgtttcgtaaaccgtaacgttaacgggtaccctttaaaccgttacccgttttacccccgaaccgttacccgttacccggtaccgtaacgggaacctaaccgggtaacgtaacggtaaacgtaaccgtttaaaccggacgttaggtaccgacgtactaccggtactacg

SEQ ID NO: 75850 - DNA, 516 bp, Homo sapiens
  misc_feature: GYAE6OF01AMTRB.8.39.D06.1.454.CMB.1.raw
  modified_base (489)..(489): a, c, t, g, unknown or other
  misc_feature (489)..(489): n is a, c, g, or t
  modified_base (509)..(509): a, c, t, g, unknown or other
  misc_feature (509)..(509): n is a, c, g, or t
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtgacaatcaaccgaactgtggctgcacatctgtctnatcttcccgccatctgagcncgcgacg

SEQ ID NO: 75851 - DNA, 562 bp, Homo sapiens
  misc_feature: GYAE6OF01DUQK0.8.39.D06.1.454.CMB.1.raw
  modified_base (261)..(261): a, c, t, g, unknown or other
  misc_feature (261)..(261): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatgggganaatcaacccgagtggaggtggtgcagagtacgcccagaggtttcagggcagagtctccatgaccagtgacacgtccgcgagcactgtctatatggagatgagagcctgagacttgacgacacggccgtatattactgtgcgagaatcgaagaaggtggactacaatcaacggagtacgttttagtaagttttaggggacctaaagggaacgtaaagttggtactagtcgtctcctcacgcccttaccaccgaacgggcccagttaccggtccttccccctggccctacccgtcctaacccg

SEQ ID NO: 75852 - DNA, 513 bp, Homo sapiens
  misc_feature: GYAE6OF01DBMKL.8.39.D06.1.454.CMB.1.raw
  modified_base (370)..(370): a, c, t, g, unknown or other
  misc_feature (370)..(370): n is a, c, g, or t
  modified_base (478)..(478): a, c, t, g, unknown or other
  misc_feature (478)..(478): n is a, c, g, or t
  modified_base (486)..(486): a, c, t, g, unknown or other
  misc_feature (486)..(486): n is a, c, g, or t
  modified_base (496)..(496): a, c, t, g, unknown or other
  misc_feature (496)..(496): n is a, c, g, or t
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttcttggtgagcctacaggccactggcaccccagacaggatcagtggcagcgggtctgggacagacttcattctcaccatcaaacngactgcagcctgaagatattgcagtttacactgtcagcaagtatgttaccgtcccgtgacgtttcggccaagggaccaaggtcgcaatcaaccgactgtagctgcacntctgtctnatccttcccncatctaganacngcgag

SEQ ID NO: 75853 - DNA, 524 bp, Homo sapiens
  misc_feature: GYAE6OF01ARGUY.8.39.D06.1.454.CMB.1.raw
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (518)..(518): a, c, t, g, unknown or other
  misc_feature (518)..(518): n is a, c, g, or t
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtgagcctacagggccactggcaccccagacaggatcagtggcagcgggtctgggacagacttcattcncacatcaacngactgcagcctgaagatatgctagtttactactgtcagcagtatgttaccgtcccgtggtacgttcggccaagggaccaaggtgactaatccgaaaccgactgcggctgcacatctgtcttcacttccttcccgcactctagacgacngcgacg

SEQ ID NO: 75854 - DNA, 589 bp, Homo sapiens
  misc_feature: GYAE6OF01BDF66.8.39.D06.1.454.CMB.1.raw
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggcgtatattactgtgcgaagaatgaagaaggtggactaacaatcgaacggagtcgtttttagaagtttttcggggaccgtaaaggggtacaaagttgggtactaagttccgtcgttcctcgacgtccctacccgaacccgtaaacgggcccctaagttccggtccctttaccccccgtgggcccctaccccgtccctaaccccg

SEQ ID NO: 75855 - DNA, 573 bp, Homo sapiens
  misc_feature: GYAE6OF01B9WII.8.39.D06.1.454.CMB.1.raw
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcaggagtctccatgaccagtgacacgtccgcgagcactgtctatatggagatgaggagcctgagacttgacgacacggccgtatattactgtgcgagaatcgaagaaggtgactacaatcacggagtcttttagaagttttggggaccgtaagggactaagttggtactactcgtcctccgtacgacgtccctacccaacccgtaacggggcccctagttcccggttccttccccccgtaggcccctaccccgtccctaacccg

SEQ ID NO: 75856 - DNA, 642 bp, Homo sapiens
  misc_feature: GYAE6OF01AESKC.8.39.D06.1.454.CMB.1.raw
  modified_base (262)..(262): a, c, t, g, unknown or other
  misc_feature (262)..(262): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggagtgggganaatcaacccgagtggaggtggtgcagagtacgcccagtaggtttcagggcagagtctccatgaccagtgacacgtccgcgagcactgtactatatggagtatggaggagccgtgacggtacgttaggaccgaacgaccgggtaccgttattaacgttacttgggtcgaccggaaaggtaacgtaacggaaggggtaaagggtacgggtacctaaacgtaacgtaccggtaacgggtaacgttaccgtttttaggtaacggtttttcggggaaccgtaaaggggaactaacgttggtactagtccgtcctccgtctacgccctaccgaccgaaccggccctagtccggtcccttccccgtgcccctaccctccgtaacccg

SEQ ID NO: 75857 - DNA, 569 bp, Homo sapiens
  misc_feature: GYAE6OF01CDIA2.8.39.D06.1.454.CMB.1.raw
  modified_base (404)..(404): a, c, t, g, unknown or other
  misc_feature (404)..(404): n is a, c, g, or t
  modified_base (423)..(423): a, c, t, g, unknown or other
  misc_feature (423)..(423): n is a, c, g, or t
  modified_base (499)..(499): a, c, t, g, unknown or other
  misc_feature (499)..(499): n is a, c, g, or t
  modified_base (527)..(527): a, c, t, g, unknown or other
  misc_feature (527)..(527): n is a, c, g, or t
  modified_base (549)..(549): a, c, t, g, unknown or other
  misc_feature (549)..(549): n is a, c, g, or t
  modified_base (555)..(555): a, c, t, g, unknown or other
  misc_feature (555)..(555): n is a, c, g, or t
tcagctcgcgtgtccacgaccggtgctcgatttagtgacatctcgcaggttctttggggcagttaggacccagagggaaccatggaaagcccagcgcagcttctcttcctcctgctactctggctcccagagacgaccggagagattgtattgacgcagtctccaaccaccctgtctttgtctcctgggggagagccaccctctcctgcaggccagtcgaaccttttagtagtaggttatttagcctggtatcggacaaaacctgccagctccccgactcctcttcttggtcggacgcctacgacgggcccactcggccaccccacgaccgaggactcgagtcggcaggcgggtcgtgggacagacttcacttctcaccatcaacagactcgcacgcctagaanactattgctagtttacatntcagcagtactgtaccgtccgtagacggttcgccgaagggacccaaggtcggactaactccgaaaccgtactcggngacctgaccacacttccgtacgtccttnacttccctaccccgctacgtcncggacnccgacgccggtacg

SEQ ID NO: 75858 - DNA, 540 bp, Homo sapiens
  misc_feature: GYAE6OF01CMB6H.8.39.D06.1.454.CMB.1.raw
tcagctcgcgtgtccacgaccggtgctcgatttagtgacatctcgcagttctttgggttttgggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggagtggtgcagagtacgccagaggttcagggcagagtctccatgaccagtgacacgtcgcgagcactgtctatatggagatgaggagctgagacttgacgacacggcgtatattactgtgcgagaaatcgaagaaggtggactacaagtcacggtagtcttttagaagttttggggacctaagggactaagtggtctatcgtctcctcacgcctccaacgacggccctatccggtccttacccccgtgcccacccgtcctaacccg

SEQ ID NO: 75859 - DNA, 605 bp, Homo sapiens
  misc_feature: GYAE6OF01EI227.8.39.D06.1.454.CMB.1.raw
  modified_base (209)..(209): a, c, t, g, unknown or other
  misc_feature (209)..(209): n is a, c, g, or t
  modified_base (541)..(541): a, c, t, g, unknown or other
  misc_feature (541)..(541): n is a, c, g, or t
tcagctcgcgtgtccacgaccggtgctcgatttagtgacatctcgcagttctttgggggggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgtaaccttttagtagttagttatttagccttggtatcggacaaaacctggccaggcctcccgactcctcttctttggtggagcctacgacgggccacgtggccaccccgagacaggatcgagtggcaggcggtcgtgggacagtacttcgattctcaccatacaacagactgacacgtcctagaagtattaagttcgacttaagtttactacttgtacagtctagtattcggttaccgtcccgtaggtaccgttcggaccgaagggtaccgtaagggtcgaccaacgtaccgaaccgtacgttcggnggtacgtcggaccaccgtattccgtacgttaccttacacgttccccttacccggcctagtaccg

SEQ ID NO: 75860 - DNA, 556 bp, Homo sapiens
  misc_feature: GYAE6OF01EGWL4.8.39.D06.1.454.CMB.1.raw
  modified_base (261)..(261): a, c, t, g, unknown or other
  misc_feature (261)..(261): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatgggganaatcaacccgagtggaggtggtgcagagtacgcccagaggtttcagggcagagtctccatgaccagtgacacgtccgcgagcactgtctatatggagatggaggagcctgagacttgacgacgacggccgtatatactgtgacgagatcgaagaaggtgactacaatcacggagtctttagtaagtttcggggaccgaaggggtacaagttggtactagtcgtctcctacacgtccctccaaccgaacggccccagtcccggttccttccccctggccctcccctccgtaacccg

SEQ ID NO: 75861 - DNA, 568 bp, Homo sapiens
  misc_feature: GYAE6OF01EIEAV.8.39.D06.1.454.CMB.1.raw
  modified_base (261)..(261): a, c, t, g, unknown or other
  misc_feature (261)..(261): n is a, c, g, or t
tcagctcgcgtgtccacgaccggtgctcgatttagtgacatctcgcagttctttgggttttgggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggganaatcaacccgagtggaggtggtgcagagtacgcccagaggtttcagggcagagtctcatgacagtgacacgtccgcgagcactgtctatatggagatggaggagcctgagacttgacgacgacggccgtaatattactgtgacgagaatcgaagaaggtggactacaatcacggagtcgtttgtaagtttcggggacctaagggactaagtggtactagtcgtcctcctcacgtccctaccgacccgaaacgggccccacgtccggttcccttcccccgtacggtcccaccccgtccctaaccccgg

SEQ ID NO: 75862 - DNA, 585 bp, Homo sapiens
  misc_feature: GYAE6OF01DVQKX.8.39.D06.1.454.CMB.1.raw
  modified_base (261)..(261): a, c, t, g, unknown or other
  misc_feature (261)..(261): n is a, c, g, or t
  modified_base (403)..(403): a, c, t, g, unknown or other
  misc_feature (403)..(403): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatgggganaatcaacccgagtggaggtggtgcagagtacgcccagaggtttcagggcagagtctccatgaccagtgacacgtccgcgagcactgtctatatggagatgaggagcctgagtacttgaacgacacggcgtatattactgtgngaagaatacggaagagtggactaacaatcgacggagtcgttttagtaagttttcggggaccgtaagggacaagtggtactagttccgtctaccctgaccgcccgtacccaacccgaacgggtacccctacgttcccggttcccttaccccccgtggtcccctaaccccgtccctaaaccccg

SEQ ID NO: 75863 - DNA, 739 bp, Homo sapiens
  misc_feature: GYAE6OF01COQA6.8.39.D06.1.454.CMB.1.raw
  modified_base (271)..(271): a, c, t, g, unknown or other
  misc_feature (271)..(271): n is a, c, g, or t
tcagctcgcgtgtccacgaccggtgctcgatttagtgacatctcgcagttctttgggttttgggggaagaggaagactgacggtccccccaggagttcaggtgctcactcccaggtgcagctggtgcagtcgtggggctgaggatgaagagtccgtggggcctcgagtgaagtactttcctgacaaggcgtccggatacgaggttccaccgccgtctatattaagtggctgcgacacggcccctggacgaagggcctgagtggagtggganatcgaaccgagtggaggtgtgacgagacgtacgccgaggtacggttcgagggtcaggtacgtctaccagtcgaccagtcgacgaccgtccgcgacgctacgtgtactaagtacgtaggagtagtaggacggacgtccgtagaacgtacgttacgaaccggaccgaccgggtaccgttaacgttacgtttacgtcggtacggaacggtaacgtaaagtacggaaagggtaacgggtaggtaaccgtaacgtaacgtaccggtaacgggtagtttaaccgtttttaggtaaacgggttttacggggaaccggtaaaggggtaacttaagttccgggtataccgttccgttaccgtcccgtaccgacccgtcccgtacccgaacccggacccggtcccgtaacccggtttccccggttcccctttaccccccggtaccgtacccccttacccccgtaccccgtaaacccgg

SEQ ID NO: 75864 - DNA, 642 bp, Homo sapiens
  misc_feature: GYAE6OF01COO8R.8.39.D06.1.454.CMB.1.raw
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
tcagctcgcgtgtccacgaccggtgctcgatttagtgacatctcgcagttctttggggcagttaggacccagagggaaccatggaagcccagcgcagcttctcttcctcctgctactctggctccagagacgacggagagattgtattgacgcagtctccaaccacctgtctttgtctcgtggggganacgccacctctcngcgacggcagtgtaactttagtagtagttattagctggtatcggacaaaactggacaggctcccgatccgtcttcgttggtagacgtcctacgacgggccacgtcggaccaacccacgacgaggactacgagaggcgacggcgggtacgcgggaacaggtacttcattcctacaccaatacaaacgagacctgaccagtccgtaaggaatattacgtagacttaacgtttactactcggtacagacgtaagtattcggttaaccgtccggtacgtacggttacgaacgaacgggaacgtacggtaagaacgtaataaccggaacgtaagtcggtagtactacggaacctccgaaacgtttcctacggtttaccttctaaccgttacccttacccggtaccaacgtttcgaacgttaacggaacccgcggtacggaaccggg

SEQ ID NO: 75865 - DNA, 573 bp, Homo sapiens
  misc_feature: GYAE6OF01BDYRX.8.39.D06.1.454.CMB.1.raw
  modified_base (342)..(342): a, c, t, g, unknown or other
  misc_feature (342)..(342): n is a, c, g, or t
  modified_base (373)..(373): a, c, t, g, unknown or other
  misc_feature (373)..(373): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctgggggcctcagtgaagatttcctgcaaggcgtccggatacaggttcaccgccgtctatattaattggctgcgacaggcccctggacaagggcctgagtggagtggggagaatcaacccgagtggaggtggtgcagagtacgccagaggtttcagggcagagtctccatcgaccagtcgacacgtccgngacgcactgtactagtatggagagtggaggngccgtgagtacttgacgacgacggcctatattactgtgcgagaactagaaggaaggtggctaacatcgacggagtcgttttagtaaggttttgggaccgtaagggactaagtggtcagtcgtcctacctcacgtccctaccaccgacgggacccctagtcccggttcccttccccgtcggccctccccgtccctaacccg

SEQ ID NO: 75866 - DNA, 679 bp, Homo sapiens
  misc_feature: GYAE6OF01CYKNL.8.39.D06.1.454.CMB.1.raw
  modified_base (228)..(228): a, c, t, g, unknown or other
  misc_feature (228)..(228): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (283)..(283): a, c, t, g, unknown or other
  misc_feature (283)..(283): n is a, c, g, or t
  modified_base (374)..(374): a, c, t, g, unknown or other
  misc_feature (374)..(374): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagtatttcctgcaaggcgtccggatacaggttcaccgcgtctatattaattggctgcgacncggcccctggacaagggcctgaggtgagtgggganancaaccgagtggaggtggngcgagacgtacgacccaggtacggtttcgagggcaggcgtctccaatcgacagtcgacacgtcgcgagcactgtactatagtacgagtagnggtaagcgccgttaggacgtacgttgaccgaacgtaccggtaccggttaatacgtttacgtggtacgtccggaagtaaacgtacggtaaaggtagggtcggaactaacaacgtacgaacggttagttacgttttaaggtaacggttttacggggaccggtaacgggtaacgttaacggtcgttacgtaacgttccgtaccgtccctacgtaccgtccctacccgtaaacccggcccgggtaccctaaccggttcccgtacccccgtttccccgtaccggtaccccctccccgtacctaaccccgg

SEQ ID NO: 75867 - DNA, 616 bp, Homo sapiens
  misc_feature: GYAE6OF01CE5WK.8.39.D06.1.454.CMB.1.raw
  modified_base (247)..(247): a, c, t, g, unknown or other
  misc_feature (247)..(247): n is a, c, g, or t
  modified_base (578)..(578): a, c, t, g, unknown or other
  misc_feature (578)..(578): n is a, c, g, or t
  modified_base (582)..(582): a, c, t, g, unknown or other
  misc_feature (582)..(582): n is a, c, g, or t
  modified_base (586)..(587): a, c, t, g, unknown or other
  misc_feature (586)..(587): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (598)..(599): a, c, t, g, unknown or other
  misc_feature (598)..(599): n is a, c, g, or t
  modified_base (604)..(604): a, c, t, g, unknown or other
  misc_feature (604)..(604): n is a, c, g, or t
  modified_base (609)..(611): a, c, t, g, unknown or other
  misc_feature (609)..(611): n is a, c, g, or t
  modified_base (613)..(613): a, c, t, g, unknown or other
  misc_feature (613)..(613): n is a, c, g, or t
  modified_base (615)..(616): a, c, t, g, unknown or other
  misc_feature (615)..(616): n is a, c, g, or t
tcagctcgcgtgtccacgaccggtgctcgatttagtgacatctcgcagttctttgggttttgggggaagaggaagactgacggtccccccaggagttcaggtgcccactcccaggttcagctggtgcagtctggagctgagagttccagggcagagtctccatcgaccatagacacatccgcgaccacagcctatagtggagttcgacgagcctgagatcgtgacgacgacggccgtgtacttacgngtgcgaggtatgtagtagtgacgtggtacgaccggggaattgacgtacgtgggccgagggtactccgtggtccaccgtctccgtcgacgtcctaccaccgaacgggccctagtccggttccttcccccgtggtaccctaccccgttccgtacccgaaacgtacgacccgtaccgtccggtacgggggtccaaccgtcggacccgggtcccgtcggggccgttcggtacccgttcgggtaaccgtaaacgggtaccttaccgttacccgaacgtaccggcggacgtaccgtacggacggccgggcgtacgggacgacggcgacgtagtacgntcgngagnngncngncgtgnntgctnagtcnnncngnn

SEQ ID NO: 75868 - DNA, 698 bp, Homo sapiens
  misc_feature: GYAE6OF01EMO2R.8.39.D06.1.454.CMB.1.raw
  modified_base (261)..(261): a, c, t, g, unknown or other
  misc_feature (261)..(261): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacagggcctgagtggagtgggganaactcaacccgagtggaggtggtgcaggagtacgcccgagaggtttcagggcagagtctccatgaccagtgacacgtccgcgagcactgtctatatggagatggaggagccgtaggagtacgttggaaccgtaacgaccgggtaccgttaattaacgtttaacgtggttacgacgggaaacgtaaacgtacggaaaggtaagggtcggaccttaacgaactaccgtaaccgggtagttacgttttaaggttaacgggtttttacgggggaccgtaaacggggtaactaacggttgggtaccgacgtttccggtaccgttcccgtaccgaacggtcccctacccgtaacccggaaccgggaccccctaagttcccccgggtttcccctttacccccccggtcgggttaccccctaccccccgttcccgtaaaccccgg

SEQ ID NO: 75869 - DNA, 714 bp, Homo sapiens
  misc_feature: GYAE6OF01C7IDH.8.39.D06.1.454.CMB.1.raw
  modified_base (190)..(190): a, c, t, g, unknown or other
  misc_feature (190)..(190): n is a, c, g, or t
tcagctcgcgtgtccacgaccggtgctcgatttagtgacatctcgcagttctttggggcagttaggacccagagggaaccatggaaagccagcgcagcttctcttcctcctgctactctggctccagagacgaccggagagattgtattgacgcagtctccaaccacctgtctttgtctcgtgggggganagccaccctctcctgcgagggcagtgtaacctttagtagtagttattagcctggtatcggacaaaacgtggaccaggcctcccgactcctcttcgttggtgacgtcctacgaggccagtcggcccaaccccgagaccgtaggactacgaggtggcgagggtccggggtctacggggacacggtacttccatttccacctaccaacttaccaaacgtacgtactacgacgtaacggcccttaaggaaacgtatttacgtagtaccgttaacggttttaacctaccgtgtaccgacgtactaagttagttcggtttacccggtccccgggtaggtacccggttaccgggaacccgtaaagggggtacccgtaaggggtccgtaacctaacggttaacctaaccggtaacggttgggtacggtcctaacggtacccgtaacttcttacggtcttaccgttacctaacctttcccgtccccgtaacttcgttaccgtaacggaccgtaaccgccgggtacgtaaccgg

SEQ ID NO: 75870 - DNA, 723 bp, Homo sapiens
  misc_feature: GYAE6OF01C3CED.8.39.D06.1.454.CMB.1.raw
  modified_base (219)..(219): a, c, t, g, unknown or other
  misc_feature (219)..(219): n is a, c, g, or t
  modified_base (282)..(282): a, c, t, g, unknown or other
  misc_feature (282)..(282): n is a, c, g, or t
tcagctcgcgtgtccacgaccggtgctcgatttagtgacatctcgcagttctttgggtttgggggaagaggaagactgaccggtccccccaggagttcaggtgctcacctcccaggtgcagctggtgcagtcgtggggctgagatagaagagtccgtcggggcctcaggtgaaagtctttcctgcgaaggtcgtaccggatacacggttcaccgccgtntataattagtggctggcgacgacggcccctggaacgacgggcctgaggtggagtagggggaanaacgtaccgaaccggaggtggaggtggtgcgaagacggtacgacccgtaaggtacggttacgacgggtaccgaaggtacgtcctaccgagttacgaacctagtacgaacccgtaccgtccgaccgaacgcctacgtcgtacgtaagttagtaggaagtacgaggaacggtaagtccgtaggaacgtcgtaacgacggacgtaccggtactagttactacgtagtagacgtaagaacgtagaaaggtggtaacgactaacgtagtacgaaggtacgttaacgtttaggtaaggtttaccgggaacgtaacggtaagttaacgttacggtactacggttccgtacgtccctacgtaccgtacccgtaccgaaccgtaccgtacccgtacgttcccgttacccccgttacccgtaccgacccctaccccgtcccgtaaacccgg

SEQ ID NO: 75871 - DNA, 670 bp, Homo sapiens
  misc_feature: GYAE6OF01BOFVH.8.39.D06.1.454.CMB.1.raw
  modified_base (321)..(321): a, c, t, g, unknown or other
  misc_feature (321)..(321): n is a, c, g, or t
  modified_base (409)..(409): a, c, t, g, unknown or other
  misc_feature (409)..(409): n is a, c, g, or t
  modified_base (647)..(647): a, c, t, g, unknown or other
  misc_feature (647)..(647): n is a, c, g, or t
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccacctgttctttgtctccgtggggggagagccaccctctcctgcgacgggccagtcgtaaccttttagtacgttaagttatttagccgttggtagttccggaactaaaaaccgtcggaccgacggcctccccgactccttcttcgttggtggacncccgtacgacggccacgtcgaccaccccgagacaggatcgaggtggcagggtccgggttcgtacgggactagtaccttacgtacttcncctaaccgtataccgaacgacgtactcgacacggtccaagtaacgtattacgtacgtacgttaagttttaccacgttgttacaggtactaagttcttaccgggttacccgtcccgggtacgggttaccgtaccggtaccggaacgggtaaccgaaggtccgacctaacgtaccgtaacgacgttggtacgactacgacgactactcgttacgtcttacgacttcccgtacctaccgtntccgtagaccgagtcgcggtacg

SEQ ID NO: 75872 - DNA, 749 bp, Homo sapiens
  misc_feature: GYAE6OF01DG209.8.39.D06.1.454.CMB.1.raw
  modified_base (261)..(261): a, c, t, g, unknown or other
  misc_feature (261)..(261): n is a, c, g, or t
  modified_base (325)..(325): a, c, t, g, unknown or other
  misc_feature (325)..(325): n is a, c, g, or t
tcagctcgcgtgtccacgaccggtgctcgatttagtgacatctcgcagttctttgggttttgggggaagaggaagactgacggtccccccaggagttcaggtgctcactcccaggtgcagctggtgcagtcgtgggctgagatgaagagtcctggggcctgagtgaagtatttcctgcaaggcgtccggatacgaggttcaccgcgtctatattagtgctgcgacacggcccctagacgaaggcctgagtggagtgggganaactacgaacccgagtggaggtggtgcgagagtaccgccgaggtggtttcgaggacagacgtcnccatcgacagtagacgacgtccgacgagcacgttgtactaatagtaggagagtaggaggacgcgtacggagtacgtttacggaaccgaaccgtacgggtaccgtaatttaacgtttacgtggtacggtacggaaagttaaacggtaccggtaaaagggtacgggttacggtaaccgtaaacgtaacgttaccggaacgggttaacgtttacgttttaaggttaagggttttaccgggaacggtaaacgggtaaccgtaagttcggttactaacgttcccgttacgtcccgttacgaacccgtccccgtaacccggtaaaccccggtaaacccgggtcccccttaaccggtttacccccggtttcccccgtttaccccccgttaccgggtaacccccctcccccgtttccccggtaaaaccccgg

SEQ ID NO: 75873 - DNA, 594 bp, Homo sapiens
  misc_feature: GYAE6OF01CAUZ4.8.39.D06.1.454.CMB.1.raw
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
  modified_base (362)..(362): a, c, t, g, unknown or other
  misc_feature (362)..(362): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatgggganaatcaacccgngtggaggtggtgcagagtacgcccagaggttcagggcagagtctccatgaccagtcgacacggtccgcgagcactgtactatatggaagntggaggagtcccgtaggagtacgttggaaccgacgaacggtccgtaattacttacgtggtgacgtaagaactacggaagaaggtggactaacaatccgaggtagtacgtttagtaaggtttcggggaccgtaaggggactaagtcggtactagtccgtcgtcctacacgtccctaccaccgtacggcccctagtcccggttcccttccccgtagccctcccgtccgtaaccg

SEQ ID NO: 75874 - DNA, 598 bp, Homo sapiens
  misc_feature: GYAE6OF01AMJWX.8.39.D06.1.454.CMB.1.raw
  modified_base (264)..(264): a, c, t, g, unknown or other
  misc_feature (264)..(264): n is a, c, g, or t
  modified_base (317)..(317): a, c, t, g, unknown or other
  misc_feature (317)..(317): n is a, c, g, or t
  modified_base (363)..(363): a, c, t, g, unknown or other
  misc_feature (363)..(363): n is a, c, g, or t
tcagctcgcgtgtccacgaccggtgctcgatttagtgacatctcgcagtttctttgggttttggggggaagaggaagactgacggtccccccaggagttcaggtgctcactcccaggtgcagctggtgcagtctggggctgagatgaagagtcctgggggcctcagtgaagatttcctgcaaggcgtccggatacaggttcaccgccgtctatattaattggctgcgacacggcccctggacaagggcctgagtggatgggganaatcaacccgagtggaggtggtgcagagtaccgccaggaggtttcagggcagngtctcatgaccagtgacacggtccgcgacgcactgtctatatgganagtggaggacgctagatcgttgacgacaccgcgtatattactgtagcgaagaatacggaaggaggtggtactaactaacgtacgaacggacgttcgttttagttaacggttttacgggaccgtaaagggtacgtaagtcggtctacgtcgtcttccgtcacgccctaccgaaccgaccgggaccctacgttccggttccccttccccgtacggtaccctcccctcccgtaacccg

SEQ ID NO: 75875 - DNA, 828 bp, Homo sapiens
  misc_feature: GYAE6OF01A5AB5.8.39.D06.1.454.CMB.1.raw
  modified_base (234)..(234): a, c, t, g, unknown or other
  misc_feature (234)..(234): n is a, c, g, or t
tcagctcgcgtgtccacgaccggtgctcgatttagtgacatctcgcagttctttggggcagttaggacccagagggaaccatggaaagcccagcgcagcttctcttcctcctgctactctggcctccagagacgaccggagagattgtattgacgcagtctccaaccacctgtctttgtctcgtgggggagacgccacctctcctagcgacgggccagtcagaattggtggccncctacgtctcctaggtaaccaacaagaaaccgtggaccacggcctaccgacggcccctacgtactacgtagtcggtgcctactaccgaaacgcgggtcctaacgtgaccactcccgagtcctaggtcaggtggacgtagggtcgggtagacgggactacggtacttccgaacttcccgtacctaaccgtacgtaccgtaacgtccgtaacggtcccggttaggacccgtccgtagggtaacgtaacgtttggtttactaacggttttacgtttaaccgttacgtaccgttaaccgtaaacgttccggttaccgtaaacccgggtttacgggtcccgggtaccccggggttacccccggggtttacgttaacccggttttaccccggggaaccccggtttacgggggtaaaaaccccgttaagggttaaccgggttaacctaacggtttaaacccggaaaacccgggttaatttcgggggtaacccgttaccgggtccgttaaacccgtaacccgttaaggtttccgttaccccggtttaacgttaccgtttacccgttacccccggtttacccgtacgttacggtttaacccgg

SEQ ID NO: 75876 - DNA, 693 bp, Homo sapiens
  misc_feature: GYAE6OF01A8BTY.8.39.D06.1.454.CMB.1.raw
  modified_base (139)..(139): a, c, t, g, unknown or other
  misc_feature (139)..(139): n is a, c, g, or t
tcagctcgcgtgtccacgaccggtgctcgatttagtgacatctcgcagttctttgggtttgggggaagaggagactgacggtcccccaggaggttcaggtgctcactcccaggtgcagctggtgcagtctgggctgagntgaagagtcctggggcctcagtgaagatttccctgcaaaggcgtccggatacgacggttcaccgccgtctatattaacttggctgcgacacggcccctggacaagggcctgagtggatggggagatcaaccgagtggaggtggtgcagagtacgcccagtaggtttcaggggcaggtacgtcttcccgaatcggacctagtcggacaccggtccgcgagaccacttcgtactagtatgggaagacgtaggaggagtcctggaagtaccttggaccgacgacggtccgtaattacgttacgtgttcgcgtaagaaacgtacggaaggtaagggtcggtaactaacgtagtaccgtaacggacgttacgtttttaggtaacggttttcgggggaacccgtaaaggggttaactaagttcgggttactaacggttccgttaccgttcccgttaccgaaccgtccctacccgttaacccgacggggtaccccctaacggttcccggttaccccctttaccccccggcggtccccctacccccggttccctaaccccgg

SEQ ID NO: 75877 - DNA, 566 bp, Homo sapiens
  misc_feature: GYAE6OF01C2U78.8.39.D06.1.454.CMB.1.raw
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (491)..(491): a, c, t, g, unknown or other
  misc_feature (491)..(491): n is a, c, g, or t
  modified_base (548)..(548): a, c, t, g, unknown or other
  misc_feature (548)..(548): n is a, c, g, or t
  modified_base (554)..(554): a, c, t, g, unknown or other
  misc_feature (554)..(554): n is a, c, g, or t
tcagctcgcgtgtccacgaccggtgctcgatttagtgacatctcgcagttctttgggttttgggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatagttaatggctgcgacaggcccctggacaagggcctgagtggatgggganatcgaacccgngtggaggtggtgcagagtacgccgagaggtttcaggggtccaggacgtctccaagtcgtaaccagtcgaccacgtccgcgagcactggtactatactggacgatggaggagccgtagagacttagacgacgacggccgtatattatgtgacgagaatcgaagaggtgctacatcacggagtcgtttagtaatttaggggacctaagggacgaagtcggtntaacgtcgtcctcgtccacgccctcacccgaggccctgtacccgtccttacccccgngtcccnccctcctacccg

SEQ ID NO: 75878 - DNA, 703 bp, Homo sapiens
  misc_feature: GYAE6OF01B8VT4.8.39.D06.1.454.CMB.1.raw
  modified_base (155)..(155): a, c, t, g, unknown or other
  misc_feature (155)..(155): n is a, c, g, or t
  modified_base (196)..(196): a, c, t, g, unknown or other
  misc_feature (196)..(196): n is a, c, g, or t
  modified_base (210)..(210): a, c, t, g, unknown or other
  misc_feature (210)..(210): n is a, c, g, or t
  modified_base (324)..(324): a, c, t, g, unknown or other
  misc_feature (324)..(324): n is a, c, g, or t
  modified_base (671)..(671): a, c, t, g, unknown or other
  misc_feature (671)..(671): n is a, c, g, or t
tcagctcgcgtgtccacgaccggtgctcgatttagtgacatctcgcagtttctttggggcagttaggacccagagggaaccatggaaagcccagcgcagcttctcttcctcctgctactctggctcccagagacgacggagagattgtatgacgnagtcctaccaacctaccctgttctttgtctccgtggggganacgccaccctctcngcgaggcagtagtaactttagtagttattagttagaccgtagtagtacgaactaaaaaccgtggacctaaggccctaccccgtacttcccttctttcgtttagggtacggtacncccgtaaggaaccgggtcctacgtccggaccaaccccgagaacgtaggatacggagtacggcgagggtcggtacgtacggggaactacgtacttacgaacttcctacaacctaagtaaccaacgtacgtactagaccacgtaccgtaggtaaacaatttacgtacgtaacgttaacgtttaactactaggtactaacgtacgtaaacgtttagtaccgttacccggtccggttacggtaacggttaccggaacggtaacggacgtaggtaccggaataacgtaaccgaacgtaacggtgtacacgtacgacctacctatcgtcgttactactacctccgttaccccntaacgtccgaagtaagaaccgtaggcgtacgg

SEQ ID NO: 75879 - DNA, 815 bp, Homo sapiens
  misc_feature: GYAE6OF01DP1BT.8.39.D06.1.454.CMB.1.raw
tcagctcgcgtgtccacgaccggtgctcgatttagtgacatctcgcagttctttgggggcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtggggcctcgagtgaagtatttcctgacaaggtccgtcggatacgtacggttcacccggccgttactattaatttaagttcgggacttggaccggaacgaccgggtcccccgttaggggaaccggaacggggtcccgttaggacgggttagggtaacggttacggggggaaacgaacgttaaccggaaaccccgggtagggtagggggtaacggggttgggtacggacgtaagggaccggtaaccggaaccccgtaaagggtttacggttacggacggtaacgaaggttaccgtaccgtacgtacgtaccggaacgaacggtaccgtaaccggtacccggtaccggacggtaccgtaaccgttaccggttacgtacgttaaggtcggtaagggaacgttaagggtacgggaacgggtaacccgtcgggttaacggtacggtttaccgtaacggacccgggtaaccggttaacccgggtacgtttaaaccgtttaggtaaccggtttgggaacggtaaccgggtaaaggtaaacggtaacgggtaaaagggttacgggtacgttaaacccgttaagaaccggttacggttaaacgggg

SEQ ID NO: 75880 - DNA, 718 bp, Homo sapiens
  misc_feature: GYAE6OF01CPN42.8.39.D06.1.454.CMB.1.raw
  modified_base (275)..(275): a, c, t, g, unknown or other
  misc_feature (275)..(275): n is a, c, g, or t
  modified_base (370)..(370): a, c, t, g, unknown or other
  misc_feature (370)..(370): n is a, c, g, or t
tcagctcgcgtgtccacgaccggtgctcgatttagtgacatctcgcagttctttggggttttggggggaagaggaagactgaccggtccccccaggagttcaggtgctcactcccaggtgcagctggtgcagtctggggctgagatgaagagtccgtggggcctcagtgaagtatttcctgcgaaggccgtccggatacgaggttcaccgccgtctattattaattggctgcgacgacggcccctggacgaagggcctaggagtggagtgggganaacgtcaaccggagtcggaggtggtgcgagacgtaccgccgagtaggttcgagggcagtcgtctaccagtcgaccagtacgacaccgtcgagacncactgtactagtagtaggagtatggaaggtacgcgtaggagtactacggtaacgaccgaacggtccgttaattacgttacgtaggttacggaacgtaagtaaacgtacggaaggtaagggtacggactaacgaacgtacggtaaggtacgtttacgtttaagggttaggtttacggggaacccgtaagggaacgtaaggttacggttacgaacgtttacccgttccgtacctccgtaaccggccccgttaacccggaacccggttaacccggggaccccttacggttcccccgggttccccctttacccccgtcgggtaccccccttaccccgtcccccgtaaaccgg

SEQ ID NO: 75881 - DNA, 678 bp, Homo sapiens
  misc_feature: GYAE6OF01A6LPY.8.39.D06.1.454.CMB.1.raw
  modified_base (274)..(274): a, c, t, g, unknown or other
  misc_feature (274)..(274): n is a, c, g, or t
tcagctcgcgtgtccacgaccggtgctcgatttagtgacatctcgcagttctttgggttttgggggaagaggaagactgacggtccccccaggagttcaggtgctcactcccaggtgcagctggtgcagtctggggctgagatgaagagtcctggggcctcagtgaagatttcctgacaaggcgtccggatacaggttcaccgccgtctatattaattggctgcgacgacggcccctagggacgtaacgggcctggaggtgggagtgggggaanaactacaacccggagtgggaggtggtgcgtaagacgtacgacccaggtaggtttcgaagggcacggaggtccttccgaatcgacctaaggtcgacgtaccgtccggacgaacgacctaccgtgtactaagtagtggagtatacggagagccgtagacggtacttaggcgaaccgacggtaccgtagttaattacgtgtgaccgtaagaaacgtacggaaaggaaggttacggactaacgaactacgaacgggtaggtacttttaagggtacggttttcggggaaccgtaaacggacgtaagtcggtactagtcggttcctcctacgaccggtcctaccaacccggaacggcccctaagtacccgggtttccctaccccgtggtcccctaccccttcgtaacccg

SEQ ID NO: 75882 - DNA, 831 bp, Homo sapiens
  misc_feature: GYAE6OF01D4JQ5.8.39.D06.1.454.CMB.1.raw
tcagctcgcgtgtccacgaccggtgctcgatttagtgacatctcgcagttcgtttgggttttgggggaagaggaagactgacggtccccccaggagttcaggtgctcacctcccaggtgcagctggtgcagtcgtgggctgagatagaagacgtccgtgggccctcagtgaagtacttttccgtgacgaaaggccgttaccggaataccgtacggtttccgacccgtccgtcttaatattaaagttggcctgcgaaccgaccggtccccgtaggaaccgaacggggtcctaggacggtagggaagttagggggaacgtaaacgtaccccgaaacccggtaggtaggggtaaggtgggtacgaccgaagtacggtaccgtacccgaggtagggtttcgacggcgaaggtacgtcctcgaacgtacgaccgagtaccgacacgtccgcgacgcctaacgttgtactagtatagggtatttacggacacgtccgagacgtacgtcgacggaaccggtaccgtccggtacccgttaggttaacttaggtacgggtacggtacgggtaaggtagttacgggtttagttacggtgggtacgggtacgggttaacccgggtaccgggttaaacgtcggttaaccgtacggggtacggggaacccggtaagggttacccgttcccgggttacgttccccggtaacccggtttcccgtacccggtccgtacccaccccgttaacccggacccgggtaacgcccccgttagttcccccgttcccccgttaccccggtcccggtcccggtaccccttccggtcccgtaaccgggtaccccgg

SEQ ID NO: 75883 - DNA, 698 bp, Homo sapiens
  misc_feature: GYAE6OF01BV2XE.8.39.D06.1.454.CMB.1.raw
  modified_base (264)..(264): a, c, t, g, unknown or other
  misc_feature (264)..(264): n is a, c, g, or t
tcagctcgcgtgtccacgaccggtgctcgatttagtgacatctcgcagttctttgggtttgggggaagaggaagactgacggtccccccaggagttcaggtgctcactcccaggtgcagctggtgcagtctggggctgagatgaagagtcctggggacctaagtgaagattttcctgacaaggcgtccggataccaggtcaccgcgtctaatattaatggactgcgacacggcccctgggacaagggcctgagtggatgggganatacaaccgagtggaggtgtgactagacgtacgcccgaaggtaggtttcgaagggcaggaagtccgtaccgatacggaccagtacgactaacggtccgcgagactatcgtatactagtaggacgatacggaaggcgtccgtagacgtaccgttagacgacgtacggtaccgtaattacgtaacttggtagtaccgaagtaaacgtagaaaggaacgggttaggaccgttaacaacgtcgtaaacggtcggttacgttttaaggtaaacggttttacggggaaccgtaacggggtacttaaagtacggtactacgttacgtaccttaccgtaccgaaccgtcccgttaccgaacccgtaaaccgggtccccgtacgttcccggtacccgttccccccgtaggtacccctaccccgtaccctacccggtaaaccgg

SEQ ID NO: 75884 - DNA, 690 bp, Homo sapiens
  misc_feature: GYAE6OF01CEWJ0.8.39.D06.1.454.CMB.1.raw
  modified_base (209)..(209): a, c, t, g, unknown or other
  misc_feature (209)..(209): n is a, c, g, or t
  modified_base (355)..(355): a, c, t, g, unknown or other
  misc_feature (355)..(355): n is a, c, g, or t
tcagctcgcgtgtccacgaccggtgctcgatttagtgacatctcgcagttctttggggggagaagagctgctcagttaggacccagagggaaccatggaaagcccagcgcagcttctcttcctcctgctactctggctcccagagacgaccggagagattgtattgacgcagtctccaaccaccctgttctttgtctccgtgggggganacgccaccctctcctgcgagggccagtcgtaaccttttagagttagttatttagcctggtactcggacaaaaccgtgccaggcctccccgactcctcttcgtttggtggacgcctacgcggccacgtcggccacccagacgagacngagtgcaggtcggtcgtagggacacgtacttcgacttcgactaccgactacaaacacgactcgacgacgaccgtagaagtattatacggtacttaacggtttactacgttcgtacgaacgtcgtaaggttacgttaccggttttaccccggttacccggttacgggttacccgggttacccgggtaaccggtaaacccgggggtacccgtaaaggggttccggtaaactaccggtaacccgaaaccggtacgttacgggcggtaccgtaccggtactaaacctcgttccgttacgttacttacccttaccgttaccctcccgtctccgttaccgg

SEQ ID NO: 75885 - DNA, 633 bp, Homo sapiens
  misc_feature: GYAE6OF01BGKW7.8.39.D06.1.454.CMB.1.raw
  modified_base (265)..(265): a, c, t, g, unknown or other
  misc_feature (265)..(265): n is a, c, g, or t
  modified_base (311)..(311): a, c, t, g, unknown or other
  misc_feature (311)..(311): n is a, c, g, or t
  modified_base (344)..(344): a, c, t, g, unknown or other
  misc_feature (344)..(344): n is a, c, g, or t
  modified_base (481)..(481): a, c, t, g, unknown or other
  misc_feature (481)..(481): n is a, c, g, or t
tcagctcgcgtgtccacgaccggtgctcgatttagtgacatctcgcagttctttgggttttggggggaagaggaagactgacggtcccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacacggcccctggacaacgggcctggagtggagtggggganaatcaacccgagtggaggtggtgcagagtacgcccgagtaggttcngggcagagtctcatgaccagtgacgacgtccgngacgcactgtactatacgtggacgagtaggacggagcgtagacgtacttggaaccgaccgaacggccgttaatagttacgtgtggtacgaagaacgtacggaaaggacgggtacggactaacaacgtacgaacggtnttacgttttagtaaggtttcggggacgtaagggtactaagttcggtacgtacgtcgtaccttccgtactacggccctacccgtaaccggaccgggaccctacgttcccggttcccttcccccggtagccccgtacccctcccgtaaccccgg

SEQ ID NO: 75886 - DNA, 825 bp, Homo sapiens
  misc_feature: GYAE6OF01C0CDU.8.39.D06.1.454.CMB.1.raw
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
  modified_base (270)..(270): a, c, t, g, unknown or other
  misc_feature (270)..(270): n is a, c, g, or t
tcagctcgcgtgtccacgaccggtgctcgatttagtgacatctcgcagttctttggggttttggggggaagaggaagactgacggtccccccaggagttcaggtgctcacctcccaggtgcagctggtgcagtcgtggggctgagatgaagagtccgtggggcctcgagtgaagtactttcctgacgaaggcgtcggatacgaggttcaccgccgtntatattagtgctgcgacncggccctaggacgaggcctggagtggagtgggganaacgtaccgaacccggaggtgggaggtggtgacgaaggacggtaccgacccgtaggtacggtttacggagggacaggtcgtcctaccgaagtacggaaccgtaggtaccgaccgtaccggtaccggacggtacgaccacgttcgtaacgttaagttacggtaggaacgagtagggaacggacggtcccgtaggtaacgtacgttacggaacccggtacgggtaaccggtaccgttaacgttaagtttaccggtagggtacggtacgtaaacggtaacggtaacgggtaaagggtaaggttaccgggtaacctaacgtaaccgttacggtaacggtagtttacgttttaagggtaacggtttaccggggaaccgtaagggtacgtaacgggttacggtaccgtacgttccccgttaccgttacccgtaccgtaaccccggtacccgtaaccccggaaacccgggtaaccccgggttacccctaaccggggttaccccccgttacccccgttaccccccggtacccggtccccctaccccgtacccccgtaacccgg

SEQ ID NO: 75887 - DNA, 726 bp, Homo sapiens
  misc_feature: GYAE6OF01D00ET.8.39.D06.1.454.CMB.1.raw
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
  modified_base (359)..(359): a, c, t, g, unknown or other
  misc_feature (359)..(359): n is a, c, g, or t
tcagctcgcgtgtccacgaccggtgctcgatttagtgacatctcgcagttctttgggttttgggggaagaggaagactgacggtccccccaggagttcaggtgctcactcccaggtgcagctggtgcagtcgtggggctgagatgaagagtccgtggggcctcgagtgaagatttccngcaaggcgtcggatacgnggttcaccgccgtactatattaagtggctgcgacacggcccctaggacgaagggcctggagtggagtgggganaatccaacccggagtgggaggtggngagagacgtaccgccgagaggtttcgagggcagagtctccagtcgaccagtagacgacggtccgngacgcacgtgtctagtagtgagagaggaggagcctaggagacgttaggaacgacgaccggaccgttaagtacgttaacgtggtacgtacggaagaaagtacggaaaggtaagggtacgacgtaacgtaacgtacgaacgggtaagttacgttttaaggttaacggttttacggggtaaccggtaagggaaaccgttaaagttcgggttaccgtacgttccggttaccgttccctaccggtacccgtaccccgttaacccaaaccccgggtaacccggggtaaccccttaccggttacccccgggttacccctttaccccccggttaccccggtaccccgtaacccccgtccccggttaaaacccccg

SEQ ID NO: 75888 - DNA, 703 bp, Homo sapiens
  misc_feature: GYAE6OF01BJCET.8.39.D06.1.454.CMB.1.raw
  modified_base (381)..(381): a, c, t, g, unknown or other
  misc_feature (381)..(381): n is a, c, g, or t
tcagctcgcgtgtccacgaccggtgctcgatttagtgacatctcgcagttctttgggggcatcatccaacaaccacatcccttctctacagaagcctctgagaggaaagttcctcaccatggactggacctggagggtcttctgcttgctggctgtagttccaggtgctcactcccgaggtgcagtcgtggtagctaggtcgtggggctagagagtaggaaggtacggtccggtcggggtcctacgtaggtagtaaacgttctttccgagacggaacggtccggtaccggaataccgtacggttaccgaccgtccgttactaattagtttagtcggactcggaccgacgccggtacccgaggaacgtacgggtcgtacggnggtggagggtagggaacaacgtacccgaaccggtggtacgggtagggtgtacgacggaggtaccggtaccggaccggtaggttacggttacggacgggtacaggtaccgtccgtacggtacgtacgaccggtagtacggaacccgtacgggtacccgacgacgtaccgtacgtacgttacgtagtagggtacggaagtggtaacggacgtacggtccgtaggtacgtacgtaccgggactacggtaccgtacgttatacgtacggtcgaggtagtaggaacgtaacgggaaggtacgtagacgttaacacggtcggtaacgg

SEQ ID NO: 75889 - DNA, 934 bp, Homo sapiens
  misc_feature: GYAE6OF01D90C3.8.39.D06.1.454.CMB.1.raw
  modified_base (191)..(191): a, c, t, g, unknown or other
  misc_feature (191)..(191): n is a, c, g, or t
tcagctcgcgtgtccacgaccggtgctcgatttagtgacatctcgcagttcgtttggggtttgggggaagaggaagactgaccggtccccccaggagttcgaggtgctcacctcccgaggtgcagcgtggtgctagtcgtgggctggagagtagaagtcgtccgtcgggcctcagtagaacgtctttccgngacgaaggtccgtaccggtactaaccgtacggttccgacccgtccggttacttaagttaagtttaagtcggtgtacggaccgaccgtacccggacccgtaggaaccggaacggtccgtaggtaggtgggagggtaggggaactaacgtaccgaaccggtggtagggtaggtggtacgacgaacggtaccggtaccgaccgtaggtacggtttacggacgggacgtaggtacgtcgtacgtaagtaccgtaccgtaggtaccgtacccggtaccgggtaccgaccgaccgacgttacgtacgttaccgttagtacggtaggagtacggtacggtaggtacgtaccgtaggacggtacggttaacggaacccgggtaacgtaaccggttaccgtttaacgttaaccggtttacggaacgttaacgggtaacggtaaacggtaacgggtaaacggtaacgggtaacgggtaaccggtaaacctaacgtaaaccgggtttcggtaaacggtttaccggttttacgggtttaacgggttaaacgggttaccggggaaaccgttaaccgggtaacgttaacggtaccggtttacgtaaccggtttccgttaacccccgttccgttaacccggacccttaccccggtaacccggaacccgggttcccgaacccgttcccgggttaccccccgtttacccccgttcccgggtaacccccgttaacccgtccccccgttccggaaaccccgg

SEQ ID NO: 75890 - DNA, 693 bp, Homo sapiens
  misc_feature: GYAE6OF01B1BFS.8.39.D06.1.454.CMB.1.raw
  modified_base (89)..(89): a, c, t, g, unknown or other
  misc_feature (89)..(89): n is a, c, g, or t
  modified_base (165)..(165): a, c, t, g, unknown or other
  misc_feature (165)..(165): n is a, c, g, or t
  modified_base (168)..(168): a, c, t, g, unknown or other
  misc_feature (168)..(168): n is a, c, g, or t
  modified_base (188)..(188): a, c, t, g, unknown or other
  misc_feature (188)..(188): n is a, c, g, or t
  modified_base (269)..(269): a, c, t, g, unknown or other
  misc_feature (269)..(269): n is a, c, g, or t
  modified_base (364)..(364): a, c, t, g, unknown or other
  misc_feature (364)..(364): n is a, c, g, or t
  modified_base (521)..(521): a, c, t, g, unknown or other
  misc_feature (521)..(521): n is a, c, g, or t
tcagctcgcgtgtccacgaccggtgctcgatttagtgacatctcgcagttctttggggcatcatccaacaaccacatcccttctctacngaagcctctgagaggaaagttcctcaccatggactggacctggagggtcttctgcttgctggctgtagttccagtnctnactcccaggtgcagctggtncagtctggggctgagatgaagagtcctaggggccctacagtacgaagtactttcctggcgaaggccggtccggaactacgnggttaccaccggaccgttcctattaactttaatttggactggacgacgacggccccgtggacgaagggtccctaggaggttggagtcggggaaanacgttaccgaacccggtagtgggtaacgggtggtgacgaacgacggttaacgcccgaggtacggtttccgaagggtccaggagtcctacccgtagacgaccaggtacgacgtaccgtccggacgtacgcctacggtcgtagtacgtactcggtaagngtcggtaaggccgtcgttaacggacgttaacgttgaaccggtacgtaacccggggtacgttacgttaaacgtttaccggttacggttacgaacccgggtaagtaaaccgggttaccgaaacgggtaacgggttaggtacccgtaaacttaaaccggtacggttaaaccgggg

SEQ ID NO: 75891 - DNA, 759 bp, Homo sapiens
  misc_feature: GYAE6OF01AX0PM.8.39.D06.1.454.CMB.1.raw
  modified_base (197)..(197): a, c, t, g, unknown or other
  misc_feature (197)..(197): n is a, c, g, or t
  modified_base (381)..(381): a, c, t, g, unknown or other
  misc_feature (381)..(381): n is a, c, g, or t
tcagctcgcgtgtccacgaccggtgctcgatttagtgacatctcgcagttctttgggggcagttaggacccagagggaaccatggaaagcccagcgcagcttctcttcctcctgctactctggctcccagagacgaccggagagattgtattgacgcagtctccaaccaccctgtctttcgtcgtccgtgggggganacgcccgaccctctcctcgcacgggctagtcgtaaccgttttagtagttagttagtttacgcgtggttacgtcggtaacaaaaaccgtcggaccaggccttccccgacgtcctacgtttctttggtacggtacgcctacgacggcctacgtcggaccacccgagacgagtacgtcgacgtggcnggtaccgggtgtacgggactacggtaaccttcctaacgttccgtacctaacgaactacccgaacgtaacgtaccgtagaccgaacgtacccgtagaaacgttattacgtcgtcgttaagttttacccgtaagttcgtactcggactaaaggttcgttaccggttaaccggttccccggttaagggtcccggttacggaacccggtaaggaccggtaaggttccggaacttaaccggtaaccggtaaacccgtcgttaggtaccgcgtaactacccggtaactacgttacgttccgttaccttaggaccctttcccggttacccgaccgtttacaccggtttaacgggaaccgtaacccgtcccgggaagtacccgggg

SEQ ID NO: 75892 - DNA, 1053 bp, Homo sapiens
  misc_feature: GYAE6OF01C49GJ.8.39.D06.1.454.CMB.1.raw
  modified_base (139)..(139): a, c, t, g, unknown or other
  misc_feature (139)..(139): n is a, c, g, or t
  modified_base (181)..(181): a, c, t, g, unknown or other
  misc_feature (181)..(181): n is a, c, g, or t
tcagctcgcgtgtccacgaccggtgctcgatttagtgacatctcgcagttcgtttgggttttgggggaagaggaagactgaccggtccccccaggagttcaggtgctcactcccaggtgcagctggtgcagtcgtgggntgagatgaagagtccgtgggcctcgagtagaagtactttcgngacgaaggcgtacggatacgtaggttccacccgtcgttactaattagttaagttcggcgttaggaccgaccgaaccggtcccccgtagggaaaccgtaacggggtcccgttaggaaggtgggtaacggtagggggaacgtaaacgtacccgaacccggtaggtgggtaaggtggtacgtacgaaggtacgtaccgtacccgtagggtacggtttacggaacgggtaccgtaaggtacggttacccgtaccgtaacggtaccgtaaccgtaacggtaccggtaacccgtaacccggttcccggaccggtaaaccgtccgttaaccggttacggtttaaaccggttaacggttaagggtaacgggtaaaccggtaaggttaacgggtaacggggtaccgtaacccggttaacgggtaaccggttaaaccggtttaacccgggaacccgggttaaccgggtaacccggggtttaccggtttaaaccggtttaacgttttaaccggttacggggttaccgggtaaacggtaaaacggtaaaccgggtaaaccgggttaaaggggtaaaccgggttacgggttaaacccgtaaacggttaaaccggttacggtaaccggggttaacgttttaccgggttttaagggtttaaccggggtttaacggggtaacccgggtaaagggttaaccgttaacgggttacggttacgggtacctttacccgggttccttacccgtacggttaacccgtaccccggttaaacccgacccgggttaaacccggaccccgttaacccgggtttcccccggtttaacccccgttacccccggtttacccgggacccccgttaccccggtaaccccgttaaaaccccggg

SEQ ID NO: 75893 - DNA, 534 bp, Homo sapiens
  misc_feature: GYAE6OF02IH9GV.8.39.D06.1.454.CMB.1.raw
tcagctcgcgtgtccacgaccggtgctcgatttagtgacatctcgcagttctttgggtttgggggaagaggaagactgacggtcccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaaggggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagctttgaattttgggccaagggacaatggtacagtcgtctcctcacgcctccaccaacgggcccacgtcggtccttcccccgtcggccacccctccctacccg

SEQ ID NO: 75894 - DNA, 571 bp, Homo sapiens
  misc_feature: GYAE6OF02HRQXD.8.39.D06.1.454.CMB.1.raw
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgctagtttactactgtcagtcagtatgttaccgtcccgtggacgtttccggacgaagggaccaagggtcggacaacgtaccgaaaccgaacttggtacggctaggaccgaccagttcctaggtcctttccgacttcccttccccggcctacgttcctagtacgaccaccggcgtaacgg

SEQ ID NO: 75895 - DNA, 540 bp, Homo sapiens
  misc_feature: GYAE6OF02GGYFT.8.39.D06.1.454.CMB.1.raw
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtgactacaatcacggagtcttttgtaagttttggggacctaagggactaagtggtactagtcgtctcctcagtcctccaccaacgggcccagtcgtccttccccctgcctaccctcctacccg

SEQ ID NO: 75896 - DNA, 550 bp, Homo sapiens
  misc_feature: GYAE6OF02F39M9.8.39.D06.1.454.CMB.1.raw
  modified_base (358)..(358): a, c, t, g, unknown or other
  misc_feature (358)..(358): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatgganatgaggagcctgagactgacgacacggccgtatattactgtgcgagaaatcgaaagaaggtggactacaatcaacggagcttttagaagtttttggggcctaaagggacaagtcggtacatcgtctcctctagccctccaccaacgggcccaagttccggtccttcccccgtcggcctacccctccctaccg

SEQ ID NO: 75897 - DNA, 566 bp, Homo sapiens
  misc_feature: GYAE6OF02HX38G.8.39.D06.1.454.CMB.1.raw
  modified_base (208)..(208): a, c, t, g, unknown or other
  misc_feature (208)..(208): n is a, c, g, or t
tcagctcgcgtgtccacgaccggtgctcgatttagtgacatctcgcagttctttggggggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagcccaccctctcctgcagggccagtgaaccttttagagtagttatttagcctggtatcggacaaaacctggccaggctcccgactcctcttcttggtgagcctacacgggccacgtggccaccccagacaggatcaggtcggcaggcgggtctgggacaggacttcattcacaccatacaaccagactcgacagcctagaacgtatatgctacgtttactactgtacagctagtattcgttacgttcccgtggtaccgttcgggaccgtaaacgggaccaagggtcgaacaacgtacgaaaccgactagtggctcggccaactactctcgtcttctacttccttcccgcctataccg

SEQ ID NO: 75898 - DNA, 534 bp, Homo sapiens
  misc_feature: GYAE6OF02HUC8T.8.39.D06.1.454.CMB.1.raw
  modified_base (259)..(259): a, c, t, g, unknown or other
  misc_feature (259)..(259): n is a, c, g, or t
  modified_base (364)..(364): a, c, t, g, unknown or other
  misc_feature (364)..(364): n is a, c, g, or t
tcagctcgcgtgtccacgaccggtgctcgatttagtgacatctcgcagttctttgggttttgggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaatggctgcgacaggcccctggacaagggcctgagtggatgggganaatcaacccgagtggaggtggtgcagagtacgcccagaggtttcagggcagagtctccatgaccagtgacacgtccgcgagcactgtctatatggagatgaggancctgagacttgacgacacggcgtatattactgtgcgagaatcgaagaagtggctacaatcacggagctttgaattttgggaccgaagggacaagtggtcatcgtctcctctacgcctccaccaacggacccaactcggtaccttcccccgtcggcctaccctcctacccg

SEQ ID NO: 75899 - DNA, 562 bp, Homo sapiens
  misc_feature: GYAE6OF02F0EIW.8.39.D06.1.454.CMB.1.raw
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttcttggtggagcctacagggccactggcaccccagacaggatcagtggcaggcgggtctgggacagacttcattctcaccatcaacagactgcagcctagaagatattgactagtttactactgtcagctagtatacgttaccgtcccgtggtaccgttcggaccgaagggaccgaaggtcggacaacgtccgaaaccgacttggtacggctgacctaccattcgtgttccttctacttcccttcccgacctacttccgtagacgacgacgcgtacg

SEQ ID NO: 75900 - DNA, 574 bp, Homo sapiens
  misc_feature: GYAE6OF02GPGFX.8.39.D06.1.454.CMB.1.raw
  modified_base (193)..(193): a, c, t, g, unknown or other
  misc_feature (193)..(193): n is a, c, g, or t
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctgggggganagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgctagtttacactgtcagcagtatgttacgtccccgtggtaccgttcggacctaagggacccaagggtcggactaacgtaccgaaaccggaacttggtcggacttgacctaaccagttacctcggttcctttaccacgttcccttaccccgccattcctacgacggtactaccggcgtaacg

SEQ ID NO: 75901 - DNA, 548 bp, Homo sapiens
  misc_feature: GYAE6OF02JLI8F.8.39.D06.1.454.CMB.1.raw
tcagctcgcgtgtccacgaccggtgctcgatttagtgacatctcgcagttctttgggggcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcgagtgaagatttcctgcaaggcgtccggatacaggttcaccgccgtctatattaattggctgcgacaggcccctggacaagggcctgagtggatggggagaagtcgaacccgagtggaggtggtgacgagagtacgcccgagaggtttcgagggcagagtctccgatgaccagtgacacgtcgcgagcactgtctatgtggagtagtgaggagccgtagacgtacttaggacgaccgaaccggaccgttagttacgtaacgttggtcggacggagaagttacggaaaggtaaggtagggtaccgtaacgtaatacgtaacggg

SEQ ID NO: 75902 - DNA, 534 bp, Homo sapiens
  misc_feature: GYAE6OF02G8I5H.8.39.D06.1.454.CMB.1.raw
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctcccagactcctcatctttggcgcctttaacagggccagtggaatcccagccaggttcagcggcagtgggtctgggacttcgtcactctcacatcaataactgcaatctgacgactttgctagtttatttctgtcagcagtctagaagactggccttcacgtttcggcggagggaccagggtcgacctacgaaacgactgtgctgacacatctgtcttcacttccttcccgctacttcgtcgacgacacggcgtacgctacgg

SEQ ID NO: 75903 - DNA, 495 bp, Homo sapiens
  misc_feature: GYAE6OF02FSTNK.8.39.D06.1.454.CMB.1.raw
tcagctcgcgtgtccacgaccggtgctcgatttagtgacatctcgcagttctttgggggcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagagtgaggagctgagacttgacgacacggccgtatattactgtgcgagaatcgaagaggtggactacatcaacgg

SEQ ID NO: 75904 - DNA, 823 bp, Homo sapiens
  misc_feature: GYAE6OF02JYYX9.8.39.D06.1.454.CMB.1.raw
  modified_base (134)..(134): a, c, t, g, unknown or other
  misc_feature (134)..(134): n is a, c, g, or t
tcagctcgcgtgtccacgaccggtgctcgatttagtgacatctcgcagttctttgggttttggggggtaagagggaagactgacggtcccccaggagttcaggtgctcactcccaggtgcagctggtgcagtcnggggctgagatgaagagtcctggggcctcgagtgaagatttcctgcaaggcgtccggatacaggttcaccgccgttactataattaattggactgcgacacggcccctggacaagggcctgaggtggaacgttgggggaagaaacgtccgaaacccggtaggtacggggtaaaggggttcgggttaggaccggaaggtaacggttaaccggacccccggtaaagggttaacggggttttttacgaacggggggtccaagggtacggttacctaccgaagttacggaacccgaaaggttcggaaaccgtaccggtccggacggaacgccaacgttcgttcctaaagttacgtggaaggtacttggaagtacggtccctaggacggtacgttacgaaccgacgtaaccgggtaccgttaacgtaacgtttaacgtacggttacggacggtaaacggtaaacgtaacgaaacgggtaagggttacggtaccgtaaacgtaaacgttacgaacgggtaacggttacgttttaaggtaacgttttacggggaacgtaaacgggtaacgtaaaggttcggttaacgaacgttacggtaccttccgtgtaccgacccgttaccgaaccgtaaccggtccctaacgttcccggttacccgttacccccggttcgacccgtacccctccgtaacccgg

SEQ ID NO: 75905 - DNA, 556 bp, Homo sapiens
  misc_feature: GYAE6OF02HSNU3.8.39.D06.1.454.CMB.1.raw
tcagctcgcgtgtccacgaccggtgctcgatttagtgacatctcgcagttctttgggttttggggggaagaggaagactgacggtccccccaggagttcaggtgctcactcccaggtgcagctggtgcagtccctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgccagaggtttcagggcagagtctccatgaccagtgacacgtccgcgagcactgtctatatggagatgaggagcctgagacttgacgacacggccgtatattactgtgcgagatacgaagaaggtggactacaatcacggagtcttttagtaagttttgggaccgtaaagggactaagtgggtacaattcgtctccttcacgcctaccaaccaacggccccaagtccggttccttcccccgtggccctacccgtcctacccg

SEQ ID NO: 75906 - DNA, 600 bp, Homo sapiens
  misc_feature: GYAE6OF02GNIWY.8.39.D06.1.454.CMB.1.raw
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctgggggagagccaccctctcctgcagggccagtgaaccttttagtagtagttatttagcctggtatcggcaaaaacctggccaggctcccgactcctcttcttggtgagcctacagggccactcggcaccccagacaggatcagtggcaggcgggtctgggacagacttcattctcaccatcaacagactgacagcctagaatatatcgactacgtttactactgtacagtacagttatcgttaccgtcccggtaggtaccgttcgggaccgaacggaccgtaaggtcggaactaacgtccgaaacccgtaacgttggtacggtctacggccaaccgtacttcgttacgttctttacctacctttccgttaccccgaccttacttccggtagtaacgacccgtacgggtcgtacgg

SEQ ID NO: 75907 - DNA, 542 bp, Homo sapiens
  misc_feature: GYAE6OF02F3AGL.8.39.D06.1.454.CMB.1.raw
tcagctcgcgtgtccacgaccggtgctcgatttagtgacatctcgcagttctttgggttttgggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatatactgtgcgagaatcgaagaaggtggctacaatcacggagtcttttgaagttttggggacctaagggacaagtggtcatcgtctcctcacgccctccaccgaacgggcccagtccggtccttcccccgtggcccaccccgtcctaacccg

SEQ ID NO: 75908 - DNA, 562 bp, Homo sapiens
  misc_feature: GYAE6OF02I8XVC.8.39.D06.1.454.CMB.1.raw
  modified_base (261)..(261): a, c, t, g, unknown or other
  misc_feature (261)..(261): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatgggganaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagatacgaagaaggtggactacaatcacggtagcttttgaagttttggggacctaaggggacctaagtggtactaagtcgtctcctcacgtccctaccgaccgaacgggtcccacgttcccggtccttcccccgtcggccctaccccttccctaacccg

SEQ ID NO: 75909 - DNA, 560 bp, Homo sapiens
  misc_feature: GYAE6OF02I837Z.8.39.D06.1.454.CMB.1.raw
  modified_base (261)..(261): a, c, t, g, unknown or other
  misc_feature (261)..(261): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatgggganaatcaacccgagtggaggtggtgcagagtacgcccagaggtttcagggcagagtctccatgaccagtgacacgtccgcgagcactgtctatatggagatggaggagcctgagacttgacgacacggccgtatattactgtgcgagaatacgaagaaggtggactacaatcacggagtcttttaggtaagttttggggaccgaagggacaagttggtctaagtcgtctcctcacgcctaccaccgaacgggcccacgtccggttccgttcccccgtcggccctaccccgtccctaacccg

SEQ ID NO: 75910 - DNA, 614 bp, Homo sapiens
  misc_feature: GYAE6OF02HQ13V.8.39.D06.1.454.CMB.1.raw
  modified_base (367)..(367): a, c, t, g, unknown or other
  misc_feature (367)..(367): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaaggcctgagtggatggggagaatcaacccgagtggaggtggtgcagagtacgcccagaggtttcagggcagagtctccatgaccagtgacacgtccgcgagcactgtctatagtggagatgaagganccgtagagcgttacgacgaacgaccggaccgttaataacttaacgtgtgacggtaagaagtacggaaagaagggtaggctaacgaatacgacggagtacgttttaggtaagtttttcggggaccgtaaacggggtaactaaagtgggtacgattcgttcctcctacgtaccgcctacccaaccggaacgggtaccctacgtaccggttcccttcccccgtcggtacccctacccgtccctaacccgg

SEQ ID NO: 75911 - DNA, 655 bp, Homo sapiens
  misc_feature: GYAE6OF02JLTTA.8.39.D06.1.454.CMB.1.raw
  modified_base (252)..(252): a, c, t, g, unknown or other
  misc_feature (252)..(252): n is a, c, g, or t
  modified_base (349)..(349): a, c, t, g, unknown or other
  misc_feature (349)..(349): n is a, c, g, or t
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagctcgcgtgtccacgaccggtgctcgatttagtgacatctcgcagttctttgggggcatcatccaacaaccacatcccttctctacagaagcctctgagaggaaagttcctcaccatggactggacctggagggtcttctgcttgctggctgtagttccaggtgctcacctcccgaggtgcagcgtggtgcagtcgtggggctgagagtgaagacgtccgtggggcctcgagtaggaagtactttccgngacgaacggcggtaccggaatacgaggttccaccggtccgtactataattaagtggtctgacgacaccggccctaggacgaggcctgagtaggaggnggggaanaactcgaaccgtaggngggaggngtagngaggagtaccggacgaggtaggttacgagggcgtacggagtctacgacgtacgaacgtaggacgaacggtccgtacgggccgtaacggtctaacttggtaactagttacgtaggacgtaggtgaacggagtaccgtaaggacggtaccgtaggaacggtaaccggaccggtacttacgttaagtttacccgtaggtaccggaaggtaaacggaacgtttaacgggaacgggttaacgggacggttaaccaaccgtaacgtagttaaccggg

SEQ ID NO: 75912 - DNA, 551 bp, Homo sapiens
  misc_feature: GYAE6OF02GK4BF.8.39.D06.1.454.CMB.1.raw
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcgacggagtcgttttagagttttgggaccaagggactaagtggtcagtcgtctcctcacgtcctaccaccgaacggccctacgtccggtcccttccccgtcggtccctacccctccctaacccg

SEQ ID NO: 75913 - DNA, 532 bp, Homo sapiens
  misc_feature: GYAE6OF02IZQ1W.8.39.D06.1.454.CMB.1.raw
  modified_base (293)..(293): a, c, t, g, unknown or other
  misc_feature (293)..(293): n is a, c, g, or t
  modified_base (488)..(488): a, c, t, g, unknown or other
  misc_feature (488)..(488): n is a, c, g, or t
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
  modified_base (517)..(517): a, c, t, g, unknown or other
  misc_feature (517)..(517): n is a, c, g, or t
  modified_base (527)..(527): a, c, t, g, unknown or other
  misc_feature (527)..(527): n is a, c, g, or t
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaactggcagctcccgatcctctcttgtgagcctanagggccactggcaccccgagacaggactcagtggcagcgggtctgggacagacttcattctcaaccatcaacagactgcagcctagaagatgttagactaagtttacacgtgtcagctagtactgttaccgtcccgtggtacgttgccgaaagggaccaaggtgacaatacgaaaccgacgtgtgctagcctaanatctgtcttacatcctcccgnttcncganacacggcggntacgg

SEQ ID NO: 75914 - DNA, 546 bp, Homo sapiens
  misc_feature: GYAE6OF02HKRBW.8.39.D06.1.454.CMB.1.raw
  modified_base (382)..(382): a, c, t, g, unknown or other
  misc_feature (382)..(382): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacganacggcgtatattactgtgcgagaatacgaagaaggtggctacaatcacggagctttgaagttttgggctaagggactaagtggtcagtcgtctacctcacgtcctaccaccgaacggtcccacgttccggtccttcccccgtcggtacccacccgtcctacccg

SEQ ID NO: 75915 - DNA, 757 bp, Homo sapiens
  misc_feature: GYAE6OF02IPCQ4.8.39.D06.1.454.CMB.1.raw
  modified_base (262)..(262): a, c, t, g, unknown or other
  misc_feature (262)..(262): n is a, c, g, or t
tcagctcgcgtgtccacgaccggtgctcgatttagtgacatctcgcagttctttgggttttgggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaagttggctgcgacaggcccctggacaagggcctgagtggagtgggganaatcaaccgaggtggaggtgtgcagagtacgccgagtaggtttacgagggcaggacgtcgtaccatcgaccgagacgacgtaccggtccgtcggagccacgtcgtctaatagtaggagacgtggaaggagaccgtggaacgtacgttagaaccggaacgacggaccgttaaagtactttaacgtaggttgaccgtaagtaaacgtacggaaaggtaacgggtaggtaacctaacgaagttaaccggaacggtaacggttacgtttttaggttaaaccggttttcggggaaccgttaaaggggaccgtaaagttacgggttacgaacgtttaccgttaaccgttccgttaaccgaccggtaccccgttaaccccggtaacccggtaaaacccggggtacccgttaacccgggttaccccgggtttaccccccggtttttacccccggtacccgggttaccccccgttaaccccccgtttacccccgtaacccccgg

SEQ ID NO: 75916 - DNA, 575 bp, Homo sapiens
  misc_feature: GYAE6OF02IW727.8.39.D06.1.454.CMB.1.raw
  modified_base (259)..(259): a, c, t, g, unknown or other
  misc_feature (259)..(259): n is a, c, g, or t
  modified_base (552)..(552): a, c, t, g, unknown or other
  misc_feature (552)..(552): n is a, c, g, or t
tcagctcgcgtgtccacgaccggtgctcgatttagtgacatctcgcagttctttgggtttgggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatgggganaatcaacccgagtggaggtggtgcagagtacgcccagaggtttcagggcagagtctccatgaccagtgacacgtccgcgagcactgtctatatggagatggaggagcctagacgacttgacgacgacggccgtatattacgtgtgcgagaatccgaagtaaggtggactacgaatcgaacggtagtacgtttagtaagttttcggggaccgtaaagggtactaacgtggtactaagtcgtctccgtactacggtcctaccaaccgaacggcccacgttccggtccttccccgnggaccctacccgtcctaacccgg

SEQ ID NO: 75917 - DNA, 601 bp, Homo sapiens
  misc_feature: GYAE6OF02JXR5J.8.39.D06.1.454.CMB.1.raw
  modified_base (194)..(194): a, c, t, g, unknown or other
  misc_feature (194)..(194): n is a, c, g, or t
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgtaaccttttagtagtagttatttagcctggtatcggacaaaaacctggccaggcctccccgactcctcttcgtttggtcggacgcctacgacgggccaacgtcggcccaccccgagaccaggactcgaggtcggcacggcggggtcgtagggacaggacttcattccacaccataccaaacacgactgccagtcctagaacgattacgtgactagttttaacactgtacagtctagttactacgttaccgtcccgtaggtacccgttcggaccgaacgggtactaagggtcgacaacgtacgaaccgtacgtggtcgactagaccactatcgttagtccttactattcccgtaccgactacttcgagacacgtacgcgtac

SEQ ID NO: 75918 - DNA, 510 bp, Homo sapiens
  misc_feature: GYAE6OF02F4ST8.8.39.D06.1.454.CMB.1.raw
tcagctcgcgtgtccacgaccggtgctcgatttagtgacatctcgcagttctttgggggcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctggagtggatggggagaatcgaacccgagtggaggtggtgcagagtacgcccagaggtttcagggcagagtctccatgaccagtgacacgtccgcgagcactgtctatatggagatgaggagcctgagtacttgacgacacgggaccgtatacttacgtgtgcgagtaagtcgaaggaaggtggactacagtcgtaacggg

SEQ ID NO: 75919 - DNA, 815 bp, Homo sapiens
  misc_feature: GYAE6OF02JSCW4.8.39.D06.1.454.CMB.1.raw
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (781)..(781): a, c, t, g, unknown or other
  misc_feature (781)..(781): n is a, c, g, or t
tcagctcgcgtgtccacgaccggtgctcgatttagtgacatctcgcagttctttgggggagaagagctgctcagttaggacccagagggaaccatggaaagcccagcgcagcttctcttcctcctgctactctggctcccagagacgaccggagagtattcgtattgacgcagtctccaaccaccctgtcctttgtcctccgtggggganacgcccaccctctccngccgagggcccagtcgtaaacccttttagagttagttatttacgcctgggttaactcggtactaaaaaccgtggacctaacgggtcctcccccggtacttcccttactttccgtttgggtacggacgtacccgtacggaccgggtacccaacgttcggggacctacccccgaaggtacgaacggtactcgtaaggttcggaccgagggtaccgggtcgttacggggaacctaggtaacccgtttctaacgttccctaccgtacccgtaatacccgaaaacgtcggaaacctttcgggaccctaaaggtccccgttaaaggaaaactaacggtttaaactttcggacccgtttaaacgggttttaaacctacgtttacgtaccgtaaacgtcccgttaaaggttaccgttttaaccggtttaccccggtaccccgtttaggggtaaacccggttttcggaaaccccggtaaaggggtaacccggtaacgggttcgaaaccgtagttaacccgaacgtacccgtaggttcggacgttcggaacccttagtacccgtnttacgtccttcgtacttccggtccccatctaacg

SEQ ID NO: 75920 - DNA, 598 bp, Homo sapiens
  misc_feature: GYAE6OF02IBZFM.8.39.D06.1.454.CMB.1.raw
  modified_base (261)..(261): a, c, t, g, unknown or other
  misc_feature (261)..(261): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatgggganaatcaacccgagtggaggtggtgcagagtacgccgagaggtttcagggcaggagtctaccgatcgaccagtgacacgtcgcgagcacgtgtctactatggacgatagaggacgccgtgacgtacttgaacgacgaccggcgtagtacttactagtcgacgagaagtacgaagaggtacgactaacatacgaggacgttacgtttagtaacggtttagggcgtaaagggactaagtcggtactactcgtccgttacctcgtacgtccctaccaccggaaccggcccgtaacgttcccggtaccttcccccggtcggaccctaccccgtcctaacccgg

SEQ ID NO: 75921 - DNA, 617 bp, Homo sapiens
  misc_feature: GYAE6OF02IVULH.8.39.D06.1.454.CMB.1.raw
  modified_base (168)..(168): a, c, t, g, unknown or other
  misc_feature (168)..(168): n is a, c, g, or t
  modified_base (193)..(193): a, c, t, g, unknown or other
  misc_feature (193)..(193): n is a, c, g, or t
  modified_base (290)..(290): a, c, t, g, unknown or other
  misc_feature (290)..(290): n is a, c, g, or t
  modified_base (569)..(569): a, c, t, g, unknown or other
  misc_feature (569)..(569): n is a, c, g, or t
  modified_base (594)..(594): a, c, t, g, unknown or other
  misc_feature (594)..(594): n is a, c, g, or t
  modified_base (605)..(605): a, c, t, g, unknown or other
  misc_feature (605)..(605): n is a, c, g, or t
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccnccctgtctttgtctccgtggggganagccaccctctcctgcacgggcctagtgtaaccttttagtagttagtttactttagcctggtatcggacaaaaacctggccaggctccccgatcctnttctttaggtgacgccttacacgggcctaactcggccaccccagtaccaggtatcagtggccagtccgggtctagggactagaccttcatttcctcaacctataccaaactaggactgcctagtccgtaggaaactattaatcgacttaagtttacacgttgtacagtacagttaactcggtttaaccgtcccggtagtacccgttacgggaccctaaagggaccgtaagggtcgtacaacgtccgaaaccgtcgttagcggctaggacctaccagttnacgttctacgtcttcccgtcccgtnactcgtgaacncctaggcctagg

SEQ ID NO: 75922 - DNA, 730 bp, Homo sapiens
  misc_feature: GYAE6OF02H9ST6.8.39.D06.1.454.CMB.1.raw
  modified_base (266)..(266): a, c, t, g, unknown or other
  misc_feature (266)..(266): n is a, c, g, or t
  modified_base (288)..(288): a, c, t, g, unknown or other
  misc_feature (288)..(288): n is a, c, g, or t
  modified_base (381)..(381): a, c, t, g, unknown or other
  misc_feature (381)..(381): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtagaagatttccgtgcgaaggccgtccggatacaggttcaccgccgtactatattaatggctgcgacacggcccctggacaagggcctgagtggatgggganaatccaaccgagtggaggtggngcaggagacgcccgaggaggttcgaggggcagagtctacactacggaccaggtacgactaccgtccgacggacgcaactcgtctatatgggancgtaggaaggacgaccgtagacgtacgttacggaacgaccggaacgggtacccgttaacgtaactttacggtacgtagggacgtaacggaacgtaacgggaaaggtaacgggttacggaccgttaactacgtaaccggacgggttacgttaacggtttttagggttaaaggtttttcggggaaccggtaaacgggtacgttaaacggttacggttacgtacgttaccgttacccttcgtaccgtaaccgcccgtaaccccgtaacccggaaccggtaccctaaccggttcccggttaccccgtttcccccggaccgtccccgtaacccccgttcccgttaaacccccgg

SEQ ID NO: 75923 - DNA, 542 bp, Homo sapiens
  misc_feature: GYAE6OF02F0843.8.39.D06.1.454.CMB.1.raw
  modified_base (324)..(324): a, c, t, g, unknown or other
  misc_feature (324)..(324): n is a, c, g, or t
tcagctcgcgtgtccacgaccggtgctcgatttagtgacatctcgcagttctttgggggcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcgaaggcgtccggatacaggttcaccgcgtctatattaattggctgcgacaggcccctggacaagggcctgagtggagtggganaatcgaaccgagtggaggtggtgcagagtacgccagaggtttcagggcagagtctcgatcgaccagtgacacgtccgcgacgcactgtactagtatggagtagtaggaggacgcgtagagtacgttagacgactacggaccctagtacgttacgtggtcgacggagtaagtacggaaaggtaacgggtacggtacgtaacgtacgtaccggtaacggg

SEQ ID NO: 75924 - DNA, 577 bp, Homo sapiens
  misc_feature: GYAE6OF02FN9IL.8.39.D06.1.454.CMB.1.raw
  modified_base (264)..(264): a, c, t, g, unknown or other
  misc_feature (264)..(264): n is a, c, g, or t
  modified_base (487)..(487): a, c, t, g, unknown or other
  misc_feature (487)..(487): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacacggcccctggaccaagggcctagagtggatgggganaatcaacccgagtggaggtggtgcagagtacgcccgagaggtttcgagggcagagtctccatgaccagtgacacgtcgcgagcactgtactatagtggagatgaggagcctgagtacgttagacgacgacggtaccgtatacttactgtagcgaagaagtacgaaaggaaggtggactacaatcacgggtactgttttagaggttttagggcctaaagggtanaagtgtacagtcgtcttcgcacgccctaccgaccgaaccggcctacgttccggtaccctttccccgcggaccctaccccgtccaacccgg

SEQ ID NO: 75925 - DNA, 545 bp, Homo sapiens
  misc_feature: GYAE6OF02JD5VV.8.39.D06.1.454.CMB.1.raw
  modified_base (462)..(462): a, c, t, g, unknown or other
  misc_feature (462)..(462): n is a, c, g, or t
tcagctcgcgtgtccacgaccggtgctcgatttagtgacatctcgcagttctttgggggcatcatccaacaaccacatcccttctctacagaagcctctgagaggaaagttcctcaccatggactggacctggagggtcttctgcttgctggctgtagttccaggtgctcactcccaggtgcagctggtgcagtctgggggctgagatgaagagtcctggggcctcagtgaagatttcctgcaaggcgtccggatacaggttccaccgccgtctatattaatggctgcgacacggcccctggaccaagggcctagaggtggagtggggaagaagtaccgaacccgaggtcgggaggtgggtgcgaggacgtaccgccgagacggtttcgagggcaggtacgtcctccatgaccagtcgacgacgtccggcgacgcgactgtctatacgtggagagtggaggngccgtgacgacttcgacgacgacggtcgtatattacgtgtgacggaagagtacggaagaacggtgactaacagtcgtaacggg

SEQ ID NO: 75926 - DNA, 810 bp, Homo sapiens
  misc_feature: GYAE6OF02JM9PK.8.39.D06.1.454.CMB.1.raw
  modified_base (266)..(266): a, c, t, g, unknown or other
  misc_feature (266)..(266): n is a, c, g, or t
tcagctcgcgtgtccacgaccggtgctcgatttagtgacatctcgcagttctttgggttttgggggtaaggaggaagactgacggtccccccaggagttcaggtgctcactcccaggtgcagctggtgcagtctgggctgagatgaagagtccgtggggcctcgagtgaagatttcctgcaaggcgtccggatacgaggttcaccgcgtctatatttaatggctgcgacacggcccctaggacaagggcctgagtggagtgggganaagtacaacccgaagtggaggtcggtgtcgagagtacgcccaaggacgtttacgagggcgagaggtccgtccacgttagaaccgagtacgaaccgtaccgtccggtaccgaacggcgaacctgtaccgtaacgttacgtagggtaagacgttacggagggtaaacggcccgttaggtaaacggaccttttagggaaccgtaacgtaacccgggtacccgtaaagtttaaaccgtttaaccgttacggtttacggacggtaacggtaaacgttaaccggaaaggtaaacgggttagggtaaaccgttaacgtaaacgttaccgtaaccgggtaaacggttcgtttttaagggtaaacgtttttacgggggtaacccggtaaacggggtaacttaaacgggttaacgggttccgtaaagtttccgtaaccgttacccgttacgacggtacccctaccgtaacccgtaaaccgggacccctacggtttaccggtaccccgtttcccccggtccggaaccccgttaccccttaccccgttaaccccgg

SEQ ID NO: 75927 - DNA, 684 bp, Homo sapiens
  misc_feature: GYAE6OF02FIGYC.8.39.D06.1.454.CMB.1.raw
tcagctcgcgtgtccacgaccggtgctcgatttagtgacatctcgcagttctttggggcagttaggacccagagggaaccatggaaagccccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggcctccccgactcctcttcttggtggagcctacagggcccactcggccaccccagacaggatcagtggcaggcgggtctgggacaggtaccttcattctcaccatacaacacgactgacacgcctaggaaagtatacgtttgactaagttttacctaacgttgtacagtcctaagtaacttcggtttaacccgtccccggttagggtaaccgggtttccgggaacccgtaaacggggaacccgtaaaggggttccggaaccgtaaacgtacccgaaaacccggtaacgttacgggtcggtacgtcgacccgtaaccgtactccgttcggttaccttaccgtaaccgtttaccccgttcccccgaccgttacttacccggttagaaccggtaacccggtaaccgacggtaaccgg

SEQ ID NO: 75928 - DNA, 589 bp, Homo sapiens
  misc_feature: GYAE6OF02HBFQW.8.39.D06.1.454.CMB.1.raw
  modified_base (523)..(523): a, c, t, g, unknown or other
  misc_feature (523)..(523): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacacggcccctggacaagggcctgagtggagtggggagaatcaacccgagtggaggtggtgcagagtacgcccagaggtttcagggcagagtctccatcgaccagtcgacacgtccggcgacgcactcgtctatagtggagataggaggacgccgtagagacttgacgacgacggcctaatattacgtgtagcgagtaagtacggaaagaaggtggactaacgaatacgacggtagttcgtttagtaaggttttacggggacgtaaagggacaagttcggtactagtcgtctccgtancgtccctccaaccgaacggcccgacgtccggtcccttccccgtcggccctacccgtccctaacccg

SEQ ID NO: 75929 - DNA, 776 bp, Homo sapiens
  misc_feature: GYAE6OF02H9R77.8.39.D06.1.454.CMB.1.raw
  modified_base (293)..(293): a, c, t, g, unknown or other
  misc_feature (293)..(293): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtccgtggggcctcaggtgaagattttcctgcaaggcgtcggatacaggttccaccgccgtactatattaagttggctgcgacacggccccgtggacgaagggcctagagtggagtggggagaagtccaaacccggagtagggnggtggtgacgagacggtaaccgcccgaaggtagtttcgacgggcaaggtaggtcctcgtatacggaacctaggtacggtaaccgtacggtccggaccggagaccgaccttagtaccgttaatacgngggtaanaggttaggaagggtacgtccgtaggtaagtacgttacgggaaaccgaccgaccgggtaccgttaacgtttaacttttaccgttaggtacggacggaaacggtaaagtaccggaaaaggtaacggtacgggtaactaaacgaacgttaacgtaagggtacgtttacgttttaaggttagggttttacgggaaccggtaaaggggtaacttaagttcggtactaacgttcgtcccttaccggtaccgtacgccccgtttacccgaaacgggttaaccccggccgtaaccggtttcccggttacccgttaccccccggttacggacccccttacccccgtacccttaacccgg

SEQ ID NO: 75930 - DNA, 690 bp, Homo sapiens
  misc_feature: GYAE6OF02FY2KC.8.39.D06.1.454.CMB.1.raw
  modified_base (265)..(265): a, c, t, g, unknown or other
  misc_feature (265)..(265): n is a, c, g, or t
  modified_base (288)..(288): a, c, t, g, unknown or other
  misc_feature (288)..(288): n is a, c, g, or t
  modified_base (331)..(331): a, c, t, g, unknown or other
  misc_feature (331)..(331): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctgggggcctcagtgaagatttcctgcaaggcgtccggatacaggttcaccgccgtctatattaattggctgcgacacggcccctaggacaagggcctgagtggagtgggganaactcaaccggagtggaggtggngcagagtacgccgagtaggttcagggcagagtctccatcgacngtcgacacgtcgcgacgcactgtactatagtggagagtaggaggacgtaccgtgacgtacgtacgacgaccgacgggtaccgtataacttacgtcgtgacgtaagaagtacggaaaggtaagggtacggtactaacgtaacgtaaccgtaacggtacgtttacgtttaggttaacggttttcgggggaaccgtaagggtaacgtaacgttacgggtacgttaacgttccggttccttacccgtacgtaccgtaccccgtaccccgtaaacccggaacccggtaccccgtacggtttaccccggtttccccgttaccccccgggtacggtaccccctaccccgttaccccgtaaccccgg

SEQ ID NO: 75931 - DNA, 641 bp, Homo sapiens
  misc_feature: GYAE6OF02HKH83.8.39.D06.1.454.CMB.1.raw
  modified_base (292)..(292): a, c, t, g, unknown or other
  misc_feature (292)..(292): n is a, c, g, or t
  modified_base (379)..(379): a, c, t, g, unknown or other
  misc_feature (379)..(379): n is a, c, g, or t
  modified_base (622)..(622): a, c, t, g, unknown or other
  misc_feature (622)..(622): n is a, c, g, or t
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtagtaaccttttagtaagttagtttatttagccttggtatcggacaaaacgtggccaggcctccacggcccctnatctagtggtgcatccaacgtagggccacgtggacactcccgacgccgtaggttcaggtggcgtaggtgggtagtgggacagtctcnctacacacctatcatccagccgtaggactccgtaaggagtagttcgttgtacttaagttttatcgtacgtacaactcgtaccgttacgtacggtcggacccgtcgggtacctaccggtttcggccccgtagggaccgtagggtacggacgtaacgtaacggaaacgtacgtcggtacggtcccgttagacccgtaacctacgttccgttccggtttccttaacgttccttaccccggttcccncttacttccgagtaacccg

SEQ ID NO: 75932 - DNA, 780 bp, Homo sapiens
  misc_feature: GYAE6OF02H276W.8.39.D06.1.454.CMB.1.raw
  modified_base (295)..(295): a, c, t, g, unknown or other
  misc_feature (295)..(295): n is a, c, g, or t
tcagctcgcgtgtccacgaccggtgctcgatttagtgacatctcgcagttctttgggttttgggggaagaggaagactgacggtccccccaggagttcaggtgctcactcccaggtgcagctggtgcagtcgtggggctgagatggaagagtccgtggggcctcgagtggaagtattttccgtgacgaaggccggtaccggaatacgaggttaccaccggccgttactattattaagttggctgcgacgacggccctaggaacgaagggcctaggaggtgggagtacgggggaanaacgtccgaaaacccgggaggttaggagggtcggtaggaccgaaggtaacggtaccggaccccgagggttaacggtttacgagggacaaggtacgtcctacgagttacgaaccgtaggtacgacgacgtccgacgacgacctagtacgtacttaagtacgtaggaagtagtagggacgggtctaccgttaggacgttaacggttacggaaccgaaccggaaccgggtacccgttaacgttaacgtttaccgtcggtacggtagaaacggtaaacgtaacgggaaaggtaaggggtacgtaacgttaacgaacttacggaacggacggtttagtttaacggttaacggttttaacggggaccgtaaacgggtaacgtaaagtcggttacgtacgttcgttacgtacctacgtacgtcccgtaaccgacgtaccggaccctacggtccggttacccctcccgttaccggcctccccgtctaacccgg

SEQ ID NO: 75933 - DNA, 708 bp, Homo sapiens
  misc_feature: GYAE6OF02FZCV1.8.39.D06.1.454.CMB.1.raw
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggagtggggagaatcaacccgaggtggaggtggtgcgagagtaccgcccagaggtttcagggcagagtctaccagtgaccagtacgaccgacgtccgacgtacgcactcgtctatacgttgggaagtacgtagtaggacgaccgtgaacggtacgtttggaaccggtaccgaccgggtaccgtaacgttaacgttaccgtaggttacggaccggaaggtaagtaaccgggaaaggtaaacgggttacggaactaaccgaaacgttcgaacggtacgttacgttttaaggtaacggtttttacgggggaccgtaaacggggtacgtaaacgttggtacgtacgttaccgtaccttaccgtaccgacggttccctacccgtaacccggaaacggtccccgtacgttacccggtcccttacccccggttaccggacccttaccccgtaccgtaaccccgg

SEQ ID NO: 75934 - DNA, 732 bp, Homo sapiens
  misc_feature: GYAE6OF02IT4PN.8.39.D06.1.454.CMB.1.raw
  modified_base (272)..(272): a, c, t, g, unknown or other
  misc_feature (272)..(272): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggagtgggagaatccaaccgngtggaggtggtgcagagtacgcccgaggtaggtttcagggcaggacgtctccgatacgaccagtacgacgaccgtccgcgagcactgtactaagtagtaggaagtagtggagggacgtcctagacgtacgttaggaccgaacgaccggtaccgttaagttacgttaccgttaggtagaccggtaaggtaaacgttaacgggaaagggtaaacgggttagggtaacctaaacgtaaacgttaacccggtaacgggtaacggtttacgtttttaagggttaaacgggttttttacgggggaacccgtaaacggggtaacgtaaacggttcgggttacgaacgttccgttaccttcccgtactaccgtcccttaaccccgaaccgtaacccgggcccctaacggttcccggttcccttacccccggtcccggtacccgttacccccgttacccgtaaccccgg

SEQ ID NO: 75935 - DNA, 721 bp, Homo sapiens
  misc_feature: GYAE6OF02FW751.8.39.D06.1.454.CMB.1.raw
  modified_base (341)..(341): a, c, t, g, unknown or other
  misc_feature (341)..(341): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaaagagtcctggggcctcgagtgaagtatttcctgcaaggcgtccggatacaggttcaccgccgtctatattaattggctgcgacaggcccctaggacaagggcctgagtggagtggggagaatccaacccgaggtggaggtggtgcagagtacgcccgagaggtttcgagggcagacgtctcatgaccagtgacncgtccgcgagccacgtgtctatatacggagagtagaagggtacgccgttaggagtaactttacgggaacggtaacacccggggaccgtaagttaactttacgtaggttaggaccgtaaggtaaacgttaacggaaaggtaacggggttaacggccttaaacgaactaccgtaacggacgttcgttttaggttaacggttttacggggaccgtaaacgggggtactaaagggtcggttacctaagttcccgttacgtacccttaccgtaccgtaccccgttacccgaacccgtaaaccgggccccctaacggtttccccgggtttacccgttcccccccggttccggtacccccgtaccccccgttacccttaacccccgg

SEQ ID NO: 75936 - DNA, 721 bp, Homo sapiens
  misc_feature: GYAE6OF02I6DU6.8.39.D06.1.454.CMB.1.raw
  modified_base (260)..(260): a, c, t, g, unknown or other
  misc_feature (260)..(260): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggccctaggacagggcctgagtggatgggganatcaaccgagtggaggtggtgcgagagtacgccaggtaggtttcgagggcaggtagtctacgatcgaaccagtacgacgacggtccgagacgacgaacgtggttacctagtacgtagggacgtagtaggaaggtacgactaggtagtacctttaggaaccgacgaccggtaccgttaagtacgtttacgtggttacgacgtaacggtaacgttaacggaaaggttaacgggtacggtaaccgtaaacgtaacgttaccgtaagggtacggtttaccgtttttaagggtaacgggttttaccggggtaacgtaaacggggtaaccgttaacggttacggtacctacggttaccgttacccttaccgttacgtaacccggtcccttaacccgtaccgtaaccgggtcccgtaacgttcccggttcccttaccccgtcggtaccctacccgtaccgtaacccgg

SEQ ID NO: 75937 - DNA, 875 bp, Homo sapiens
  misc_feature: GYAE6OF02IGBD4.8.39.D06.1.454.CMB.1.raw
  modified_base (149)..(149): a, c, t, g, unknown or other
  misc_feature (149)..(149): n is a, c, g, or t
  modified_base (166)..(166): a, c, t, g, unknown or other
  misc_feature (166)..(166): n is a, c, g, or t
  modified_base (600)..(600): a, c, t, g, unknown or other
  misc_feature (600)..(600): n is a, c, g, or t
tcagctcgcgtgtccacgaccggtgctcgatttagtgacatctcgcagttctttgggttttggggggaagaggaagactgacggtcccccaggagttcaggtgctcactcccaggtgcagctggtgcagtcgtggggctgagatgaagngtccgtggggcctcagngaagtatttcctgacgaaggtcgtccggatacgtaggttcaccgccgtactattattaagtggctgcgacgtacgggtccccctagggaacgaacggggcctaggagtagggagttcggggggaataacgtacgaacccggaggtacgggtagggtgggttcgacgtaacggtacggtaacccgccccggtaaggtacgggtttacgacgggtaccgtaaggtacggttcctacgtaactcggaaccgtaggtacgaaccgtaacggttccggacgacgaccgtacggttacgtacgttaagtaggttaacgggagtaacggttgggaacgggtacgtcccggtagtaacggttaacgttacgggacccggaaacggtacccgggtaaccggttaaactttacgttttaacccgtaggttacgggaacggtaanaacgggtaccgggtaaaaggtaacgggttcgaacgtaaacccgtaaacgttacggaacggttacggttacgtttttacgggttaaaggttttccggggaaaccgtaaacggggtaacgtaacgttacggtacgttaccggttccgttaccgttacccgtcgacccggttacccgtacccggtaaccccggtaaccggggtccccctacggtttacccccgggtccctttacccgggtccccggtaacccccttaccccggtccccgttaacccgg

SEQ ID NO: 75938 - DNA, 624 bp, Homo sapiens
  misc_feature: GYAE6OF02GTX4S.8.39.D06.1.454.CMB.1.raw
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccacctgtctttgtctccgtggggggagagccaccctctcctgcgagggccagtcgtaaccttttagtagttagttatttagcctggtatcggacaaaacctgccagctccccgactcctcttcttggtggagcctacgacgggccacgtggccacccccgagaccaggactcgagtggacgaggcgggtcgtagggacagtacgttctacttcctacgaacctactacaaacagtactagacacgtcctaggaactagtatcgacttacgtttactacgtgtcagtctagtacttcgttaccgtcccggtaggtaccgttccggaccgaacgggtaccgagggtcgactacgtaccgaacgacgttaggtcgacgtacgacctaccgtactccgttacgttcttacctacttcccgtacccgtcctactacgtaccgacgtaccgacggtacgtacgg

SEQ ID NO: 75939 - DNA, 763 bp, Homo sapiens
  misc_feature: GYAE6OF02HEF99.8.39.D06.1.454.CMB.1.raw
  modified_base (196)..(196): a, c, t, g, unknown or other
  misc_feature (196)..(196): n is a, c, g, or t
tcagctcgcgtgtccacgaccggtgctcgatttagtgacatctcgcagttctttgggttttggggggaagaggaagactgacggtcccccccaggagttcaggtgctcactcccaggtgcagctggtgcagtctggggctgagatgaagagtcctggggcctcagtgaagtatttcctgcaaggcgtccggatacnggttcaccgccgtctatattaatggctgcgacaggcccctggacaagggctgagtggagtggggagaatccgaaacccgaggtaggagggttggtgtcgaggagtaccgcccgaggtaggtttcgagggtcgaggaagtcgttaccagtacgaccgagtgaaccgaccgggtccgccggaacgcctacgtcgtacgtactagtggacgtagtacggaggtacgtaccgtagtacgtacgttacggaccgaccgaccggtacccggttaacttaacgttttacgttacggtacggtacggaacggtaaacgttacggtaaaacggttaggggtaacggtaaccgttaacgtaaacgttacggacgggtaacgtttcggttttaagggttaacggttttaccgggggaaccgtaacgggtaaagttaacgttacggtacgttaacgttcccgttacgttcccgtcgtaccggtacccctaccgttaacccggaacccggtcccgtaaggttccccggttaccccgttaaccccgttccgggaccccccttaccccttcccgtaaccccg

SEQ ID NO: 75940 - DNA, 725 bp, Homo sapiens
  misc_feature: GYAE6OF02FRHVC.8.39.D06.1.454.CMB.1.raw
tcagctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgccagggccagtcgtaaccttttagtagtagttaatttagcctggtatcggactaaaaaccgtggaccacggcctaccccggacttcctctttctttcgggtcggagccctacgagggccacgtggacccaccccgagaccgaggatcgagtcggacaggtccgggtcgtagggacaggtacttacattccacgaacctagtaccaacgaacgactcgaccgtaacgtccctaaggtaacgtattacgttacggacgtttaacttttacgaaccggtttcgtaccgtaagtacgtaagttaccgttacgggtttaacccgtacccgggttagggttacccgttacgggaaccgtaaacgggaccgtaaagggttcgaactaacgtacccgaaacggtaccgttacgggcgtacgtacgtaccgaccgtcgtaccgttcgtaccgtttacctacgtttccccgttacccgtccgttccgtaaggtacccgtaacgtacccgggtccggtacggtacggg

SEQ ID NO: 75941 - DNA, 704 bp, Homo sapiens
  misc_feature: GYAE6OF02JLYNO.8.39.D06.1.454.CMB.1.raw
  modified_base (267)..(267): a, c, t, g, unknown or other
  misc_feature (267)..(267): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtggaagatttcctgcaaggcgtccggatacaggttcaccgccgtctatattaatggctgcgacacgggccctggacaacggggcctggagtggagtggggganaactacgaacccgaggtgggacgggttgggtagcgaaggaggtaaccgcccgaaggtacgggttttacgaacggggcaggtacgtcctccgactggaccaggtacgaccgtaccggttcccggacgaacggcaacttcgttctataagtggagatgggaaggacgtcgtagacgtacgtcgaacgacgaacggtacgtagttattacggtacggacgtacggaagtaacgtacggaaaggtaaggtcgtacgtaacaacgcgtaacggacgttgttttaaggtacggttttacgggaccgtaaagggtaacgtaaggtcggttaacgtacgtccgtttaccaccgttacgaccgtacccgtaccgtaaccgaaccgggtacccaggttacccggttccccttaccccggtcgtaccccgtaccccttccctaaccgg

SEQ ID NO: 75942 - DNA, 742 bp, Homo sapiens
  misc_feature: GYAE6OF02G8IAI.8.39.D06.1.454.CMB.1.raw
  modified_base (275)..(275): a, c, t, g, unknown or other
  misc_feature (275)..(275): n is a, c, g, or t
tcagctcgcgtgtccacgaccggtgctcgatttagtgacatctcggcgagttcttgggtttgggggaagaggagactgacggtcccccaggagttcaggtgctcgactccaggtgtcagctggtgcagtcgtgggctggagagtgaaagagtccgtggggcctcagtagaagtagttcctgcgaaggcgtccggactacgaggttccgaccgccgtactagtattaattggctgcgacgacggcccctggacaagggcctagaggtgagtggganatacgaaccgagtggaggtggtagcgacgacgtacgcccgacgaaggtttcgacgggtcgacgtagtccgtaccgagtacgaccgtaagtacgaccgtaccgtaccggaccggtagaccgtaacgtcgttacgtagttacggtaggaacgtacgtaggtaacggacgacccgtaggtacgtaaccgtttcgaaccggtaaccgacccgggtacgttacgttaacgttacgtacggtcggtacgaaggtaacgtacggaaaggtaacgggttacgtaacgttaagaacgtcgtaacggtaggttaacgtttaggttaacggttttacgggaacccggtaaggtaaccgtaacggtcggtactcgttacgtaccgtcccgtacgtaccggccctaacccgaaccgaaccggtacccgtaccgttccgtacccgttaccccgtccggtccctacccgccccgttaaccgg

SEQ ID NO: 75943 - DNA, 773 bp, Homo sapiens
  misc_feature: GYAE6OF02H2UQC.8.39.D06.1.454.CMB.1.raw
  modified_base (705)..(705): a, c, t, g, unknown or other
  misc_feature (705)..(705): n is a, c, g, or t
tcagctcgcgtgtccacgaccggtgctcgatttagtgacatctcgcagttctttggggggagaagagctgctcagttacggacccagagggaaccatggaaacgcccagcgcagcttctcttcctcctgctactctgctcccagacgacgacggagagtattgtatgacgcagtcctaccaacctacccttgtcttttcgtccgtccggtggggggacacggccctacccttctccgtggccgacgggccagttacgttaaccttttaggtacgttagtttatttacgccgttaggtactacggaacaaaccgtcggaccacggtcctacccgattcccttcttcgtttgggtacgtacgccgtacgtacgggacctacgtcggaccctaccccgagaccgtaggtactacggttaggcggacgacggttccgggtacggtacggggtacctaaggtaccctttacgtacgtttccaaccgtaacctaacgttacccgaaagtaaccgtacgtttcgaacgttacgtaaccgtaacgtaaacgttacgttacgttacgcgtttaacgttaccttacgtacgtacgacttacgttacttaacggttaccgtaccgttacccggtcgggtttaccggtacgtaccggaacggtaccgtaacggacgtacgtaacgttaaccgaaccgttacgtacgtacgtccggtntaccccgaatacgtttccgtactttaccgtacgttacccgttcccgttaccggtaccctgttaacccg

SEQ ID NO: 75944 - DNA, 919 bp, Homo sapiens
  misc_feature: GYAE6OF02H35Z8.8.39.D06.1.454.CMB.1.raw
  modified_base (214)..(214): a, c, t, g, unknown or other
  misc_feature (214)..(214): n is a, c, g, or t
  modified_base (885)..(885): a, c, t, g, unknown or other
  misc_feature (885)..(885): n is a, c, g, or t
tcagctcgcgtgtccacgaccggtgctcgatttagtgacatctcgcagttctttggggcagttaggacccagagggaaccatggaaagcccagcgcagcttctccttcctcctgctactctggctccagagacgaccggagagattgtattgacgcagtctccaacctacctgttctttgtctccgtaggggaggagaccgccaccctcgtccngcgaggccgagtacgtaacctttaggtaagttagttacgttacgtccgttaaggttacgtaccggaaacctaaaaccggtcgaccgtacggtccttccgaacccgtacccttccgttaccgtttacggtttacgggtggtaacccgtaccgtaaccggaaccgggtaccctaaccggttaccgggacccctaacccccggtaagaacccggtaagggtaactaccggtaagggtacgggaacggacggggttacgggtaccggtaacggggtaaactacgtttaaccgttaccgtaaacgttttcctaaccgaaccgtaacgtaaccgaaaaccgtacggttaaccctggaaccgtaaccggtcgtaaacggtaacgttaacgtttaggttacctaacccgggttttaattttaaccgtaacgtttccggtaaaccggtacgtaacgtttaaagggttaaccggttttcccgtttaacccggggttaccccggtttaacccgggggtacgggttaaacccgggaaccggttaaaccgggacccgggttaaagggccggtaacgtaaacccggtacggtaaaaccgtaccggttcggagttaccccgaaaccggtcccaaccgggttactaccggtttctaaccggttccgttacccgtccgttaccccggnttaaccggtttccgaaactccgggactaaccggg

SEQ ID NO: 75945 - DNA, 783 bp, Homo sapiens
  misc_feature: GYAE6OF02GDE4V.8.39.D06.1.454.CMB.1.raw
tcagctcgcgtgtccacgaccggtgctcgatttagtgacatctcgcagttctttgggttttggggggaagaggaagactgacggtccccccaggagttcaggtgctcactcccaggtgcagctggtgcagtcgtgggctgagatgaagtgtccgtggggccctcagtagaagtatttccgtgacgaacgggccgtaccggatacgacggttccacccggtccgtactattattaagttggctaggccgacgacggtccccgtggaacgaacggggtccttggacggtgggacggtagggggaaacgtaacgtccgaaaccccggtagggttagggacgggttagggttacggacggtaacggaacgggttaccccggacccggtagggttacgggtttccggagggacgtaggtacgtcctaccgtacgtacgaaccgtaggtacgaccgtacccggtccgacgacgtacctacgttcgttactagtagtacggagtagtagggacgacgtccgagtacgtacgttggaaccgacgaccggtagtacttagttacgtgtacggagtaaggtaacgtacggaaaggtacggtagtaccgtaaacgtacgtacgaacggttactttcggtttaaggttaggtttaacgggccgaaaggtacgtaggtacgtctacgttgtcccttacacggtaaccgtccccgtaacgaacccggtacccgtacccgttacggtacccggtttccccttcccggaccgtaccccgtccccgttaaccgtaaccgg

SEQ ID NO: 75946 - DNA, 908 bp, Homo sapiens
  misc_feature: GYAE6OF02G9D9B.8.39.D06.1.454.CMB.1.raw
  modified_base (185)..(185): a, c, t, g, unknown or other
  misc_feature (185)..(185): n is a, c, g, or t
tcagctcgcgtgtccacgaccggtgctcgatttagtgacatctcgcagttctttgggggcatcatccaacaaccacatcccttctctacagaagcctctgagaggaaagttcctcaccatggactggacctggaggtcttctgcttgctggtctgtagttccgaggtgctcactcccgaggtgcngcgtggtgcgtagtcgtaggggctggagactaggaaggtcgtccgggtcggggcccttagtaaggttagtaacgttactttccgtacggaacgtaacgggtccggtacggtaacgtaacgtacgggtttaccgaaccggttcccggttaacttaagtttaagtttaaacggttcggggaccgttcgggtaacccggtaaccggtacccgggtacccccggttaacggggtaaacccgggtaaaccgggggttccccggtaaggggtaaccggggttaggggtaaacgggttacgggggggtaaacgtaaaaccggtaaccccgggtaaaacccgggtagggttacggggggtaacgggtttgggtaccgggtaacgtaacgggttaacccgggttacccggaacccggttaaggggttaaccgggtttaccgggaacgggtcgtaacgggttacgtccgttaccggtaacgtaccggtaccgtaacggttaccggtaaccgtacccgggtaccggtacgaccggtaccgtacgtttacgttaccgttaacggttaggtacggtagtacggtacggacggaccgtacggttagtaaccggttcgttaacggtaccgtaacgggtaaccggttacgttaccgttacgtttacggtcggttacggaacggtaacgtaacggtacggaaggttaccggtaggtaacgtaacgtacgttacgtacggg

SEQ ID NO: 75947 - DNA, 547 bp, Homo sapiens
  misc_feature: GYAE6OF02GIM8T.8.39.D06.1.454.CMB.1.raw
  modified_base (243)..(243): a, c, t, g, unknown or other
  misc_feature (243)..(243): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
  modified_base (381)..(381): a, c, t, g, unknown or other
  misc_feature (381)..(381): n is a, c, g, or t
  modified_base (498)..(498): a, c, t, g, unknown or other
  misc_feature (498)..(498): n is a, c, g, or t
tcagctcgcgtgtccacgaccggtgctcgatttagtgacatctcgcagttctttgggggcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagacgtcgtggggcctcgagtgaagtatttccngcgaggcgtccggatacaggtcaccgccgtctatattagtgctgcgacgcggcccctggacgagggcctgagtggagtggganaacgtacgaccgnggtaggaggtggngacagagtacgccgagtgttcgaggcagngtctacagtacgacgagtacgacgacggtaccgcgacgctagtgtcttagtagcggagtagtggaagtcgcgtagacgtacgtcgaacgtacgacgtacctagttacgtacgtgganacggaagtagtacggaaggtacgggtacgactaacgacgtacggtacgg

SEQ ID NO: 75948 - DNA, 838 bp, Homo sapiens
  misc_feature: GYAE6OF02HDQJH.8.39.D06.1.454.CMB.1.raw
  modified_base (196)..(196): a, c, t, g, unknown or other
  misc_feature (196)..(196): n is a, c, g, or t
  modified_base (267)..(267): a, c, t, g, unknown or other
  misc_feature (267)..(267): n is a, c, g, or t
tcagctcgcgtgtccacgaccggtgctcgatttagtgacatctcgcagttctttgggtttggggggaagaggaagactgacggtccccccaggagttcaggtgctcactcccaggtgcagctggtgcagtctggggctggagatgaagagtcctggggcctcagtgaagtatttcctgcaaggcgtccggatacgnggtcaccgcctctatattatggctgcgacacggccctggacaaggggcctggagtagggtagtaggggganaacgttccgaaacccggtaggtcgggaagggttcgggtggaccgaagggtaccgttaacccggccccgtaagggtaaggtttttccggaagggggccgaaggtaccggtcctacccgtagttacggaaccccgtaaggtacgaacccgtacccgggtacccggaccggacggtacctaacgttcggttacccgttaagttaacggtaggggtaaccggtaaggtacggaacggggtaccggtcccgttaacgggaacggttaccgtttcgggaaccggaccggtaaccggggtaccgttaaacttacgtttaacgtggtcggtacggtaaacggtaagtaacgggaaagggtaacggggtaggtaaccctaacgtacgtaaccgacgggtgtttaacgttttagggtaacggttttcggggaaccgtaagggtaaccgtaaggttcgacctaagttccgtaccgttccgttacgacccggtccctacccggtaaccggtaacccggtccgttaaccgttcccggttaccccttccccggttacgaccccttacccgtacccccgtaaccgg

SEQ ID NO: 75949 - DNA, 698 bp, Homo sapiens
  misc_feature: GYAE6OF02HN8EL.8.39.D06.1.454.CMB.1.raw
  modified_base (264)..(264): a, c, t, g, unknown or other
  misc_feature (264)..(264): n is a, c, g, or t
  modified_base (373)..(373): a, c, t, g, unknown or other
  misc_feature (373)..(373): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatagaagagtccgtggggcctcagtgaagatttcctgcaaggcgtccggatacaggttcacgccgtctatattaattggctgcgacacggcccctggacaagggcctggagtggagtggganaatacaaccgagtggaggtggtgcaagagtacgaccagtaggttcgaggggcaggaggtctaccgaatagtaccgaagtcggaacacggtccgacgacggacactagtntaactagtaggagagtggaaggacgcgtagatacgttgacgacacggtaccgtaatagttactaggtgacgtaagaagtaacggaaaggtaaggtcggtacgtaacgtaaagtaccgaacggacgttacgtttttagggtaacgtttttacgggggaacctaaacggggtaacgtaaaggtacggttacaaagttccgttacgtacccgttacgaacccggtcccttaacccgaaacccggaaaccgggtaccccgaacctttaccgggttccccgtttaccccccggttaccggaccccgttacccctaccccgttaaccccgg

SEQ ID NO: 75950 - DNA, 1012 bp, Homo sapiens
  misc_feature: GYAE6OF02I6SPF.8.39.D06.1.454.CMB.1.raw
tcagctcgcgtgtccacgaccggtgctcgatttagtgacatctcgcagttctttgggtttgggggaagaggaagactgacggtccccccaggagttcaggtgctcactcccaggtgcagctggtgcagtctggggctggagatgaagacgtcccgtgggggccttcgaggtaggaaagtacgttttcccgtaggaccgtaaacgggccggttaccgggaacttaaccggtaacgggtttccaacccggtccgttactaaattaactttaaacggttgggtaccgttcggtaacccggaacccggtaccgggtaccccccgttagggaaaccgttaaaccggggggtcccttaacggggtagggttacggggtaaacggtaggggggggtaacctaaacggttaacccgtaaaacccgggtaaggggttacggggtaacgggggtttacgggtcggtaaccggtaacgggtaaacccggttacccggtaacccggtaacggggttaacggtttttaccggaacggggggttacccgaacgggttaccggtacccgttaacccggaagttaccgggtaacccggttaacggtaccggtaaccggttacccggtacccgggttacggaccggttaccgtaaccggttacgttacgttaacgtaacggttacgggacggtacgttaacggggaaccggtacggtacccgtaggtaaccggtaacgtttcgggaacccgtacggtaaccgggtaccctttaagtacgttaacggtggtacgacggtaaagaaccgtaacgggtaaggtaacggttacgacgtaactaaaccggtcgtaaccggtacgtttagttacggttaacggtttacgggaaccggttaaggtacgttaggtacgttacgtacgttaccggtactcccgttacgaccgtacccgttcccgaaacccggttcgaacccgtacgttacccgggttcccttacccccggtcgtccccttacccgacccgtaacccgg

SEQ ID NO: 75951 - DNA, 814 bp, Homo sapiens
  misc_feature: GYAE6OF02IL9ZU.8.39.D06.1.454.CMB.1.raw
  modified_base (748)..(748): a, c, t, g, unknown or other
  misc_feature (748)..(748): n is a, c, g, or t
  modified_base (755)..(755): a, c, t, g, unknown or other
  misc_feature (755)..(755): n is a, c, g, or t
  modified_base (802)..(802): a, c, t, g, unknown or other
  misc_feature (802)..(802): n is a, c, g, or t
tcagctcgcgtgtccacgaccggtgctcgatttagtgacatctcgcgagttctttggggcagttaggacccagagggaaccatggaaagcccagcgcagcttctcttcctcctgactactctgctccagagacgacggagagattgtattgaccgctagtcctacccaacctacccgttgttcgtttcggtccgttcccggtaggggggatacggccctacccttctccgtgcgacgggcctaagtacgttaaccgttttagtagttacgttagtttacgcgttaggtactacggtaacgtaaaacgtcgggtacccgggcctaccccggtaccttccgttacgtttcggtttacgggtcgggtaaccgttacccgtaccggaccgggtaccccgtaacggttccggtacccccgaaccccggttaaggaaccgtaaggggtaaccttaaccgcgggttaaccggacgtaccggggttaccgggttcggtaacgggtaccgtacggttaaccgttcggttacttacccgtaaccgaactacgtaaccgaacgtaaccggttcgaacgtccgtaacgtaaccgtaagggtaacgtaagtttacttaacgggacttttaacgtttaactccgttacggtaccgaacgtcgttaaacgggtccttaaccgggtttccggtaaccgggtcggtacgttaacgaccggtaaacggtgaacgggtcgtaagactacggaaccgtacggtgtccngactacncgtacttcgccttcgacttccgtccaacgttgacgtacgtccgaacncggtcacgtcgg

SEQ ID NO: 75952 - DNA, 823 bp, Homo sapiens
  misc_feature: GYAE6OF02GPBZP.8.39.D06.1.454.CMB.1.raw
tcagctcgcgtgtccacgaccggtgctcgatttagtgacatctcgcgagttctttggggcagttaggacccagagggaaccatggaaagcccacgcgcagcttctcttcctcctcgctactcctggctcccagagacgaccggagagattgtagttgacgcagtctccaaccaccctgtcttcgtctccgtggggggtagagccaaccctctacctcgccagggccacgtgtaacccgttttagtacgtagttactttaagcctaggtagtacggacgtaaaaaccgtggacctaggcctacccgacgtaccctacttcttggtacggacgtcctacgagggtcccaacgtcggaccaaccccgagtaaccgaacgggtacgtacgtacggtacgggaccgtaacggtcccggggtacgttacggggaaccgttaaccggtacgttttacccgacgtttaccctaccgaaccgttaccgtaacgttaaaaccggaacgttaccgttacggtaccgaaaccgttacccgttaacggaaaacggtaacgttaacggttccgtaaccgttaacgggttttaaaccaaacggtttccgtaacgtaagttccggtaaagttacggtttacgtttaaccggtacccggttacgtaccgggtttacggacccgtaaaggggtaacccgtaaggggtgtaaccgtaacggttaacccaaaccggtacggttacggtaggtcccggtacgtccaaccgtgtacccttagtcccgtaactcgttacccgttaccgataaccgtgttaccgcgtaacccggtcgtaccctaggg

SEQ ID NO: 75953 - DNA, 846 bp, Homo sapiens
  misc_feature: GYAE6OF02H6VL5.8.39.D06.1.454.CMB.1.raw
  modified_base (228)..(228): a, c, t, g, unknown or other
  misc_feature (228)..(228): n is a, c, g, or t
tcagctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtccgtggggcctcagtgaagtatttcctgcaaggcgtccggatacaggttcaccgccgtctatattatggctgcgacncggccctggacaagggcctgagtggagtggggagactcgaacccgtaggtacgggaggtggtaggtcgaagtacgtaccggccccgaaggtacggtttaccgaacgggacgaggtaacggttcctacccgagttaccggaaccctacggtacggtaacccgtaccggtacccggtacggaccgtcgtaaccgttcggtaccgttaacgtaggtacgggtaagtaggtacgggtaaggaccggtacggtcggtaacggtaacccgtttagggaacccggtaaccggtaaccgggtaccgggtttaaacttacgtttaaccgttggtaacggtccgtaaaggtaaacggtaccggtaaaacgggaaacgggttcggtaaaccgttaacgtaaacgttccggaaacggttaaccgttacgttttttaagggttaaacgggttttaccgggggtaaccggtaaaggggtaaacgtaacgttcgggtaacgttaaccggtcgtttacccgtaccttccgacccggtccctaaccccgaaccgtacccgggtacccgtaaccgtttcccgggttccccgttacccccggtaccgtaaccccttccccccgtaccgttaacccgg

SEQ ID NO: 75954 - DNA, 661 bp, Homo sapiens
  misc_feature: GYAE6OF02IDJAG.8.39.D06.1.454.CMB.1.raw
  modified_base (276)..(276): a, c, t, g, unknown or other
  misc_feature (276)..(276): n is a, c, g, or t
  modified_base (334)..(334): a, c, t, g, unknown or other
  misc_feature (334)..(334): n is a, c, g, or t
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (508)..(508): a, c, t, g, unknown or other
  misc_feature (508)..(508): n is a, c, g, or t
tcagctcgcgtgtccacgaccggtgctcgatttagtgacatctcgcagttctttgggggcatcatccaacaaccacatcccttctctacagaagcctctgagaggaaagttcctcaccatgggactggacctggagggtcttctgcttgctggctggtagttccagggtgcctcacctcccagggtgcagtctgggtgccaggtccgtgggggctggagaatggaaagtacggttcccgtgggggcccttacgaaggtaggtaacgtactttccgnggtacgaagggtccggtacggataacgaggttccaaccgtcgtactatattagtcggntgcgacgacggcccgtaggacgaacggtcgtggagtggagtaggganaacgacaccggagtgggagtggngacagtagacnccgagtacggttcgacggcgagtacgtctaccgtaagcgaacgtacgtgaacgaccggtcgaccggactacgttaactgttaccgtaatacgngaattgacggaaggcgactaggtaacgtacgtaggtaacccgacgtaccggaccgttagttaccttaggtacggtacggtaacggtaaaggtaaccgtaacgggtaagggtaacggtacggaaccgtaaacctaaccgggtcgtaaaccgggg

SEQ ID NO: 75955 - DNA, 708 bp, Homo sapiens
  misc_feature: GYAE6OF02F1L8E.8.39.D06.1.454.CMB.1.raw
  modified_base (256)..(256): a, c, t, g, unknown or other
  misc_feature (256)..(256): n is a, c, g, or t
tcagctcgcgtgtccacgaccggtgctcgatttagtgacatctcgcagttctttgggggcatcatccaacaaccacatcccttctctacagaagcctctgagaggaaagttcctcaccatggactggacctggagggtcttctgcttgctggctgtagttccaggtgctcactcccgaggtgacagctggtgcagtcgtggggctgagagtagaagacgttccgtggggccctcgacgtaggaacgtactttccgngaccgaaggccggtaccggtatacgtcggttaccaccggtccgtactattaacttaagtcgctggcgaccgcggccccgtggacgaacgggccgtaggtaggtggtacggtggggaacgtaacgtaccgaaacccggtaggtacggggtaggggtggtacggacaaggacggtaccgacccggtaaggttacgggtttacggacggggtacgaggtacggttcctaccgtagttaccggaaccgtaggtcggtaaccgtacccgggtaccggaccgacgtaccttaacgtcgttaacgtacgttacggtaggaacgtaggtacggacgggtacgtccgtaaggacgttagtacggaaccacggtaccggacttacgttacgttacgttggacgtacggtaagtaaccgttaaggaaggtacggtacggtacgaacgtacgtaggtaaccggg

SEQ ID NO: 75956 - DNA, 525 bp, Homo sapiens
  misc_feature: GYAE6OF01CP9R3.5.73.G07.1.454.CMB.1.raw
  modified_base (148)..(148): a, c, t, g, unknown or other
  misc_feature (148)..(148): n is a, c, g, or t
  modified_base (331)..(331): a, c, t, g, unknown or other
  misc_feature (331)..(331): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgngtttctagtggctatttaaaggtgtcattgtgaggtgcagttgttggagtctgggggaggcttagtacagcctggggggtccctgagactctcctgtgcagcctctggattcacctttgacaactatgccatgagctgggtccgccaggctccgagggaaggggctggagtgggtctcagttnttcgtggtagtggtggtgccacatactacgcagactccgtaaagggccgttcgcagtctccagagacaattccaagaacacggtgtatctgcagatgaacagcctgagagccgaggacacggccgtttattactgtgcgaaagacacctctggtgggtggttgtactaacgtggttcgactcggtgggacccgg

SEQ ID NO: 75957 - DNA, 673 bp, Homo sapiens
  misc_feature: GYAE6OF01C6B22.5.73.G07.1.454.CMB.1.raw
  modified_base (254)..(254): a, c, t, g, unknown or other
  misc_feature (254)..(254): n is a, c, g, or t
  modified_base (318)..(318): a, c, t, g, unknown or other
  misc_feature (318)..(318): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtcgtttctaggtggctatttaaaaggtgtcatgtgaggtgcagttgttggagtctgggggagcttagtacagcctggggggtccctgagctctcctgtgcagcctntggattcacctttgacaatatgccatgagctgggtccgccaggctccgagggaaggggctgggngtggtctcgtagttagttcggtggtgtggtggtcgaccactactacgtacgacgacgtaccgtaccgggtaaacgggtcccggttacgacctactccgtaccgaaggaacgtaacctaaacgttaacccgaaaacggtaaccgtaacgggttagttaacgtcgtaggtaaccgaagtaagtaacgtaacgaacgtaccgtacggaacggacggaccggaacggaccggtaaccggttaccgtttacgttacgttacgtacgtaaccgaaacgaaccgtaccgttacgttcggttcgggttagggttaggttaacgttaacgttacggttacggtacggtcgggtcgggtaccggg

SEQ ID NO: 75958 - DNA, 533 bp, Homo sapiens
  misc_feature: GYAE6OF01ARO2H.5.73.G07.1.454.CMB.1.raw
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (506)..(506): a, c, t, g, unknown or other
  misc_feature (506)..(506): n is a, c, g, or t
  modified_base (526)..(526): a, c, t, g, unknown or other
  misc_feature (526)..(526): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggcttttctgtggctattttaaaaggtgtccattgtgaggtgcagttgttggagtcgtgggggaggcttagtacagcctggggggtccctgagactctcctgtgcagcctctggattcacctttgacaactatgccatgagctggggtccgccaggctccgaggggaaggggctgggagtgggtctcgagttattcggtgggttagtggtggtgccacatactacgcagactaccggtaaagggccgttcgccatctccagagacattcccaaagacaggtgtatctagcagatgaacngccngagcgcgaggacacggtcttatacgtgtagacgaaagcncctntgggtgggtggttnacgtagtggttacgactggngggaccg

SEQ ID NO: 75959 - DNA, 580 bp, Homo sapiens
  misc_feature: GYAE6OF01A0KCY.5.73.G07.1.454.CMB.1.raw
  modified_base (286)..(286): a, c, t, g, unknown or other
  misc_feature (286)..(286): n is a, c, g, or t
  modified_base (471)..(471): a, c, t, g, unknown or other
  misc_feature (471)..(471): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtgtttctaggtggctattttaaaaggtgtcattgtgaggtgcagttgttggagtctgggggaggcttagtacagcctggggggtccctgagactctcctgtgcagcctctggattcacctttgacaactatgccatgancgtgggtccgccaggctccgagggaaggggctgggagtgggtctcgagttattcgtggtaggtggtggtgccacatacgtacgcagtacctccggtaaagggccggttacgccaagttcctcccaggacgactaaattccaaagaacacggtgtatctgcagatgaacagcctgagagcgacganaccggtcgttattacgtgtagacgaaaggacctaccgtcttagggtggggttacgggttagttaacgtaacgttggggttacctaacggtcgggttcgggggaacccgg

SEQ ID NO: 75960 - DNA, 538 bp, Homo sapiens
  misc_feature: GYAE6OF01D7ACM.5.73.G07.1.454.CMB.1.raw
  modified_base (426)..(426): a, c, t, g, unknown or other
  misc_feature (426)..(426): n is a, c, g, or t
  modified_base (494)..(494): a, c, t, g, unknown or other
  misc_feature (494)..(494): n is a, c, g, or t
  modified_base (506)..(506): a, c, t, g, unknown or other
  misc_feature (506)..(506): n is a, c, g, or t
  modified_base (521)..(521): a, c, t, g, unknown or other
  misc_feature (521)..(521): n is a, c, g, or t
  modified_base (529)..(529): a, c, t, g, unknown or other
  misc_feature (529)..(529): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagcgtcgggtccgccaggctccgaggggaagggctggagtgggtctcgagttattcgtggtagtggtggtgccacatactacgcagactaccgtaaaggccggttcgccatctccagacgacaattaccaagaacacggtntatctgacagatgaacagcctagagacgccgaaggaccacggtccttatctgtgacgaaagcacctgnggtgggtggttnacgacgttggttacncgttcggngggtaccgg

SEQ ID NO: 75961 - DNA, 588 bp, Homo sapiens
  misc_feature: GYAE6OF01A65G0.5.73.G07.1.454.CMB.1.raw
  modified_base (450)..(450): a, c, t, g, unknown or other
  misc_feature (450)..(450): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagccgtggggggtccctgagactctcctgtgcagcctctggattcacctttgacaactatgccatgagcgtgggtccgccgaggcctccgaggggaaggggctgggagtgggtctcgagttagttcggtggtaggtggtggtgccacatactacgcagaccgtaccggtaaacgggcccggttcgacccatccgtacccagacgaactaacttccaaaggacacgggtntatctgacagatagaacagcctagacgacgccgaggaccacggtcctttatacgtgtacgacgaaagccaccgttgtgggtcggggttgggttcgtaacgtaacggttgggttaccgacgttcggggtggggaccccg

SEQ ID NO: 75962 - DNA, 556 bp, Homo sapiens
  misc_feature: GYAE6OF01DUT2O.5.73.G07.1.454.CMB.1.raw
  modified_base (362)..(362): a, c, t, g, unknown or other
  misc_feature (362)..(362): n is a, c, g, or t
  modified_base (453)..(453): a, c, t, g, unknown or other
  misc_feature (453)..(453): n is a, c, g, or t
  modified_base (505)..(505): a, c, t, g, unknown or other
  misc_feature (505)..(505): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtcttttcttgtggctattttaaaaggtgtccattgtgaggtgcagttgttggagtcgtggggggaggcttagtacagccgtggggggtccctgagactctcctgtgcagcctctggattcacctttgacaactatgccatgagctgggtccgccaggcctccgaggggaagggctggagtggtctcgagttagttcgtggtagtggtggtgccanatactacgcagactaccggtaaaggccggttcgccatcctccgagacgaactacttacccaaagaacacggtgtatctagcagatagaacngcctgagacgccgagaccacggtctttatactgtgacgtaaacgctaccgtnttgggtcgggttggttagtactaacgtggttcgacgttggtcgggacccgg

SEQ ID NO: 75963 - DNA, 604 bp, Homo sapiens
  misc_feature: GYAE6OF01A7KCY.5.73.G07.1.454.CMB.1.raw
  modified_base (436)..(436): a, c, t, g, unknown or other
  misc_feature (436)..(436): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggcgttttctagtggctattttaaaggtgtcatgtgaggtgcagttgttggagtctggggaggcttagtacagcctgggggtccctgagactctcctgtgcagcctctggattcacctttgactaactatgccatgagctgggtccgccaggctccgagggaagggcgtggagtgggtctcgtagttagttcgtggtagtggtggtgccgacagtactacgcagactccgtaaaagggccgttcgccgtatccgtaccagacgacaatttccaaagtaactacggtttancttagcagatacgaacaggcctagaagacggccgaggtaccacgggtccgttaagttaccgtgttcggacgtaaacggacctaccgtcgttgggtcgggttggggtttataaccgaacgtttcgggttaccgtaaccggtcggtttcgggggccgttaaacccggggg

SEQ ID NO: 75964 - DNA, 554 bp, Homo sapiens
  misc_feature: GYAE6OF01DYP1L.5.73.G07.1.454.CMB.1.raw
  modified_base (430)..(430): a, c, t, g, unknown or other
  misc_feature (430)..(430): n is a, c, g, or t
  modified_base (443)..(443): a, c, t, g, unknown or other
  misc_feature (443)..(443): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgttttcttaggtggctattttaaaaggtgtccattgtgaggtgcagttgttggagtctgggggaggcttagtacagccgtggggggtccctgagactctcctgtgcagcctctggattcacctttgacaactatgccatgagctgggtccgccaggctccgagggaaggggctggagtgggtctcagttattcgtggtagtggtggtgccgacatactacgcagactccgtaaaggccgttcgccatctccagacgacaattcccaagaactacggtttanctgcagatgaacngcctgagagccgagacacggtcctttatactgtgacgtaaacgactaccgtctggtgggttgggttagtacaacgttgggttaccgagttcggtaggggccgtaaccgggg

SEQ ID NO: 75965 - DNA, 814 bp, Homo sapiens
  misc_feature: GYAE6OF01BCHMX.5.73.G07.1.454.CMB.1.raw
tcagatcagacacgcacgaccggtgctcgatttagctctacgctcaggggtctgagagaggagcccagccctgggattttcaggtgtttcatttggtgatcaggactgaacagagagaactcaccatggagtttgggctgagctggcttttcttgtggctattttaaaaggtgtccattgtgaggtgcagttgtggagtcgtgggggaggcttagtacaggccgtggggggtccctgagactctcctgtgcagcctctggattctacctttgacaactatgccatggagcgtcgggtccgccgacggcgtccgaggggaacgggcgtgggaggtgggtctcgtagttattcggtggtagtggtggtgccacgataccgtacgcaacggtacctacccgggtaaacggggtcccggttaccgacccgtaagttcccgtaccgaaggaacgtaacctaaacgtttaccccgaaaaaggtaaaccgtaaccggggtttacgtaaacgtttcccgtaaggacccgtaaagggtaacgttacggtaaaaacccgacgggtacccccggttaagggaaacgggtaaccgaaccccgggggaaacgggtaaccccgtaaacggggtttcccccgttttttaaagttaacccggttggtaacgggtaacccgggtaaaaaaacggttccccgtaaacccgtttcccggttagggggtttacgggggtttacggggtttaaccggtaaacccgttaaaccgggtttcccggggtttaaccggaacccggtttcccgggggttaaccggggggaacccccgggg

SEQ ID NO: 75966 - DNA, 557 bp, Homo sapiens
  misc_feature: GYAE6OF01CCQ4F.5.73.G07.1.454.CMB.1.raw
  modified_base (421)..(421): a, c, t, g, unknown or other
  misc_feature (421)..(421): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccgagggagggctggagtgggtctcagttattcgtggtagtggtggtgcacatactacgcagactaccgtaaagggcccggttcgccatctccagacgacaattccaaagacacggtntatctgcagatgaacagcctgaagacgccgaaggacacggtccgtttatacgtgtgaccgaaagaccgtaccgtcgtaggtgggttgggttacgtacgtaacgttgggttaccgacgttcgggtcggggtacccgg

SEQ ID NO: 75967 - DNA, 563 bp, Homo sapiens
  misc_feature: GYAE6OF01CPRTX.5.73.G07.1.454.CMB.1.raw
  modified_base (438)..(438): a, c, t, g, unknown or other
  misc_feature (438)..(438): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggcttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccgagggaagggctggagtgggtctcgagttattcgtggtagtggtggtgccacatactacgcagactccgtaaagggccgttcgccatctccagacgacaattcccaagaacaacggtgtatctgcagatgaacngctgagacgccgaggacacggtccgtttatacgtgtagacgaaagacctaacctcgtggttcggggttgggtttacgtaaccgtaacgttcgggtttacgaaccgtcgggttcggggaacccggg

SEQ ID NO: 75968 - DNA, 586 bp, Homo sapiens
  misc_feature: GYAE6OF01CU06T.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggcttttctgtggctattttaaaaggtgtccattgtgaggtgcagttgttggagtctgggggagcttagtacagccgtggggggtccctgagactctcctgtgcagcctctggattcacctttgacaactatgccatgagctgggtccgccaggctccgagggaaggggctgggagtgggtctcgagttagttcgtggtagtggtggtgccacatactacgcagaccgtaccggtaaagggtccggttcgccatcctccgagagaacaattacccaagaacacggtgtactctgacagatagaacagcctagagacggaccgaggacacgggtaccgtttagtaagtgtacgacgtaaagaccgtaccgtagtggtggggttgggttacgtaacgtaacggttcgggttaccggaacgttcgggtcggggtaaccccggg

SEQ ID NO: 75969 - DNA, 574 bp, Homo sapiens
  misc_feature: GYAE6OF01D8XM8.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagccgtggggggtccctgagactctcctgtgcagcctctggattcacctttgacaactatgccatgagcgtgggtccgccgaggctccgaggggaaggggctgggagtgggtctcagttattcgtggtagtggtggtgccacatactacgcagactccggtaaaggcccggttcgccatctccagaacgacaattccaagtaacacggtttatctagcagatgaacagcctgagagaccgaggacacggtcgtttatacgtgtgacgaaacgacctaccgtcgtgggtggggttgggttacgtacgtaaacgttcgggtttacgaccgttcgggtcgggggccctaaccggggg

SEQ ID NO: 75970 - DNA, 560 bp, Homo sapiens
  misc_feature: GYAE6OF01BBBA6.5.73.G07.1.454.CMB.1.raw
  modified_base (256)..(256): a, c, t, g, unknown or other
  misc_feature (256)..(256): n is a, c, g, or t
  modified_base (298)..(298): a, c, t, g, unknown or other
  misc_feature (298)..(298): n is a, c, g, or t
  modified_base (366)..(366): a, c, t, g, unknown or other
  misc_feature (366)..(366): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgcgtttctaggtggctattttaaaggtgtcattgtgaggtgcagttgttggagtctgggggaggcttagtacagcctggggggtccctgagactctcctgtgcagcctntggattcacctttgacaactatgccatgagctgggtccgccnggctccgaggggagggctgggagtgggtctcgagttattcgtggtagtggtggtgccacatactacgnagactcgtaaaggccgttcgcatcctccgagagacaattcccaaagacaacgggttntatcngacaganagaacngcngacgcgacgagtacgacggttcttatacgtgtacgacgaacgtacctccgttgtgggtcggggttacggttacgtaacgtacggttcggttacgtaccggtcggggtcggggaccg

SEQ ID NO: 75971 - DNA, 551 bp, Homo sapiens
  misc_feature: GYAE6OF01CETX7.5.73.G07.1.454.CMB.1.raw
  modified_base (295)..(295): a, c, t, g, unknown or other
  misc_feature (295)..(295): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggcttttcttgtggctattttaaaggtgtccattgtgaggtgcagttgttggagtcgtgggggaggcttagtacagcctggggggtccctgagactctcctgtgcagcctctggattcacctttgacaactatgccatgagctgggtccnccgaggctccaggggaaggggctgggagtgggtctcagttattcgtggtagtggtggtgccacatactacgcagactaccgtaaagggccggttcgccatcctccagagacaattcccaagaacacggtntatctgcagatgaacngcctgagagccgaggacacgggtcctttatactgtgacgaaagcaccttcgtaggttcggggtagggtttataacgtaacgttgggttaccgacttcgggtggggacccg

SEQ ID NO: 75972 - DNA, 615 bp, Homo sapiens
  misc_feature: GYAE6OF01C2EEM.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtctttttcttgtggctaattttaaaaggtgtccattgtgaggtgctagttgtggagtcgtgggggagcttagtacagccgtgggggtccctgagactctcctgtgcagcctctggattcctacctttgacaactatcgccagtgagcgtggggtccgccgaggcctaccgaggggaaggggctgggaggttgggtctcgtagttagttcggtggttagtggtggtcgacccagatacgtacgcacgtaccgtaccggtaaacgggccgttcgaccatcctaccgagagaacaacttccaaagaacgacggtgtaatcgtagacagatcgaacagtcctagaacgacggaccggaggaccgacggtaccgtttataccgtgtacgaacgtaaagccaaccgttcgtaggttggggttagggttcgtaacgtaacgttggttccgaacgttcgggtacggggtacccgg

SEQ ID NO: 75973 - DNA, 526 bp, Homo sapiens
  misc_feature: GYAE6OF01ERO2P.5.73.G07.1.454.CMB.1.raw
  modified_base (489)..(489): a, c, t, g, unknown or other
  misc_feature (489)..(489): n is a, c, g, or t
  modified_base (502)..(502): a, c, t, g, unknown or other
  misc_feature (502)..(502): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggcttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccgagggaaggggctggagtgggtctcgagttatcggtggtagtggtggtgccacatactacgcagactccggtaaagggccgttcgccatctccagacgacaattccaaagaacacggtgtatctgcagatgaacagcctgacgagccgaggacacggtcctttatactgtgacgaaagcaccgtntggtgggtggttnacagtggtcgactcggtggggccg

SEQ ID NO: 75974 - DNA, 646 bp, Homo sapiens
  misc_feature: GYAE6OF01AUK7U.5.73.G07.1.454.CMB.1.raw
  modified_base (583)..(583): a, c, t, g, unknown or other
  misc_feature (583)..(583): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcttttcttgtggctattttaaaaggtgtccattgtgaggtgcagttgttggagtcgtggggaggcttagtacagccgtgggggtccctgagactctcctgtgcagcctctggattcacctttgacaactatcgccatgagcgtcgggtccgccgaggcctccgaggggaagggcgtgggagtgggtctcgtagtttagttcggtggttaggtggtggtcgccgacatactacgcgaacgaccgtacccgggtaaacgggtcccggttaccgcctactccgtaccacggacgaactaacttacccgaaacgaaccgtacggttagtacttcgtacgtacgagtagtacgaacgacgacgtaggaaggaccgccgggaaggtaaccgacggttacccgttttataccgtagtcgaacgtaaacgaccgtaccgttnacggggttggttgggttacgtacgtaacgttggttaccgcgttcggggtcggggtaaccccgg

SEQ ID NO: 75975 - DNA, 682 bp, Homo sapiens
  misc_feature: GYAE6OF01EGP6K.5.73.G07.1.454.CMB.1.raw
  modified_base (172)..(172): a, c, t, g, unknown or other
  misc_feature (172)..(172): n is a, c, g, or t
  modified_base (180)..(180): a, c, t, g, unknown or other
  misc_feature (180)..(180): n is a, c, g, or t
  modified_base (242)..(242): a, c, t, g, unknown or other
  misc_feature (242)..(242): n is a, c, g, or t
  modified_base (503)..(503): a, c, t, g, unknown or other
  misc_feature (503)..(503): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtgttctaggtcgctatttaaaggntcatgtgngtgcagtgtgagtctggggagcttagacagcgtgggggtcctgagctctcctgtgcagcctnggtattccgacctttgactaactatcgccaatggatcgttcggcccgcgacggcctacggaggggaaggggtccagggtacggttgggtcctacgtagtttaagttcggtggtaggttggtagggttcgacccgtacgtaataccgttaacggaccgagtaaaccgttccgggttaaaacggggcccgtttacggccctaagttccctacgaaggtacgaactaaacttcccaaaaggtaacacgggtttacttacgtcgngacgtagtagtacgaacgacgtacgtagacgacggaccggaacggacggtaccggttaccgtttacgttacgtacgtacgaacgaaacgtacgtacgttacggttagggttcgggttacgggttacggttaacgttaacggttacgggttacggtacggttacgggtacggggtaccgg

SEQ ID NO: 75976 - DNA, 625 bp, Homo sapiens
  misc_feature: GYAE6OF01CJKGC.5.73.G07.1.454.CMB.1.raw
  modified_base (455)..(455): a, c, t, g, unknown or other
  misc_feature (455)..(455): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagccgtggggggtccctgagactctcctgtgcagcctctggtattcacctttgactaactatgccatgagcgtgggtcccgccgaggcctccgaggggacggggcgtggaggtgggtctcgtagttagttcggtggtagtggtggtgccacatactacgcacgacgtaccggtaaacgggtcccggttcgacctacgtcctacgagacaactaacttacccaagacgtacggtntactcgtagacagatacgaacacgacgtgacgacgaccggaggaccgtccggttacgtttagtacgtggtacgaaccggaaacgaccgtaccgttggtagggtttgggggttcggttacgtaccgtaacggttcgggttaccggtcgttccgggggtcgggtaacccggg

SEQ ID NO: 75977 - DNA, 543 bp, Homo sapiens
  misc_feature: GYAE6OF01C3046.5.73.G07.1.454.CMB.1.raw
  modified_base (297)..(297): a, c, t, g, unknown or other
  misc_feature (297)..(297): n is a, c, g, or t
  modified_base (439)..(439): a, c, t, g, unknown or other
  misc_feature (439)..(439): n is a, c, g, or t
  modified_base (507)..(507): a, c, t, g, unknown or other
  misc_feature (507)..(507): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagccgtggggggtccctgagactctcctgtgcagcctctggattcacctttgacaactatgccatgagctgggtccnccaggctccgagggaagggctgggagtgggtctcagttattcgtggtagtggtggtgccacatactacgcagactccgtaaagggccgttcgccatcctccagagacaattccaagaacacggtgtatctgcagatagaacngcctgagacgccgaggacacggtcctttatacgtgtgaccgaaagcctacctgttggtgggtgggttntacgtacgttggttaccgacgtcggtcggggacccg

SEQ ID NO: 75978 - DNA, 657 bp, Homo sapiens
  misc_feature: GYAE6OF01BZ468.5.73.G07.1.454.CMB.1.raw
  modified_base (481)..(481): a, c, t, g, unknown or other
  misc_feature (481)..(481): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggcgtttttctagtggctaattttaaaaggtgtccattgtgaggtgcagttgttggagtcgtgggggaggcttagtacagccgtggggggtccctgagactctcctgtgcagcctctggattcacctttgacaactatcgccatgagcgtgggtccgccgaggcctccgaggggaacggggctgggaggtgggtctcgagttattcgtggtagtggtgtgccacatactacgcagacctaccggtaaagggcccggttcgcctatcctacccgaaggacaaccaacttacccgaaagaaccgtacgggttcgtaatctaggacagaattcgaacngcccgtggaacggacgacccggaaggacctaccgggttaccgttttagtacgttcgggtacgaaccggtaaaacgaccgtaacccgttcggtaggggttccggggttaggggtttacgtaaccggtaaccggttggggtttacccgaacggttccggggtacgggggaaccccggg

SEQ ID NO: 75979 - DNA, 666 bp, Homo sapiens
  misc_feature: GYAE6OF01BU99I.5.73.G07.1.454.CMB.1.raw
  modified_base (528)..(528): a, c, t, g, unknown or other
  misc_feature (528)..(528): n is a, c, g, or t
  modified_base (587)..(587): a, c, t, g, unknown or other
  misc_feature (587)..(587): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtctttttctgtggcttaattttaaaaggtgtcattgtgaggtgcagttgttggagtcgtggggaggcttagtacagccgtgggggtcctgagactctcctgtgcagcctgtggattcacctttgacaactatgccagtgagcgtgggtccgcaggcctccgaggggaacggtcgtgggtagtgggtctacgtagttagttcggtggttaggtggttgggtgtaccgtacaacgtaacgtaccgacgaacggtaacctaccgggtaaacggtaccggggttaccgaccgtacgtaccgttaccaaggtaacggaactaaaccgttacccgtaaacgaacgtaacggtacgttacgtactacgtacgaagtagtacggaaanacgacgtcgaagtacggaccgaggacgacgtaccggttattacgtgtagacgaaaacgngtaacccgtgttggggtcgggttagggttaccgtaagtaaccgttacggttacggacgttcgggtaggggtaacccggg

SEQ ID NO: 75980 - DNA, 566 bp, Homo sapiens
  misc_feature: GYAE6OF01AIUO6.5.73.G07.1.454.CMB.1.raw
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtgttttctagtggctattttaaaggtgtccattgtgaggtgcagttgttggagtcgtgggggaggcttagtacagcctgggggtccctgagctctcctgtgcagcctctggattcacctttgacaactatgccatgagctgggtccgccaggctccgaggggaaggggctgggaggttgggtcctgtagttagttcgtgggttaggtggtggtgccacatactacggcagactaccggtaaaggtccggtcgccatcctaccagacacaattccaaagacacggtgtatctgcagatcgaangcctgganacgccgaggaccacggtcgtttatacgtgtgacgaaacgactccttgtagggtgggttagggttactacgtaacttgggttacgaccgttcgggtcgggggtaaccccg

SEQ ID NO: 75981 - DNA, 640 bp, Homo sapiens
  misc_feature: GYAE6OF01BNKU5.5.73.G07.1.454.CMB.1.raw
  modified_base (337)..(337): a, c, t, g, unknown or other
  misc_feature (337)..(337): n is a, c, g, or t
tcagatcagacacgcacgaccggtgctcgatttagctctacgctcaggggtctgagagaggagcccagccctgggattttcaggtgtttcattggtgatcaggactgaacagagagaactcaccatggagtttgggctgagctggcttttctgtggctatttaaagtgtccattgtgagtgcagttgtggagtctggggagctagtacagcctgggggtcctgagactctcctgtgcagctcgtggattcactttgacactatgccatgacgtctgggtccgcaggctaccgagggaaggctggacgtggtctcagttatcgtgtagtgtggtgcanatacgtcgacagactccggtaaaggccgttcgcagtcgtaccaggacgtactaagttcccaaagacctacggtagtaactcgtacggacctaaggtacttacggaactacggtccgttacgggaacgtacgtacccgggtaagggtacctaaccggggttacccgttttaagttacccgtaggtaccggtaacggaaaaccggtccgtacccgtttaggtacggttacggggttacgggtttacgtaacccggttacgttacggggttacccgacggtttaccgggtcgggggtaaaccccgg

SEQ ID NO: 75982 - DNA, 728 bp, Homo sapiens
  misc_feature: GYAE6OF01CF3LP.5.73.G07.1.454.CMB.1.raw
  modified_base (506)..(506): a, c, t, g, unknown or other
  misc_feature (506)..(506): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcttttcttggtggcttaattttaaaaggtgtccattgtgaggtgcagttgttggagtcgtgggggagcttagtacagccgtgggggtccctgagactctcctgtgcagcctgtggtacttctacctttgaacaactatcgccatgagcgtcgggtccgccaggcctccggaaggggacgggctgggaggtgggtctcgtagtttagttcggtgggttaggtgggtggtcgaccactaacttactaccggactaacggtaccgttacccgggtaaacggggtcccgttcgaccctaactcccgtacccaaaggtaccgaacctaaacgttaacccgaaaacggaaacgtaccgggttntaacgtccgtaggaccaaggtaagtacgaaaccgacgtccgtaagggaacggacgtacccgggaaggtaacccgacgggtttacccgttttaacgtaacgtcgggttaacgaaaccggtaaacgtaccctacccggttggttaggggttcgggggttacggttaacgtaaaccgttaacggttggtttacccggaccgttcgggggaccgggggtaacccgg

SEQ ID NO: 75983 - DNA, 553 bp, Homo sapiens
  misc_feature: GYAE6OF01D86RN.5.73.G07.1.454.CMB.1.raw
  modified_base (441)..(441): a, c, t, g, unknown or other
  misc_feature (441)..(441): n is a, c, g, or t
  modified_base (543)..(543): a, c, t, g, unknown or other
  misc_feature (543)..(543): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctattttaaaaggtgtccattgtgaggtgcagttgttggagtcgtgggggaggcttagtacagccgtggggggtccctgagactctcctgtgcagcctctggattcacctttgacaactatgccatgagcgtgggtccgcaggcctccgaggggaagggctgggagtggtctcagttattcgtggtagtggtggtgccacatactacgcagactccgtaaaggccgttcgccatctccagagacaattacaagaacacggtgtatcgtgcagatagaacngcctgagagccggaggaccgacggtaccgttttatacgtgtacgacgaaacgctacctcgtggtggggttaggtgtaacctacggttacggttcgactgggngggtacccgg

SEQ ID NO: 75984 - DNA, 613 bp, Homo sapiens
  misc_feature: GYAE6OF01EYGT5.5.73.G07.1.454.CMB.1.raw
  modified_base (362)..(362): a, c, t, g, unknown or other
  misc_feature (362)..(362): n is a, c, g, or t
  modified_base (443)..(443): a, c, t, g, unknown or other
  misc_feature (443)..(443): n is a, c, g, or t
  modified_base (465)..(465): a, c, t, g, unknown or other
  misc_feature (465)..(465): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagcctggggggtccctgagactctcctgtgcagcctctggattcacctttgacaactatgccatgagctgggtccgccaggcctccgaggggaaggggctgggagtgggtctcagttattcggtggtagtggtggtgccantactacgcagacctaccggtaaagggcccggttcgcctatcctaccgagacgaactaaattacccaaagaaccacgggttntaactctgacagataggaaccncgcaggagacggaccggagaccgtacggttacgtttatacgtggtacgaacgaaacgtaccgtaccgttggttggggttcggggttagggttacgtaaccggttaacggttcgggttaccggtccggttccgggggtcggggtacccg

SEQ ID NO: 75985 - DNA, 548 bp, Homo sapiens
  misc_feature: GYAE6OF01A0E8U.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagccgtggggggtccctgagactctcctgtgcagcctctggattcacctttgacaactatgccatgagctgggtccgccaggctccgaggggaaggggcgtgggagtgggtctcagtttattcggtggtagtggtggtgccacatactacgcagactccggtaaagggcccggttcgccatctccagagacaattccaaagacacggtgtatctgcagatgaacagcctgagagccgaggaccacggtccgtttatacgtgtacgacgaaagctacctgtggtgggtgggttagacgtacgttggtacgacgtcgggtggggacccgg

SEQ ID NO: 75986 - DNA, 600 bp, Homo sapiens
  misc_feature: GYAE6OF01CW2G2.5.73.G07.1.454.CMB.1.raw
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (288)..(288): a, c, t, g, unknown or other
  misc_feature (288)..(288): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
  modified_base (436)..(436): a, c, t, g, unknown or other
  misc_feature (436)..(436): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtcgtttctaggtggctaattttaaaaggtgtcattgtgaggtgcagttgttggagtctggggaggcttagtacagcctgggggtccctgagctctcctgtgcagcctntggnttcacctttgactaactatcgccagtgngctgggtccgccagggcctccgaggggaacggggtctgggagtgggttcctagtagttattgtggtgtggtggtgcactatacacggcagctaccggtaaaggccgttcgacnttccgccagganacaacttcaaagtacacgggttntatcgtagacagtagtaacgaacgtacgtcgtaaggacggacggaccggaggtacgtaaccggttacgtttagtacgtagtacgacgtaacgccgtacgttcgtagggttgggttacgttagaaccgttacggttcggtacgacggttccgggtacggtaccgg

SEQ ID NO: 75987 - DNA, 587 bp, Homo sapiens
  misc_feature: GYAE6OF01EL516.5.73.G07.1.454.CMB.1.raw
  modified_base (258)..(258): a, c, t, g, unknown or other
  misc_feature (258)..(258): n is a, c, g, or t
  modified_base (427)..(427): a, c, t, g, unknown or other
  misc_feature (427)..(427): n is a, c, g, or t
  modified_base (457)..(457): a, c, t, g, unknown or other
  misc_feature (457)..(457): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
  modified_base (507)..(507): a, c, t, g, unknown or other
  misc_feature (507)..(507): n is a, c, g, or t
  modified_base (522)..(522): a, c, t, g, unknown or other
  misc_feature (522)..(522): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtcttttcttgtggctattttaaaaggtgtccattgtgaggtgctagttgttggagtcgtgggggagcttagtacagccgtgggggtccctgagactctcctgtgcagcctntggattccacctttgacaactatcgccatgagcgtggggtccccgccgacggcctaccggagggggaacggggctaggggaggtcgggtctcgtagtttagttcggtggtaggtggtggtcgccatatactacgcagaccgtaccggtaaacgggccgttcgctactcnccgaagacgactaattccaaagactaggtntatcngcagatgaacngcctagacgagccgaggactacggttcttatcgngtcgaacgaagtccnccgttgtgggtgggttcggttataccgtaacggttcggttacgacggttcgggcggggtaacccg

SEQ ID NO: 75988 - DNA, 823 bp, Homo sapiens
  misc_feature: GYAE6OF01B47IR.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttctgtggctattttaaaaggtgtccattgtgaggtgctagttggttggagtcgtgggggaggcttagtacagccgtgggggtccctgagactctcctgtgcagcctcgtggattcacctttgacaactatcgccatgagcgtcgggtccgccgaggccgtaccggaggggaacgggcgtagggaggtggtctacgtagttagttcggtggtaggttggtggtcgaccaactataaccgtacgacaggtaccgtaccgggaaacggggtcccggttaccgacccgtaacgtcctacccgaagtaacgtaacctaaactttaacccgaaacgtaaaccgaacgggttacgttaactacgttacggaacgaacggtaactaacgggaaaccgaccggtccgtaacggaacggggaaccggacccggggtaaacgggtaacccgtaaacccggggtttacccggttttttaaacgttaacggttacgggttaaccgggaaaccggtaaaaaacccgggtaccgtaaacccccggtttacgggtttacggggggtttaccggggggtttacggggttttaaccggttaaaccgttaaacccggggttttaccgggtttaacccggtaacccggggtttcccggggggttacccgggggggtaaaaccccccgggg

SEQ ID NO: 75989 - DNA, 654 bp, Homo sapiens
  misc_feature: GYAE6OF01B22IF.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagccgtgggggtccctgagactctcctgtgcagcctctggattcacctttgacaactatgccatgagcgtgggtccgccgaggctccgaggggaaggggctgggagtcgggtctcgtagttagttcgtggtagtggtggtgccacatacacgcacgactacggtaaaggccgtcgcatcctcagagacattccaaagactacggtgtactcgtagaccgagatacgaacacggtccctaggaacggacggacccgggaagggacccgtaaccgggttcccgttttaacgttaccgttgggtacggaaccggtaaaacgtacccgtacccgttggtacggggtttcgggggttaggggttttacgtaaccggttaaaccggttcggggtttacccggtaaccggttccccgggggttggggggtaacccccggg

SEQ ID NO: 75990 - DNA, 661 bp, Homo sapiens
  misc_feature: GYAE6OF01BUCIW.5.73.G07.1.454.CMB.1.raw
  modified_base (252)..(252): a, c, t, g, unknown or other
  misc_feature (252)..(252): n is a, c, g, or t
  modified_base (469)..(469): a, c, t, g, unknown or other
  misc_feature (469)..(469): n is a, c, g, or t
tcagatcagacacgcacgaccggtgctcgatttagctctacgctcaggggtctgagagaggagcccagccctgggattttcaggtgtttcatttggtgatcaggactgaacagagagaactcaccatggagtttgggctgagcgtgtgtttctaggtggctatttaaaggtgtcattgtgaggtgcagttgttggagtcgtggggaggcttagtacagctggggggtccctgagactctcctgtgcagcctntggtattcactttgacaactatgccatgagctgggtccgccgaggcctaccgaggggaacggggcgtgggaggtgggtctcgtagtttatcggtggtagtggtggtcgcgactatacgtacgcagactaccggtaaacgggcccggttcggacctatcctacccgaagagaacctaagttcccaaaggaaccgtaggttagtaacttctaccggganaagtacgtacgaacgacgtcgtaggaacggacggaccggaacggaccgttaccggttacgtttaacgtaccgtaggtaccgaacggaaacgtaccgtaccgtttggtaggggttcggggttacgggtttacggttaaccgttacgggttacgggtttaccggtaccgggttccggggtaccgggaacccggg

SEQ ID NO: 75991 - DNA, 554 bp, Homo sapiens
  misc_feature: GYAE6OF01BESVC.5.73.G07.1.454.CMB.1.raw
  modified_base (359)..(359): a, c, t, g, unknown or other
  misc_feature (359)..(359): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggttcagttgttggagtcgtgggggaggcttagtacagccgtgggggtcctgagactctcctgtgcagcctctggattcacctttgacaactatgccatgagcgtcgggtccgccaggctccgagggaggggcgtggagtgggtctcagttattcgtggtagtggtggtgccanatactacgcagactaccgtaaagggtccggtcgccactctccagacgacaactacaacgaacgacggtagtatctcgcgagatagaacagctagagagaccgagacgacggtacgttactacgtgtgacgaaacgacaccgtcgtggtgggtggttgtacgagtccccggtgtaccgtcggtgggcgtaaccggg

SEQ ID NO: 75992 - DNA, 702 bp, Homo sapiens
  misc_feature: GYAE6OF01DNAP7.5.73.G07.1.454.CMB.1.raw
  modified_base (177)..(177): a, c, t, g, unknown or other
  misc_feature (177)..(177): n is a, c, g, or t
  modified_base (252)..(252): a, c, t, g, unknown or other
  misc_feature (252)..(252): n is a, c, g, or t
  modified_base (288)..(288): a, c, t, g, unknown or other
  misc_feature (288)..(288): n is a, c, g, or t
  modified_base (597)..(597): a, c, t, g, unknown or other
  misc_feature (597)..(597): n is a, c, g, or t
tcagatcagacacgcacgaccggtgctcgatttagctctacgctcaggggtctgagagaggagcccagccctgggattttcaggttgttttcatttggtgatcaggactgaacagagagaactcaccatggagtttgggctgagcggtgtcgtttctaggtcggctaatttaaaggngtcattgtgagtgctagttgttggagtcgtggggagcttagtacagccgtgggggtcctgagtctctcctgtgcngcctgtaggtacttcctaccgtttgaactaacttancgccatcggagtccgtcgggtcccgccgacggtccgtaccggaaggggtacggggcgttgggaggtcgggtacctcgtagttagttcggtggttacggtggtggttacgaccaactagttaacgtaccgacgtaacgtaccgttaaaccgggtaaaccgggttccggttaccgacctacgttcccaaccgaaggaaacctaacttaaacgttacccgaaagtaaccgtcggtattaagttcagacgtagagtacgaacacgctaggacggaccgcggaaacggtccgttaaccggtttatttactacgngggttaacgaaacgtaaacgcccgttagttcgggtttaggtcgggtttacggtactaaaccggttgttaccgggggtacacggtttccggggagggtaacccccg

SEQ ID NO: 75993 - DNA, 565 bp, Homo sapiens
  misc_feature: GYAE6OF01D3HMK.5.73.G07.1.454.CMB.1.raw
  modified_base (302)..(302): a, c, t, g, unknown or other
  misc_feature (302)..(302): n is a, c, g, or t
  modified_base (359)..(359): a, c, t, g, unknown or other
  misc_feature (359)..(359): n is a, c, g, or t
  modified_base (450)..(450): a, c, t, g, unknown or other
  misc_feature (450)..(450): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (481)..(481): a, c, t, g, unknown or other
  misc_feature (481)..(481): n is a, c, g, or t
  modified_base (491)..(491): a, c, t, g, unknown or other
  misc_feature (491)..(491): n is a, c, g, or t
  modified_base (514)..(514): a, c, t, g, unknown or other
  misc_feature (514)..(514): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcgttttctaggtggctaattttaaaaggtgtccattgtgaggtgcagttgttggagtcgtgggggaggcttagtacagcctgggggtccctgagactctcctgtgcagcctcgtggattcacctttgacaactatgccatgagcttcgggccncgaggctccgaggggaagggctgggagtgggtctcgagttatcgtgggtagtggtgngcacatactacgcagacgtaccgtaaaggcccgttcgcctatccgtaccgagtaacgtacaaacttcccgaaagaacgtacggtgtactcnggacagatagaacngcngagacgcgtagacncgtcgtttanacgtgagaccgaaagcctcgttntggggttcggtggttactaacgtacgttggttacacgtgggcgggtacccg

SEQ ID NO: 75994 - DNA, 797 bp, Homo sapiens
  misc_feature: GYAE6OF01A6SP3.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagccgtggggggtccctgagactctcctgtgcacgcctctggattcacctttgactaactatgccatgagcgtgggtcccgccgaggccgtccgaggggaacggggcgtgggaggtgggtctcgtagtttacgttcggttgggtacggtgggttgggtcgacccgtaactaacgtaaccgtaaccgcgtaacggtacccgttacccgggtaaaacgggggtccccggttaccggacccgtacgttccctacccgaaaggaaccgaacctaaacgtttacccgaaaaggtaaaccgtacgggttagtacttaccgtggacctaagtacgtacggaaacaacgggtacgtaggaacggtaacggacccgggaaacgggaacccgttaaccggggtttaccccggtttttaattaaaccggttcgggaaaccggtaaccgggaaaaaacggtaccccttaaccggttccggttaagggggtttcggggggttaccggggttttagtaaaacccgttaaccgggtttgggggtttaacccggtacccggtttccggggggtcggggggtaaacccccggg

SEQ ID NO: 75995 - DNA, 697 bp, Homo sapiens
  misc_feature: GYAE6OF01B7Q0F.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctattttaaaaggtgtccattgtgaggtgcagttgttggagtcgtgggggaggtcttagtacagccgtggggggtccctgagactctcctgtgcagcctctggtacttcctacctttgacaactatgccatgacgcgtcgggtcccgccgacggcctccgaggggaacggggcgtgggaggtgggtctacgtagttacgttcggtggttaggtggtggtcgaccgtactacgtactacgcaacggtaccgtaccgggtaaacgggtcccgttccgacctactcctacccgaagacgtaacctaacttacccgaaaagtaaccgtacgggttacgttaactccgtaggaccaagtaactcggaaacacgtaccgtaggacgaccggccggtaaggacccgtacgggtttaccttttataccgtgtacggaccgaaaagtcccgtaaccgttggttacggggttcggggttaggtttacgtaaacccgtaacggtttcggggttaaccgtacggttcggggtccgggggtaaacccgg

SEQ ID NO: 75996 - DNA, 729 bp, Homo sapiens
  misc_feature: GYAE6OF01BJ348.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttaattttaaaaggtgtccattgtgaggtgcagttgttggagtcgtgggggaggcttagtacgagccgttggggggtccctgagactctccgtgtgcagcctctggattccacctttgacaactatcgccatgaggctcggggtccgcgacggctccggaagggaaggggctgggaggtgggtcgtcgtaggttagttcggtgggttagtgggttggtcgccgaactacgtaaccgtacgccaacggtaccgttacccgggtaaaaggggtccccggttccggaccctacgttcccgtacccgaaggaacgtaacctaaacgtttaccccgaaaacggaaaccggtaaccgggtagttaaccgttcgttaggacccaaggtaacgtaacgaaacgtacgcccgttaaggaacggacgacccgggaacggtaccgtaacgggttccgttttaacttacgtgtacggacgaaaaacgtcccgtaaccgttcgttagggttcggggtgggtttagttaaccgtaaccggttcgggttaccgaccggtttcgggtcgggggtaaccccggg

SEQ ID NO: 75997 - DNA, 604 bp, Homo sapiens
  misc_feature: GYAE6OF01D5A1T.5.73.G07.1.454.CMB.1.raw
  modified_base (460)..(460): a, c, t, g, unknown or other
  misc_feature (460)..(460): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagccgtggggggtccctgagactctcctgtgcagcctctggattccacctttgacaactatgccatgagcgtggtccgccaggctccgaggggagggctgggagtggtctcgagttagttcgtggtagtggtggtcgcacatactacgcagacctacggtaaacgggccgttcgcctatcctaccgagagaactaacttacccaaagtaaccacgggtatatcgtgcaggactagaacngcctaggaacgacggaccgaggtaccacgggttacctttaatacgtggtagaaccggaaagtaccctaccgttgtaggggttggggttacgggttactaaccgtaacggttcgggtaccggtaccgtcggggtcggggacccgg

SEQ ID NO: 75998 - DNA, 694 bp, Homo sapiens
  misc_feature: GYAE6OF01CL5IK.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggtctattttaaaaggtgtccattgtgaggtgctagttgttggagtcgtgggggaggcttagtacagtccgtgggggtccctgagactctcctgtgcagcctcgtggactttcctacctttgaacctaacttatcgccatgagtcgtcgggtcccgcgacggccgtaccggaggggaagggtcgtgggaggtgggtctcgtagttagttcggtggtagtggtggtcgccatatacacgcagtacctacgggtaacggtccggttaccgctactcctaccagacgaactaacttacgaaagtaacgtacggttagtactccgtagaccaagtactaacgaacgacgtcgtaagacggtacggacccggaaggaacccgtaccgggttaccgttttaagtccggttagggtacgtaaaccggtaaacgtacccgtaaccgttcggttacggggttaggggtttcggttaacggttaaacccgtaacggtttacgggttaccgtaaacccggttcggggaaccggggtaaccccgggg

SEQ ID NO: 75999 - DNA, 732 bp, Homo sapiens
  misc_feature: GYAE6OF01BXA3H.5.73.G07.1.454.CMB.1.raw
  modified_base (513)..(513): a, c, t, g, unknown or other
  misc_feature (513)..(513): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctattttaaaaggtgtccattgtgaggtgcagttgttggagtcgtgggggaggcttagtacagccgtgggggtccctgagactctcctgtgcagcctctggattccacctttgactaactatgccatgacgcgtgggtcccgccgacggcctccggaggggaagggccgtgggaggtgggtctcgtagttagttcggtggtagtggtggtcgccacgatacgtacgcgacgtaccgtaccggtaaacgggcccgttcgcctacttcctaccgaagaacgtaacctaaacgttacccgaaaaggaaccgtacggttaggttaactccgtaggacaaggtaactacggaaaccncggtaccctagggaacggaacggacccgggaagggtaacccgtaccgggttacccgttttaacgttaccggttaggtacggaaccggtaaaaaccggacccgttacccgttacggttacgggggttcgggggttacggggttttaaccgttaaacccggtaaacggttttcggggttaaccggtaccggtttccgggggtccgggggtaaacccccggg

SEQ ID NO: 76000 - DNA, 693 bp, Homo sapiens
  misc_feature: GYAE6OF01BECTV.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgtttctagtggctatttaaaggtgtccattgtgaggtgctagttgttggagtcgtgggggagtcttagtacgagccgtgggggtccctgacgactcgtcctgtgcagcctctggtattcctacctttgaactaactatcgacctagtgacgtccggtcgggtcccgccgacgggtccgtaccggaaggggtaagggtccgtgggaggttcgggtctacgtaggtttacgtttcgggtggttaggtggttcggtcgacccgtataactaccgtacggacaacggtaccgtaccgggtaaacggtcccggttaccgcctacgtcctaccgaaggaacgtaaccgtaacttacccgaaaagtaaccgtaacgggtatacgttacgtacgccgtaagtacgtacgaacgtacgacgttacggaacggtacggaccggaacggtacccgtaacggttcctttaagtccgtaggtaccgtagaaaccgtcgtaccgttgtggttcgggttgtacgtacgtacgttcgtacggacgtcgggcggtaccggg

SEQ ID NO: 76001 - DNA, 608 bp, Homo sapiens
  misc_feature: GYAE6OF01AH7VA.5.73.G07.1.454.CMB.1.raw
  modified_base (460)..(460): a, c, t, g, unknown or other
  misc_feature (460)..(460): n is a, c, g, or t
  modified_base (467)..(467): a, c, t, g, unknown or other
  misc_feature (467)..(467): n is a, c, g, or t
  modified_base (482)..(482): a, c, t, g, unknown or other
  misc_feature (482)..(482): n is a, c, g, or t
  modified_base (517)..(517): a, c, t, g, unknown or other
  misc_feature (517)..(517): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgttttctaggtggctatttaaaggtgtcattgtgaggtgctgttgttggagtcgtggggagcttagtacagccgtgggggtccctgagctctcctgtgcagcctcgtggattcacctttgacaactatgccatgagctcgggtcccgaccgaggtcctccgaggggaagggtcgtgggagtgggtctcgtagttgttcggtggtagtggtggtcgcacagtactacgcgagtaccgtaccggtaaacgggtccgttacgcctactccgtacccgaagacgaactaacgttaccaaaggtaacctacgggtntacgtcnggaccagctacgaancgtcagacgcggcgaagccgacgttccttatacgngtacacggaaatcccgtacgttacggtgggttcggggttacgttacgtaacgtacggttccggttaagccgttcggggacgggtacccggg

SEQ ID NO: 76002 - DNA, 726 bp, Homo sapiens
  misc_feature: GYAE6OF01BVPGJ.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttattttaaaaggtgtccattgtgaggtgctagttgttggagtcgtggggagtcttagtacagccgtgggggtccctggagactctcctgtcgcacgcctcgttggtattcctacctttgaacctaacttatcgaccaagttggacgtcgttcggggtccccgaccgacgggtccgtaccggaaggggaacggggtcgtcgggagttcggggttctacgttagtttagttcggttaggttaggtggtggttcggaccctacgactaaccgtacggacaacggtaccgtaccggtaaacggggtcccgtttacgacccgtaacgttccgtacccgaaggtaaccgtaaccgtaaactttaaccccgaaaaggtaaacccggtaacgggtttagttaactacggttacgaccgtaagtaacgtagaaaccgacgtaccgtaggaacgtacgaccggaacgaccgtacgttacgttatacgtgtacgacgaaacgccgtacgtgtaggtcgggtaggttcgtaacgtacgttacgggtaccgtacgttcggggtaccggtacccggg

SEQ ID NO: 76003 - DNA, 649 bp, Homo sapiens
  misc_feature: GYAE6OF01EBACV.5.73.G07.1.454.CMB.1.raw
  modified_base (328)..(328): a, c, t, g, unknown or other
  misc_feature (328)..(328): n is a, c, g, or t
  modified_base (429)..(429): a, c, t, g, unknown or other
  misc_feature (429)..(429): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggcttttcttgtggctatttaaaaggtgtcattgtgagtgcagttgtggagtctggggagcttagtacagcctgggggtccctgagactctcctgtgcagcctcgtggattcacctttgacaactatgccatgagcgtgggtccgccaggctccgaggggaagggctggagtgggtctacgngttatcggtgtagtggtggtgccacatacgtacgcagactaccggaaaggtcccggttcgcctaatctccgagagacaattcccaaagaaccgtacgggtntatcgttgactagatacgaacacgaccgttggaagacggacccgggagggaacccgtaccgggttacccgttttaagtttaccgtggttacgggaccggtaaaaacgtacccgaacccggtttgttacggggttcgggggttacggggtttacgttaacccgtaaaccggtttcggggtttaaccggtaccgtttccggggtacggggggtaacccccgg

SEQ ID NO: 76004 - DNA, 584 bp, Homo sapiens
  misc_feature: GYAE6OF01B2S3C.5.73.G07.1.454.CMB.1.raw
  modified_base (299)..(299): a, c, t, g, unknown or other
  misc_feature (299)..(299): n is a, c, g, or t
  modified_base (410)..(410): a, c, t, g, unknown or other
  misc_feature (410)..(410): n is a, c, g, or t
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagccgtggggggtccctgagactctcctgtgcagcctctggattcaccttttgacaactatgccatgagctgggtccnccgaggctccgaggggaaggggctgggagtgggtctcgtagttattcggtggtaggtggtggtcgccacatactacgcagacctaccggtaaaggcccggttcgccatccnccagagacaattccaaagacacggtntatctgcagatgaacngctaggagacgccggaggaccacgggtcctttatacgtgtacgacgaaacgtccgaccttggttcgggtggggttacgggttacgtaacgtaacgttcgggttacccgacgttcggggtcggggtaacccgg

SEQ ID NO: 76005 - DNA, 641 bp, Homo sapiens
  misc_feature: GYAE6OF01BM3X6.5.73.G07.1.454.CMB.1.raw
  modified_base (499)..(499): a, c, t, g, unknown or other
  misc_feature (499)..(499): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctattttaaaaggtgtccattgtgaggtgtcggttgttggagtcgtgggggaggcttagtacagccgtgggggtccctgagactctcctgtgcagcctctgattcacctttgactaactatgccatgacgcgtcgggtcccgccacggcctaccggaggggaacggggcgtgggaggtggtctcgtagtttagttcggtggtagtgggtggtcgccacacgtactacgacgacgtaccgtaccggtaaacgggtcccggttcgacccattcccgtaccgagaacgaaccttaataccgaaacgtaacgacgttcgtactctagacagtagtacaacgngccgtagacgacgaccggaggtacgtaccggttacgtttacgttaccgtagggtacgacggtaaacgacgtcccgttggtggtacggggttgttacggtactacggtcggttacgtacggtcggtggggacccgtaaccggg

SEQ ID NO: 76006 - DNA, 733 bp, Homo sapiens
  misc_feature: GYAE6OF01AYXJ4.5.73.G07.1.454.CMB.1.raw
  modified_base (546)..(546): a, c, t, g, unknown or other
  misc_feature (546)..(546): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcgttttctgtggctaattttaaaaggtgtccattgtgaggtgcagttgttggagtcgtgggggaggcgttagtacgagccgtgggggtccctgagactctcctgtgcacgcctctggacttcacctttgactaactatgccatgagcgtcgggtccgccgaggcgtccgaggggaacggggcgtagggacggtgggtcgtcgtaggtttagttcggtgggttaggttgggtggttacgcccaacgtataaccgtacgtcgaacgtaccgttacccgggtaaaaggggtccccggttcgacccgtaacttcccgtaccgaggaacgtaaactaaccttaccgaaacgaaccgtaacgggttagttaactcgtacggacctaaggtaactaggaaaccnggtacccaggaacggaccggaccgggacgggaaccgtaacgggttacccggtttaattaccgtagggtacggaacgtaaaacgtcccgtaccgttggttgggggttcgggtttacgggttacgttaaaccgttacggtttacggggtacccggaaccggtttcgggggtcccggggtaaaccccggg

SEQ ID NO: 76007 - DNA, 591 bp, Homo sapiens
  misc_feature: GYAE6OF01C2K1O.5.73.G07.1.454.CMB.1.raw
  modified_base (448)..(448): a, c, t, g, unknown or other
  misc_feature (448)..(448): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctaattttaaaaggtgtccattgtgaggtgctagttgttggagtcgtgggggaggcttagtacagccgtggggggtccctgagactctcctgtgcagcctcgtggattctacctttgacaactatgccatgagcgtgggtccgccaggctccgagggaaggggctggaggtggtctcgtagttagttcgtggtagtggtggtgccacatacacgcacgactaccggtaaacgggccgttcgcctatcctaccagaagacaacttcccaaagaactacggtgtacttcngacagatacgaacagccgtagagacgccgaggacacggtaccgtttatacgtgtcgacgtaaacgaccgtacctgtggtggggttacgggttagtaaccgtaacggttgggttaccgaccgttcgggtcgggggtaaccccgg

SEQ ID NO: 76008 - DNA, 743 bp, Homo sapiens
  misc_feature: GYAE6OF01DLJY3.5.73.G07.1.454.CMB.1.raw
  modified_base (177)..(177): a, c, t, g, unknown or other
  misc_feature (177)..(177): n is a, c, g, or t
  modified_base (261)..(261): a, c, t, g, unknown or other
  misc_feature (261)..(261): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcttttctgtgctatttaaaggtgtcatgngaggtgcagttgttggagtcgtgggggagcttagtacagccgtgggggtccctgagactcctcctagtgcagtcctgttcggtnttccaccttttcgaacctaacttactcgaccagttcgacgtcgtcggggtccgccgaggcctaccggagggggaacggggcgttgggaggtgggttctacgtgttagttcggtggtagtggtggtcgaccgactacgtaaccgtacgacgaacgtaccgttacccgggtaaacggggttcccggttaccggtaccctacgttaccttacccgaagaacgtactaaacgttacccgaaaagaaccgtacggttacgtactcgtacgtacgaaggacgttacgaaacgcgtaccggtagaacggaaccggtcccgggaaacggtaccgtaacccggggtttaccttttaacgtttaccgggtacgttacggaaaccggtaaacgtacccgtacgttccgggtttaggggttaggggtttcggggttaacttaccgtacgggtttcgggttaccggtacgttccgggggtacgggtaaccccggg

SEQ ID NO: 76009 - DNA, 731 bp, Homo sapiens
  misc_feature: GYAE6OF01BIUY4.5.73.G07.1.454.CMB.1.raw
  modified_base (427)..(427): a, c, t, g, unknown or other
  misc_feature (427)..(427): n is a, c, g, or t
  modified_base (505)..(505): a, c, t, g, unknown or other
  misc_feature (505)..(505): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgttttcttaggtggctattttaaaaggtgtccattgtgaggtgcagttgttggagtcgtgggggaggcttagtacagccgtgggggtccctgagactctcctgtgcagcctctggattcacctttgacaactatgccatgagcgtcgggtccgccgaggcctccgaggggaacggggctgggaggtgggtctcgtagtttattcggtggtagtggtggtcgccacgatacgtacgcagaccgtaccggtaaacggggtcccggttcgacccgtatccnccgtaacgacgtaactaaacttaaccccgaaaggaacctacgggttataacttcgtacgacaagtaatacgaaaccgngtaccccgttagggaaacgaccggaccgggtaaccgggaaccgtacccgggtttaccgttttaacgtttaaccgtggtacggaccggtaaaaacggtacccgtacccgtttacggttacggggtttcggggggttacgggttttacggtaaaacccgtttaccgggtttacgggtttaacccggtaacccgggtttcgggggtaccggggggtaaaccccccgggg

SEQ ID NO: 76010 - DNA, 636 bp, Homo sapiens
  misc_feature: GYAE6OF01EGMJW.5.73.G07.1.454.CMB.1.raw
  modified_base (298)..(298): a, c, t, g, unknown or other
  misc_feature (298)..(298): n is a, c, g, or t
tcagatcagacacgcacgaccggtgctcgatttagctctacgctcaggggtctgagagaggagcccagccctgggattttcaggtgtttcatttggtgatcaggactgaacagagagaactcaccatggagtttgggctgagcgtggcttttctgtggctatttaaaaggtgtccattgtgaggtgcagttgttggagtcgtgggggaggcttagtacagccgtgggggtccctgagactctcctgtgcagcctcgtggattcacctttgactaactatcgccatgagcgtgggtccnccgaggctccgaggggaagggctgggagtgggtctcgtagttagttcgtggtaggtggtggtcgccacgtatactacgcgagaccgtaccggtaaaggggcccggttacgcctaagtcctacgagaagaacctaagttacccaaaggaaccgtacgggtagtaactccgtgaccaagtactacggaacagaccgttaggaacgtacggaccggaaggtaccacgggttaccgtttaatacgtgtacgacgtaaacgccgtaacccgttgtgggtacggggttggttacgaacgtaacggttcgggttacccgacggttccgggtcggggtaaccccgg

SEQ ID NO: 76011 - DNA, 697 bp, Homo sapiens
  misc_feature: GYAE6OF01AEDSD.5.73.G07.1.454.CMB.1.raw
  modified_base (263)..(263): a, c, t, g, unknown or other
  misc_feature (263)..(263): n is a, c, g, or t
  modified_base (524)..(524): a, c, t, g, unknown or other
  misc_feature (524)..(524): n is a, c, g, or t
tcagatcagacacgcacgaccggtgctcgatttagctctacgctcaggggtctgagagaggagcccagccctgggattttcaggttgttttcatttggtgatcaggactgaacagagagaactcaccatggagtttgggctgagcgtggtcgttttctaggtggcttaattttaaaaggtgtccattgtgaggtgctagttgttggagtcgtggggagcgttagtacagccgtgggggtccctgagactctctgtgcagcctntggtattcacctttcgacaactatcgccatgacgcgttcgggtccgccgaggcctccgaagggggaaggggtcgtagggacggtgggtcctacgtagtttacgtttcggtaggttaggtcggtggtacgcaacgtactacgtacgcacggtaccgttaccgggtaaacgggtccgttacgcctagtccctcgaagtacgaacctacttacccgaaagtaaccgcgggttatactacgtagactaacggaattcggaaaccnggtaccctgggaaccggacgcccgggaagtaccgtaacgggttaccctttaagtccgtaggttaccgaaccgtaaaggacccgtccgttggttaggggtcgggtttacgggttaactaaccgggttaacgtttcgggtacccggttacggttcgggtcggggtaaaccccggg

SEQ ID NO: 76012 - DNA, 582 bp, Homo sapiens
  misc_feature: GYAE6OF01DE3KD.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtctttttcttgtggctaattttaaaaggtgtccattgtgaggtgcagttgttggagtcgtgggggaggcttagtacagccgtggggggtccctgagactctcctgtgcagcctctggattcacctttgacaactatgccatgagcgtgggtccgccaggctccgaggggaagggcgtggaggtgggtctcgtagttattcggtggtagtggtggtgccacatactacgcagacctccggtaaaggccggttcgccatcctccagacgaacaattacccaaagaaccacggtagtaatctgacagatagaacagcctggagacgaccgaaggacacggtcgtttaagtactgtacgacgaaagaccaccgttgtggttggggtcgggttagtaaccgtaacgttgggttaccgacgttcgggtggggtaccccgg

SEQ ID NO: 76013 - DNA, 769 bp, Homo sapiens
  misc_feature: GYAE6OF01DFIVR.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttctgtggctattttaaaaggtgtccattgtgaggtgcagttgttggagtcgtggggagcttagtacagccgtgggggtccctgagactctcctgtgcagcctctggattctacctttgacaactatgccatgagcgtgggtccgccaggctccggagggaaggggctagggagttgggtctcgtagttagtcggttggtaggttggtggtcgccactactacgtacgacacgtaccgtaccggtaaacgggtcccggtttacgcctaacgtccgttacccgaaggtaacgaacctaaactttacccgaaaaggtaaacccgtacgggttacgttaacttcgtacgtaccgaagtacgtacgaaaccgacggtaccgtacggaacggaaccggacccgggaaacgggtaaccgtaccggggttaacccggtttttaacgttaaccgttgggttaaccggaaaccggtaaaacggtaccccggttaaacccgttcggtttacgggggtttcgggggtttaacggggttttaccggtaaacccgtttaaaccgggtttccggggttttacccgggtaaacccggtttccgggggttacggggggtaaaccccccggggg

SEQ ID NO: 76014 - DNA, 582 bp, Homo sapiens
  misc_feature: GYAE6OF01EZL8A.5.73.G07.1.454.CMB.1.raw
  modified_base (411)..(411): a, c, t, g, unknown or other
  misc_feature (411)..(411): n is a, c, g, or t
  modified_base (460)..(460): a, c, t, g, unknown or other
  misc_feature (460)..(460): n is a, c, g, or t
  modified_base (543)..(543): a, c, t, g, unknown or other
  misc_feature (543)..(543): n is a, c, g, or t
  modified_base (571)..(571): a, c, t, g, unknown or other
  misc_feature (571)..(571): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctatttttaaaaggtgtccattgtgaggtgcagttgttggagtctgggggaggcttagtacagccgtggggggtccctgagactctcctgtgcagcctctggattcacctttgacaactatgccatgagcgtgggtccgccgaggccgtccgaggggaacggggcgtgggaggttgggtctcgagttattcggtggtagtggtggtgccacgatacgtacgcagactccggtaaagggccgttcgccatcnccagacgactaacttccaaagaactacggtatactctgcgagatgaacngacctgacgagccggtaagacacggtacgtttactacgtgtcgtacggaaacgccgaccgttggtggttggggttacgggttntaacgtacgttcggttacgcgttcgggnggggtacccgg

SEQ ID NO: 76015 - DNA, 622 bp, Homo sapiens
  misc_feature: GYAE6OF01AZM0C.5.73.G07.1.454.CMB.1.raw
  modified_base (301)..(301): a, c, t, g, unknown or other
  misc_feature (301)..(301): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctattttaaaaggtgtccattgtgaggtgctagttgttggagtcgtgggggaggcttagtacagccgtgggggtccctgagactctcctgtgcagcctctggacttcaccttttgacaactatgccatgagctgggtccncaggctccaggggaagggctggagtgggtctcgagttatcggtgtagtggtgtgcacatactacgcagactaccggtaaagggccgtcgccatcctccagagactaattccaaagacacggtntacnctncagatgaacagccgtagacggtagccggaaggaccgtacggttccgtttaagtccgttggtacggaaccgtaaacggaacctaccccgttgttacggggttcgggggggtttacggtttacggtaaccgttaaaaccgggttcgggttttaacccgggccgttttcggggccggggggttaaacccccggg

SEQ ID NO: 76016 - DNA, 634 bp, Homo sapiens
  misc_feature: GYAE6OF01A3029.5.73.G07.1.454.CMB.1.raw
  modified_base (462)..(462): a, c, t, g, unknown or other
  misc_feature (462)..(462): n is a, c, g, or t
  modified_base (474)..(474): a, c, t, g, unknown or other
  misc_feature (474)..(474): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagccgtggggggtccctgagactctcctgtgcagcctctggattcacctttgacaactatgccatgagcgtcgggtcccgccgaggcctccgaggggaaggggctgggaggtgggtctcgagttattcggtggtagtggtggtcgccacatactacgcacgtaccgtaccggtaaacgggcccggttcgcctatccgtccaagacgaactaattacccgaaagtaaccacggtgtactcgtnacagatagaacngcctgacgacggaccggaaggacctacgggtaccttttaagtacgttggtacgaccgtaaacgtaccctaccgttcggttagggtcgggggttagggtttacgtaaccgttaaccggttcgggtttaccgaccggttcggggtccgggggtaaccccggg

SEQ ID NO: 76017 - DNA, 585 bp, Homo sapiens
  misc_feature: GYAE6OF01CX39X.5.73.G07.1.454.CMB.1.raw
  modified_base (258)..(258): a, c, t, g, unknown or other
  misc_feature (258)..(258): n is a, c, g, or t
  modified_base (454)..(454): a, c, t, g, unknown or other
  misc_feature (454)..(454): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggagcttagtacagccgtggggggtccctgagactctcctgtgcagcctntggattcacctttgacaactatgccatgagctgggtccgccaggcctccgagggaaggggctgggagtgggtctctagttagttcggtggtagtggtggtgccacgatactacgcagactacggtaaaggcggttcgcatctcagagacaattccaagaacacggtgtatcgtgcagatacgaacagtcctagganaggccgagggaccgacggttacccgtttatttaccgtaggttacgaccggaaaggacctacccgtgtcgggttggggttagggttgttaacgtaacgttgggttactaccggtcggtcgggggtaacccgg

SEQ ID NO: 76018 - DNA, 948 bp, Homo sapiens
  misc_feature: GYAE6OF01DXJKG.5.73.G07.1.454.CMB.1.raw
tcagatcagacacgcacgaccggtgctcgatttagctctacgctcaggggtctgagagaggagcccagcccgtgggattttcgaggtgtttcatttggtgatcaggactgaacagagagaactcaccagtggagtttggctgagtctggtctttttcgtgtggtacttaagttttaaaaggtcgtacctagttggtggaggtgacgtaggtttggttggtacggttcggtgggggacggtcgttaaggtaacgcggtccggttcggggggtccctggtaacgtccgtccttccgtggtcgaccgtacgtccgttacgttcggtactttacccgtaccgttttacggaaaccttaaaccgttagtaccgtacccgtagtacggtacggtccggttacccgggggtacccgtacccggacggtacccggtacccgggaaggggaaccggggtccggtagggtacgggttcggttccgttacggttacggtttaacggtttcgggttagggttagggttcgggttacgggttaccgacccggtaacctaacgttaaccgtaaccggacgtaacggtaacccggttaccgggtaaaccgggttcccggtccgaccgtaccgtccgtaacgacgaacgtaaccgtaaccgttaaacgaaacgtaaccggtaacggtaggtactcggacgtacggaagtacgacggaacgtaccgaacccggtaggaaccggaccggtaacccgggtaacggtaaaccccggttaccgggtttaacccgtttaacggtttaaccgtaacgggttacgtaaacccgggtaaaacggtcccggttaaacccgttaggggttcgggttaacgggggtttaccgttaacgggttaacccggtttaaaccgggttcgggttaaccccggtaccgggttacccgggggaacccggggttaaaccccgggg

SEQ ID NO: 76019 - DNA, 634 bp, Homo sapiens
  misc_feature: GYAE6OF01D4O99.5.73.G07.1.454.CMB.1.raw
  modified_base (174)..(174): a, c, t, g, unknown or other
  misc_feature (174)..(174): n is a, c, g, or t
  modified_base (298)..(298): a, c, t, g, unknown or other
  misc_feature (298)..(298): n is a, c, g, or t
  modified_base (323)..(323): a, c, t, g, unknown or other
  misc_feature (323)..(323): n is a, c, g, or t
  modified_base (460)..(460): a, c, t, g, unknown or other
  misc_feature (460)..(460): n is a, c, g, or t
  modified_base (572)..(572): a, c, t, g, unknown or other
  misc_feature (572)..(572): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcttttctagtggctatttaaaaggtntcatgtgaggtgcagttgttggagtcgtgggggagcttagtacagccgtggggggtccctgagactctcctgtgcagcctctggtacttcacctttgactaactatgccatgagcgtgggtccnccgaggctcgaggggagggctaggngtggtctcgtagttagttcggtggtaggtggtgtcgcactatactacgacagtacgtaccggtaagggcccgttacgcctattccaccgagaacgactaacttaccgaaagtaacgtacgggtagttactaaccgtnaacgaggtaacttacggaaaaccgtcgtaccgtaaggaacggacggaaccccgggaaggtaccgtacgggttacttttactacgtagtaccggacgaaagtccctacgttgngggtttcgggtagggtttcaaaccggtagttcgggtacgaacggttcgggcgggtaacccgg

SEQ ID NO: 76020 - DNA, 761 bp, Homo sapiens
  misc_feature: GYAE6OF01BQGT0.5.73.G07.1.454.CMB.1.raw
  modified_base (281)..(281): a, c, t, g, unknown or other
  misc_feature (281)..(281): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgttttctaggtggcttaattttaaaaggtgtccattgtgaggtgcagttgttggagtcgtggggaggcttagtacagcgtgggggtccctgagactctcctgtgcagtcctcgtggtacttcctacctttanaacctaactatcgccatggacgtcgtcgggtacccgccgaggcctaccggaggggaggggcctgggacggtgggtactcgtgtttaagttcggtaagtggtggttggtcgacctacgaacttaccgtaccgacgtaacgtaccgtaccgggttaaaacggggtcccggtttacgaccctaacgttcccgtaccgaaggaacgtacctaaacgttaaccccgaaaacggtaacctaacggggtttactaactccgggttaacaccgtaagacggttaacgaaacgtacgtacgtacggaacggacgggacccgtaacggtaaccggtaccggtttaccgtttaagttccgttaagtacgggtaaaccgaaacgttaccgtacccgttaggttaggggttaccgggttggtttaacgtaaaccggttacggtttacgggtttaacccggacgtttcccggggggtaccgggtaaaccccggg

SEQ ID NO: 76021 - DNA, 673 bp, Homo sapiens
  misc_feature: GYAE6OF01B6550.5.73.G07.1.454.CMB.1.raw
  modified_base (386)..(386): a, c, t, g, unknown or other
  misc_feature (386)..(386): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcttttctgtggctatttaaaaggtgtccattgtgaggtgcgagttgttggagtcgtggggaggcttagtacagccgtgggggtccctgacgactctcctgtgcacgtcctcgtggtacttcctaccgttttcgaactaacttatgtcatggagcgtcgggtccgccgaggcctccggaaggggagggcgtgggaggtggtctcgtagttagttcggtggtaggtggtggtcgccganagtactacggacacgtacgtaccgggtaaacggtccggttaccgcctaacgttcccgtacccgaaggtaacgaacctaaacgttaccccgaaaagtaaccgtacgggtattaacgtcgtagactagaatacgaactcgaccgtagggaacgacggaccgggtaacggaactacggttacgggttaccgttttacgtacgtggtaccgaacgtaaaacggccttacccgttggttgggtcgggttagggttactaacgtagttcgggtacgtcggtcgggtaccgggg

SEQ ID NO: 76022 - DNA, 737 bp, Homo sapiens
  misc_feature: GYAE6OF01DPCPQ.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgttttctagtggctaattttaaaggtgtcattgtgagtgcagttgtggagtgtggggagcttagtacagccgtgggggtccctgagctctcctgtgcagtccgtctggacttcctacctttgactaactatcgaccatgagcctggtccgcaggcctacgagggaagggctgggagtgggtctacgagttagttcgtggtgtggtgtcgacacagttacaacgcgtacgaccgtaccggtaaaacgggtccggtttacccgacctaacgttcccgtacccgaacggaaccggtaactaaaaccgtttaaccccgtaaacggaaaaacccgttacggggtttaacggttaacgttccggttacgaccgtaagtaaccgttaagaaaccacggtaccctaagggacggaaccggaccggaacgggtaacccggaccggttaacccgttttacgttaacgtacgggtacgaaccggttaaaacgacccgttaaccgttcggttacggtttgggggttaccgggtttaagttaaccccgtaagtttacggggttcggtaaacccggttccggggttggggaaacccccgggg

SEQ ID NO: 76023 - DNA, 708 bp, Homo sapiens
  misc_feature: GYAE6OF01B9PHQ.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttaattttaaaaggtgtccattgtgaggtgctagttgttggagtcgtgggggaggcttagtacagccgtggggggtccctgagacctctcctgtgcagcctcgtggtacttctacctttgactaactatcgccatgacgtcgtcgggtccgccgacggccgtaccggaagggggaacggggcgtgggtaggtgggttctcgtagtttagttcggttgggtaggttgggtcggtcgtaccaacgtataaccgtacgacgtaacggtaacccgttaccggtaaaacggggtcccggttaccgaccctactcctaccgaagaacgtaactaacttaaccgaaacgtaaccgtacggttgtaacttcgtacgcgtaagatacgaaacacgtccgtagaacggaccggaccgggaaggaaccgtaccggttaccgtttaattaccgtaggtacgaaaccgaaacgacccgtaccgttcgtaggggttggggttacgggttacgtaacgtaacggttcgggttacgtacggttcgggtcggggtaaccccgg

SEQ ID NO: 76024 - DNA, 822 bp, Homo sapiens
  misc_feature: GYAE6OF01CH22Q.5.73.G07.1.454.CMB.1.raw
  modified_base (169)..(169): a, c, t, g, unknown or other
  misc_feature (169)..(169): n is a, c, g, or t
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (179)..(179): a, c, t, g, unknown or other
  misc_feature (179)..(179): n is a, c, g, or t
  modified_base (182)..(182): a, c, t, g, unknown or other
  misc_feature (182)..(182): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
  modified_base (277)..(277): a, c, t, g, unknown or other
  misc_feature (277)..(277): n is a, c, g, or t
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtgttctaggtcgctattaagntcatgngngngcngtgtgngngtgggagcttagacngccgtggggtcctgagctctctgcgcagcctgtggacttctaccttgactactatgcatgcgcgtcgggccncgagccacggagggacgggctgggnggtcgtctgtagttgtcggtggtggtggtcgcnccacgtactacgtacgacgtacgtacgtacgggtacggtccgtacgtctacgtccgtacgaacgtaacgtaacaaccgtaacgaaacgtaccggtacggttacgtacttacgtacgtacgtaacgtaacgtaaacggtaaccggtaacgggtaccggtaaccgggaaccgggtaacccggggaaacccggggtaaacccggggttaaacccggggtttaaacccccggggttttaaaccccgggtttttaacccgggttttaaaccgggtttaaccgggttaaacccgggtaaacccgggtaaaacccggttaaaccccggtttaacccggtttacccgggtttacgggggtttaccggggggttttaaccggggttttaaacccgggttaaacccgggtttaaacccggggtttaacccgggggtttaacccggggtttaacccggggttacccggggggttaaccccggggggtaaccccggggg

SEQ ID NO: 76025 - DNA, 867 bp, Homo sapiens
  misc_feature: GYAE6OF01D0UCC.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgttttctaggtggtctaattttaaaggtgtcctattgtgtaggtgctagttgttggagtcgtggggaggcttagtacagccgtgggggtcctgagcgtctcctgtgcacgcctctggtacttcctacctttgaactaactatgccagtgagccgttcgggccgccgaggtcctccggaaggggaacgggtcgtgggtaggttgggtcctacgtagtttacgtggttagggtaggttggtcggtcgacctaactacgttacgtacgctaacggtaccgtaaccgggtaaacggggtcccgggttcccgaccgttactacccgttaccgaacgaacggtaaccttaaaccttaaccgaaaacgtaaaccccggtagggtttacgttaaccgttacggttacgtaccgaaagtacgttaaaccgggaaactaaccgggttcccgtaagggaaacccgggtaacggtaccccgggggaacgggttaacccgttaaacccgggggttttaccccgtttttaaagtttaaccggtttccgggttaaaaccggaaaccccggtaaaaaggtacccccggtaacccggtttaggttttacgggggttaacccgggggggtttttaggtttaacccgggttaaacccgggttaccgggttttaaaccggggggtttccctaaaacccgggggggtttcccgggggttcccgggggtaaacccccggg

SEQ ID NO: 76026 - DNA, 833 bp, Homo sapiens
  misc_feature: GYAE6OF01CUEOS.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggtctaattttaaaaggtgtccattgtgaggtgctagttggttggagtcgtgggggagtcttagtacaggtccgtgggggtccctgagacctctcctgtcgcacgtcctcgtggtacttcctaccgtttgaacctaacttatcgaccaagtcggacgtccggtcgggtcccgccgacggtccgtccggaagggggaacgggtcgtagggtacggttcgggttctacgttaggtttagtttcggttagggttaggttgggttcgggtcgtacccgtaacgtaacgttaaccgtacggaccgtaacggtaacccgttaacccgggttaaaaccggggtcccggtttaccgcccgttacgttcccgtaaccgaacggaacgtaacctaaaccgttaacccgtaaaacggtaaccggtaaccgggttagttaacgttcggtacgtacgaagtaacgtaacgtaaaccgtacgtaccgtaacggaacggaacccggaccggtaacgggtaacccgttacccgggttaaccgttttacgtaaccggttacggtaacgtaaaccggtaaacgtacccgtaccgttacggttagggttacgggggttaccggtttaacgttacccgttaaccggtttacgggttaccggtcggttacccgggggtaccggggtaaccccggg

SEQ ID NO: 76027 - DNA, 650 bp, Homo sapiens
  misc_feature: GYAE6OF01B31TZ.5.73.G07.1.454.CMB.1.raw
  modified_base (143)..(143): a, c, t, g, unknown or other
  misc_feature (143)..(143): n is a, c, g, or t
  modified_base (162)..(162): a, c, t, g, unknown or other
  misc_feature (162)..(162): n is a, c, g, or t
  modified_base (168)..(168): a, c, t, g, unknown or other
  misc_feature (168)..(168): n is a, c, g, or t
  modified_base (175)..(175): a, c, t, g, unknown or other
  misc_feature (175)..(175): n is a, c, g, or t
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
tcagatcagacacgcacgaccggtgctcgatttagctctacgctcaggggtctgagagaggagcccagccctgggattttcaggtgtttcatttggtgatcaggactgaacagagagaactcacagtggagttggctgagcgntgttctagcgctattaagntcatgngagtgcngtgtggatcgagggatntagangtcgtgggtccngatctntctgtagcacgcctctaggacttcacctttagaacaactacgtacgtacgtacgtacgacgtacggtcggtaccgacgacggacgtacggacgggacgggtacggtaggtacggtacggtacgtacgtagttacgtacggtaggtaggtggtcggtacgtacgtacgtacgtacgtacgtacgtaacgtacgtaaccggtaacggtacggtaccgtacgtacgtacgtacgtaacgtaacgtaaccgtaaacgtaacgaaacgtaacgtaacgtaacgtaacgtacgtacgacgtaagtaacgtaacgaacgacgtacgtagacgacgaacggtacgacgtacggtacgttacgtacgtagtacgacgtaacgacgtacgtacgtaggtggttaggtacgtaacgtacggtacgtacgtcggtcggtcgggacgg

SEQ ID NO: 76028 - DNA, 870 bp, Homo sapiens
  misc_feature: GYAE6OF01BDBI2.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcgttttcttggtggctattttaaaaggtgtccattgtgaggtgctagttgttggagtctgggggagcgttagtacagccgtgggggtccctgagactctcctgtcgcgagcctctggtatttccaaccttttgaaccaacgttacttcgccctaatggacgtcggtccggggtacccgaccgacggtccgttaccggaaacgggggaacggggtccgtaggggtaagggttcggggttacgttaccggtaaggttttaactttccggggttagggttaacggttcggggtttacggtacgggtacccctaacgtaacgtttaccggttaaaccgaccggtaaggtaaacccggttaccgggttaaaacgggggtccccgggtttccgacccgttaattcccgtacccgaaagttaaccggaaccttaaaccggttaccccgtaaaaggtaaccgtaaccgggttagtaacgttcgtacgtacgtaagtataaacggaacgtacgtacccgtaaggtacgggaccggtaccgggaacggtaaccgtacccgggtttaccgtttacgtttaaccggtacgttacggtaaacccggtaaaaggtaccccgttaccggttaccggtaagggggtttcgggggttaacgggtttaacggttaaacggttaacgggtttaccgggttacggacccgggtttgggggtacccggggtaaaccccgggg

SEQ ID NO: 76029 - DNA, 748 bp, Homo sapiens
  misc_feature: GYAE6OF01D6V67.5.73.G07.1.454.CMB.1.raw
  modified_base (502)..(502): a, c, t, g, unknown or other
  misc_feature (502)..(502): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagccgtggggggtccctgagactctcctgtgcagcctctggtattccacctttgaactaactatcgaccatgacgtcgtcgggtcccgccgacggccgtccggaggggaaggggcgtgggaggtggggtctcgagtttagttcgtggtaggtggtggtcgcacagtacgtacgcaacgtaccgtaccggtaaacgggtcccgttcgacctactcctaccgagaacgactaaacttaccgaaagaaccgtacggtagtactcgtcgacgagtagtacgaacnggcctagaacggacggaccggaacgggtaaccgtaacccgggtttcccgttttaagttacccggttaggtaacggtaaacccggtaaaaaccggtaccccgtaaccccggtttaccgggtttacgggggttcgggggggttttacggggttttaacggttaaaaccccggttaacgggtttacggggtttaccccgggtaaacccggggtttcccgggggtaacgggggggtaaacccccccgggg

SEQ ID NO: 76030 - DNA, 675 bp, Homo sapiens
  misc_feature: GYAE6OF01ECGAL.5.73.G07.1.454.CMB.1.raw
  modified_base (233)..(233): a, c, t, g, unknown or other
  misc_feature (233)..(233): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcttttcttggtggcttaagttttaaaaggtgtccattgtgtaggtgcgtagtttggtggagtcggtgggggagtcttaagtacncgtccgggttcggggggtccctaggacgtacctccgttccgttggtcgacgtacgcccttcggtaggtacttaccgttaccgtttacgaacctaactagttcgacctagtcggacgtcggttcgggtcccgccgacgggtcctcgggaaaggggtacgggtcggtacggtgggtcggtctcgttaagttagtgtggtggtggtgtcgtactactacgtacgtacgacgtacgtacgtacggtacggtccggtccgtctactccgtacgacgtacgtacgtaactaacgaacgacgtacgtacgtacgtcgagacgagtacgacgacgacgcgagacgacgacgacgtacgtacgttacgttacgttcgtacgtacgacgacgtaccgtacgtaggtcggttcggtggttacgtacgtacgtaggtcggtcggtcgggtacgg

SEQ ID NO: 76031 - DNA, 730 bp, Homo sapiens
  misc_feature: GYAE6OF01BBBXU.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtctttttcttaggtggctaattttaaaaggtgtccattgtgaggtgcagttgttggagtcgtgggggaggcttagtacagccgtggggggtccctgagactctcctgtgcagcctctggacttcacctttgacaactatgccatgagctcgggtccgccaggctccgagggagggctggagtcgggtctctaggttattcggtggtagtggtggtcgcccaacgtacgttaaccgtaccggactaacggtaacccgttacccgggttaaaacgggggtccccggtttcgaccccgaatttcccgtaccaaggtaacgaactaacgtttacccgaaaagtaaccgtaaccggggtttgtaccttacgtcgggaccaaagtagtaccgaaacgacggtacccgtgggaaaccgacgggacccgggttaaggaacccggtaaccgggtttaccttttaaagttccggtaggtaaggacccggtaaaagacccgtaccggttgtaggggttccgggggtttaggttacgttaaaccaaccgggtttgggttaaaccccgcggttcggggttcgggggaacccccgg

SEQ ID NO: 76032 - DNA, 835 bp, Homo sapiens
  misc_feature: GYAE6OF01CB92X.5.73.G07.1.454.CMB.1.raw
  modified_base (267)..(267): a, c, t, g, unknown or other
  misc_feature (267)..(267): n is a, c, g, or t
tcagatcagacacgcacgaccggtgctcgatttagctctacgctcaggggtctgagagaggagcccagccctgggattttcaggttgttttcatttggtgatcaggactgaacagagagaactcaccatggaggtttgggctgagcgtggtctttttcttggtggtcttaagttttaaaaggtgtccattgtgaggtgcagttgttggagtcgtgggggaggtcgttagtacagccgtcggggggtccctgagacctctcctgtgcngcctctggattccaccgtttgaccaactatcgccatgacgtccgtcggggtccccgccgacgggtcccgtaccggaacggggggtaacggggcgttaggggacgggtttagggtccgttacgtaggttttaagtttcgggttgggttaggttggggttacggtcgacccgtaacgtacttaacccgtaaccggtaccgtaacggtaccggtacccgggttaaaacgggggtccccggtttacccgaccctacgttccccgtaccgaacgggtaacgtaaaccttaaacttacccgtaaaaacggtaaccttaacggggttttactaccgtaggtacgaacggtaataccggaaaccgtcggtacccggtaggaacgggtaccggacccgggaacggggtacccggttaaccgggtttaacccgtttttaagtaccgttaggtacgggaaaccggtaaactaccccggtcgttccgggtagggtttacgggggttaggtttaccggtaaccttaagggttccgggttaccgtaccgggttcggggtaccggggacccggtaacccgggg

SEQ ID NO: 76033 - DNA, 717 bp, Homo sapiens
  misc_feature: GYAE6OF01DAJL9.5.73.G07.1.454.CMB.1.raw
  modified_base (616)..(616): a, c, t, g, unknown or other
  misc_feature (616)..(616): n is a, c, g, or t
tcagatcagacacgcacgaccggtgctcgatttagctctacgctcaggggtctgagagaggagcccagccctgggattttcaggttgttttcatttggtgatcaggactgaacagagagaactcaccagtggtagtttgggctgagctggtctttttctgtggtcttaattttaaaaggtgtcctattgtgaggtgctagttgtggagtcgtgggggagtcttagtacaggtccggtcggggggtccctagacgtacctccgtccgtgtcgccgagtcccttcgtacggtacttacctaccgtttagaacctaacttatcgacctagtcggacgtccgttcgggccccgaccgacggccgtaccggaaggggtacgggcgtaggtaggtcggtctacgtagttagttcggtaggtaggtggtgtcgaccaacgtactaccgtacgacgtaacgtaaccgtaccgggtaacggtccgtaccaccgacttccgaaccaaggacctaacgaacttaccgaaaaggtaacctacgggttataacctcgtagacgtaagagtaccgaacgtacgcgtaggaacgaccggaccgggaacggtaccgtaccgttaccgtttanacggttaggacgtaaacgaaaccgtccgtaaccgttgggtgggttacgggtaggtataacccgtaggttcgggtaccgcggttcggggccgggtaacccgg

SEQ ID NO: 76034 - DNA, 613 bp, Homo sapiens
  misc_feature: GYAE6OF01EL4QH.5.73.G07.1.454.CMB.1.raw
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (338)..(338): a, c, t, g, unknown or other
  misc_feature (338)..(338): n is a, c, g, or t
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgtttctaggtcggctaattttaaaaggtgtccattgtgaggtgcagttgttggngtgtggggagcttagtacngccgtgggggtccctgagctcctcctgtgcngcctntgattcaccttgaccatatgcatcgncgtcgggccncgacggctccggagggaagggctgggacgtgggtcctgtagttntcgttagggtgtcggtgacncccgtanattaaccgcgactacggacctcggtaaacggccgggtttcaccgtactctacccgagaacgaactaacttacccaaagaaccgtcgggtattaactaccgtgacgtaagactacggaaacctgccctaaggacgtaacggccgaagacctacgggtaccttttagtaccgtggtacacggaaaactcgtacctcgagggttgggtaggttaagacctaacgttggtaactcgtcgggccgggtaaccg

SEQ ID NO: 76035 - DNA, 699 bp, Homo sapiens
  misc_feature: GYAE6OF01DUHE0.5.73.G07.1.454.CMB.1.raw
  modified_base (179)..(179): a, c, t, g, unknown or other
  misc_feature (179)..(179): n is a, c, g, or t
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (580)..(580): a, c, t, g, unknown or other
  misc_feature (580)..(580): n is a, c, g, or t
  modified_base (615)..(615): a, c, t, g, unknown or other
  misc_feature (615)..(615): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccagtggtagtttgggctggagcggtgtcgtttctaggtggactaatttaaaggngtcatgtgagtgntagttgtgagtgtggggagtcttagacngccgtggggtcctgngctctcgtgcgcncgcttctggtatttcctacgtttacaactaaacttgtcgacctagtgacgtccggttcgggtcccgaccgacggccgtaaccgggaagggggaccgggtcggtagggtagggtttcggtccgttacggttaggttttaacgttccgggttagggtagggttcgggtaggttcgtacccaagtacgttaacgtaccgtacgaacgtacccgtaaccggtaaacgggtccccgtcgtaccgtacttccgtacgagtaccgtaactaacgttaccgaaacgtaaccggtagtaggtaacttcgtacgacgtaagtagtacgaacgtacgacgganaccggacggaccgaacggtacccgtaaccggtttnttaacgacgtacgtacgacgtaacgtccgtacgtggtacgggttgtagtacgtacgtacggttcgacggtcgtgggccgtacgg

SEQ ID NO: 76036 - DNA, 679 bp, Homo sapiens
  misc_feature: GYAE6OF01EBMCX.5.73.G07.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
  modified_base (527)..(527): a, c, t, g, unknown or other
  misc_feature (527)..(527): n is a, c, g, or t
tcagatcagacacgcacgaccggtgctcgatttagctctacgctcaggggtctgagagaggagcccagccctgggtattttcaggttgttttcatttggtgatcaggactgaacagagagaactcaccagtggtagtttgggctgagcggtgtcgttctaggtcgactaattaaaggtgtcatgtgagtgntagtgtgngtcgtggggagtntagtacngccgtcggggtcctgagtcctctccgtgtcgcacgtcctgtagtacttctacttanaactaactgtcnccaagtggacgcggttcggtcccgaaccggtacggccgtaccgggaagggggacgggtcgtagggtaggttcggtactcggttaagtttagttcggtggtacggttggtcgtacgtcccaatacgtacgtacggactacgaccgttacggtaacgggtccgtacgacctacggtcctaccggaagtacgtaactaacgtacctaaaggtaactcgggtatacgtctagacctagtacganacgtacgtacgcggaacgccgacggaacgtaccgtacggtttacttatcgtagtacgcgtaaaaccgtcgtaccggttgtacgggtttggacgggttacgtaacgttcggttacccggtacggtaaccggtcgggtcggtaaacccccgggg

SEQ ID NO: 76037 - DNA, 654 bp, Homo sapiens
  misc_feature: GYAE6OF01BRTPG.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctattttaaaaggtgtccattgtgaggtgcagttgttggagtcgtgggggaggcttagtacagccgtggggggtccctgagactctcctgtgcagcctctggattcctacctttgacaactatgccatgagcgtgggtccgccgaggctccgaggggagggctgggagtgggtctgtagttagtcggtggtagtggtggtcgccacatactacgcacgacctacggtaacggccggttcgccatcctacagacgaactaactacccgaaagaaccgtaggttagtactcgtgactagagtacgaacgcgccgtaggaacggacggacccggtaacggtaccgtacccgggttaccgttttataaccggttggtacggaaccggtaaaacgtcccgtacccgttggtaggggttcgggggttcgggtttacgtaaacccggtaagggtttccgggttacggaccggtttcgggggtccgggggtaacccccggg

SEQ ID NO: 76038 - DNA, 619 bp, Homo sapiens
  misc_feature: GYAE6OF01B0VNW.5.73.G07.1.454.CMB.1.raw
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagccgtgggggtccctgagacctctcctgtgcagcctctggattctacctttgacaactatgccatgagctcgggtccgccgaggctccgaggggagggctgggagtgggtctcgagttattcgtggtgtggtggtgcacatactacgcagaccgtaccggtaaagggtccggttcgccatccctacagagacctaattcccaaagaactacgggtntaactcgtgactagactgaacngacctggaagcggaccgaaggaccgaccgggttccgtttaataccgtaggtacggaaccgaacggtaacctaccgttcgtagggttcgggggttagggttcgtaaaccgttaccgttggggttacccgacggtttccggggtcgggggtaaaccccggg

SEQ ID NO: 76039 - DNA, 575 bp, Homo sapiens
  misc_feature: GYAE6OF01EGABB.5.73.G07.1.454.CMB.1.raw
  modified_base (329)..(329): a, c, t, g, unknown or other
  misc_feature (329)..(329): n is a, c, g, or t
  modified_base (447)..(447): a, c, t, g, unknown or other
  misc_feature (447)..(447): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggcttattttaaaaggtgtccattgtgaggtgcagttgttggagtcgtgggggaggcttagtacagccgtggggggtccctgagactctcctgtgcagcctctggattcacctttgacaactatgccatgagctgggtccgcaggctccgagggagggctggagtggtctnagttattcgtggtagtggtgtgcacatactacgcagacctccggtaaaggcccggttacgcctactccgtccaggacgacaaattccaaagaacacggtagtatctgcagatagaacngccgtagagacgccggaacggacgtcggtaccgtttattacgtgtagacgaaacgacaccgttgtggtcgggttgggttacgtacgtaacgttacgggttaccgacgttccgggtggggtaccccggg

SEQ ID NO: 76040 - DNA, 670 bp, Homo sapiens
  misc_feature: GYAE6OF01CWSUG.5.73.G07.1.454.CMB.1.raw
  modified_base (260)..(260): a, c, t, g, unknown or other
  misc_feature (260)..(260): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttaattttaaaaggtgtccattgtgaggtgctagttgtggagtcgtgggggagcttagtacagccgtgggggtccctgagactctcctgtgcagcctntggattcacctttgacaactatgccatgagcgtgggtccgcgacggctccgagggaaggggcgtgggagtgggtctcgtagttacgttcgtggtaggttggtggtcgccgactaacgtaactacgaccgtacgaccgtaccggtaaaacgggtcccggttccggaccagtcctacccgaagtaacgtaaccaacttaccgaaacgaaacgtaaccggtgtaactcgtacgccgaagtactaacgaacaacgtctaaggacgaacggtaccggacggaaccgtaaccggtacccgtttagttaaccgttagtcgaaacggtaaacgaacgtacccgttacgttgggttacgggttgggttacgttacgtaaccgttacggttacggtacgtcgggtcgggtaaacccgggg

SEQ ID NO: 76041 - DNA, 820 bp, Homo sapiens
  misc_feature: GYAE6OF01BU6SD.5.73.G07.1.454.CMB.1.raw
tcagatcagacacgcacgaccggtgctcgatttagctctacgctcaggggtctgagagaggagcccagccctgggtattttcaggttgttttcatttggtgatcaggactgaacagagagaactcaccagtggaggtttggctgagctggtcttttcttgtggtacttaagttttaaaggtgtcctattgtggtaggtgcgtaggttggttggaggtcggtgggggaggtcttagtacgtacggtccggtcggggggtccctggtacgtacctcctccgtggtcgacgcgtccgtcgtcggtaacttccgtaccgtttacgaacctaaactagtcgtaccgtaagtcggacggtcggtccggggtccccggccggaacgggtcccgtaccgggaacggggggaacgggtcggtagggtagggttcgggttcgtacggttaaggtttacgtttcgggtagggttagggtgggttggtcgtacccgtaacgtacgtacgtaaccggacgtaaccggtaacccggttaacccgggtaaaccggggttcccggttaccgaccgtaacgttccctcccggaaagaaccgtaaccgtaaccgttaaaccgaaacgtacggtaccgttagtacgtacgtcgacgtaaagtacgtaacgaacgcgtaccgtagggaccgaacgggacccggtaagggtaccgtacggttaccgttagtaccggttagacgtaaaccgtaacgacgtcccggttggtcgggttggggtaggtttaccaacggtttaccggtacgggttaccgtacgggtccgggggtcgggtaacccgg

SEQ ID NO: 76042 - DNA, 631 bp, Homo sapiens
  misc_feature: GYAE6OF01D94YO.5.73.G07.1.454.CMB.1.raw
  modified_base (173)..(173): a, c, t, g, unknown or other
  misc_feature (173)..(173): n is a, c, g, or t
  modified_base (217)..(217): a, c, t, g, unknown or other
  misc_feature (217)..(217): n is a, c, g, or t
  modified_base (303)..(303): a, c, t, g, unknown or other
  misc_feature (303)..(303): n is a, c, g, or t
  modified_base (335)..(335): a, c, t, g, unknown or other
  misc_feature (335)..(335): n is a, c, g, or t
  modified_base (482)..(482): a, c, t, g, unknown or other
  misc_feature (482)..(482): n is a, c, g, or t
tcagatcagacacgcacgaccggtgctcgatttagctctacgctcaggggtctgagagaggagcccagccctgggattttcaggtgtttcatttggtgatcaggactgaacagagagaactcaccatggagtttgggctgagcgtgtcgttttctaggtggctatttaaaggngtcattgtgagtgcagttgttggagtcgtggggagcttagtacngccgtgggggtaccctgagtactctcctgtgcagcctctggacttcctactttgactaactatcgccatgacgccgtcgggtaccnccgaggtcctccggaggggaacgggtctgggngttgggtctcgtaggttagttccggtggtaggtggtcggtacgccaacgtatactaacggcaacgtacgtccggtaaagggtccgtcgacgtactctacgagaacgtacaacttacaagtaaccaggtgtactcgtgcagatagaancgacgtgaacggacgaccggtaaggacgtacgggtactttactaacggtcgtagaaccgtaaagtaaccgtccgtttacggttggggttacggttacgtacgtaacggttcggttacccgtaggtccgggtggggcccgtaaaccgggg

SEQ ID NO: 76043 - DNA, 627 bp, Homo sapiens
  misc_feature: GYAE6OF01EY9UQ.5.73.G07.1.454.CMB.1.raw
  modified_base (309)..(309): a, c, t, g, unknown or other
  misc_feature (309)..(309): n is a, c, g, or t
  modified_base (469)..(469): a, c, t, g, unknown or other
  misc_feature (469)..(469): n is a, c, g, or t
  modified_base (547)..(547): a, c, t, g, unknown or other
  misc_feature (547)..(547): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttctgtggctattttaaaagtgtccattgtgaggtgcagttgttggagtcgtgggggaggcttagtacagccgtgggggtccctgagactctcctgtgcacgtcctcgtggattcctacctttgacaactatcgcctatgacgtccggtcggtccgcnggcgtccgagggaaggggcgtgggaggtgggtcgtcgtagttagttcggtggttaggtgggtgggtgccgacgactactacgcacgacgtccgtaaacgggcccggttcgccgactctccgacgacgaacaaacttaccaacgaaactaccggtagtacntcgtcgacgacgtagtacgaacgacgtccgtacgaggaccggacggacggacgtaccggttacgttacgttacgtagngtaacgtacgtaaacgtccgtaccgttacggttacgggttacgggttacggttaacgttacggttaccggtcggttccgg

SEQ ID NO: 76044 - DNA, 733 bp, Homo sapiens
  misc_feature: GYAE6OF01EV3XQ.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttattttaaaaggtgtccattgtgaggtgcagttgttggagtcgtgggggaggtcttagtacagccgtggggggtccctgagactctcctgtgcacgcctctggtattcctacctttgactaactatcgccatgacgtcgtcgggtcccgccgacggccgtccggaagggggaaggggcgtgggaggtcgggtctgtaagtttagttcgggttaggttaggtgggtcggtcgaccctacgtataacgtaacgcgaacgtaacccgtaccggtaaacggggtcccggttaccgacctaacgtcctacccgaaggaacgtaacctaaacgtttaccccgaaaacgtaaccgtacgggttacgtacgttacgtggaccaaggtactaacggaaccgacgcccgttagggaacggtaccgggacccggtaagggaaccgtaccggttacccgttttaataccggtggtacggaaaccgaaaacggtacccgtaccgttgttcggggtgggtttacgggttactaaccggttaacgttcgggttaacgacccggttcggggtccggggtaacccgg

SEQ ID NO: 76045 - DNA, 945 bp, Homo sapiens
  misc_feature: GYAE6OF01B9SBV.5.73.G07.1.454.CMB.1.raw
  modified_base (275)..(275): a, c, t, g, unknown or other
  misc_feature (275)..(275): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttctgtggacttaattttaaagtgtcctattgtgaggtgctagttggttggagtcggtgggggaggtcttaagacgagtcccggtgggggtcccctggacgtacttccgtccgtgtcgaccgngtccctgtaggtacttcctaccgtttagaacctaacttagtcgtaccctagtcgacggtccggtcgggtcccgaccgacgggtccgtacccggaagggggtaacggggtccggtaggggtagggttcgggttcgtacgttaacgtttacggttaccggtttagggtaggtttgggttaccggtacggtacccgtaaacgtacgttaaaccccgtaaccggtaccgaacggtaaacccgtttaacccggggtaaaaaccgggggtccccggtttacccgaacccgtaccgttacccgtaacccgaacggtaacgaaacctaaaccttaaaccccggaaacggtaaaacccggttaacgggttacttaacccggttacggtacgtaaccgtaagtaaccggttaacgaaacccgttaaccggaccgttaaacggaaggggtaaccccggaaccgggtaaaccggtaaccccgggtttaaccgggttaacccggttttaaacgtttaaccggttaacggtaaaccgggaaaccgtaaaacggtaccccggttaaccgttaccggggtttacgggttacggggtttacggggttaacgttaaacccgggttacgggtttaaccgggttacccggtaaccgggttccggggtaaccgggggtaaaccccccgggg

SEQ ID NO: 76046 - DNA, 885 bp, Homo sapiens
  misc_feature: GYAE6OF01CQN9C.5.73.G07.1.454.CMB.1.raw
  modified_base (261)..(261): a, c, t, g, unknown or other
  misc_feature (261)..(261): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggtcttaattttaaaaggtgtccattgtgaggtgctagttggtggagtcgtgggggagtcttagtacagccggtcgggggtccctgacgactctcctgtgcngcctgtggtacttctacctttgaacaactatcgccatgagtcgtcgggtcccgccgaggccgtaccggaggggaacgggtcgtgggtaggttgggtcttacggtagttacgttcggtaggttacggttggtcggtcgacccgtaacgtactaaccgtaccggacgtaacggtaccgttaaccgggtaaaccggggtcccggttaccgaccgtacgtccgtaaccgagtaaccgtaacctaaacgttaaccccgaaaggtaaaccgtacgggttacgttaactaccgttaggaccgtaaaggtaacgttaaccggaaacccgtaccggtacccggtaaggaaccgggtaacccgggtaaccccggggtaacggggttaaaccccgttaaacccgggggtttttaaccccgtttttaagtttaacccgggttacgggtaaaccgggtaaaacccgggtaaaacccgtttaaccccggtaccccgggttttgggtttacggggggtttacggggggttttaccggggttaaaccgtttaaacccggtaaccgggggtttttacccggggttacccggttaaacccggggttcccggggggtaacccgggggttaaaccccccggggg

SEQ ID NO: 76047 - DNA, 782 bp, Homo sapiens
  misc_feature: GYAE6OF01DB2NJ.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggtcttaattttaaaaggtgtcctattgtgaggtgctagttgtggagtcgtgggggaggcttagtacacggccgtggggggtccctgagactctcctgtgcacgcctcgtggtacttctacctttagaacaactatcgccagtgacgtccggtcgggtcccgccgacggccgtaccggaagggggtaacggggccggttagggacgggttcgggttcgtacgttagtttaacgttcgggttgggttaggttgggttgggtcgacccgtaactacttaaccgtacgacgaacggtaccgttaccgggtaaaacggggtccggttaccgccgtactcctaccgaacgaacgtacctaaacgttacccgaaacggtaaccgtaacgggttacgttaacgttcgttacgacgtaagtaacgtaacgaaccgacgtccgtaacggaacggaccggaacccgggtaacgggtacccggtaccgggtttaaccgttttaacgttaacggttggtaacgggaaaccggtaaacgtacccgtaaccgttcggttaggggttcgggttagggtttacgtaacgttaacggttcgggttaccggtaccggttccggggtccggggtaacccggg

SEQ ID NO: 76048 - DNA, 710 bp, Homo sapiens
  misc_feature: GYAE6OF01A8XFF.5.73.G07.1.454.CMB.1.raw
  modified_base (306)..(306): a, c, t, g, unknown or other
  misc_feature (306)..(306): n is a, c, g, or t
  modified_base (516)..(516): a, c, t, g, unknown or other
  misc_feature (516)..(516): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgttttctagtggctaattttaaaggtgtcattgtgaggtgcagttgttggagtcgtgggggaggtcttagtacgacgccgtggggggtccctgacgctcctcctgtgcagcctctggacttcacctttgacaactatgccatcgagcgtcgggtccncgaggctccggagggaggggctgggagtcgggtcttcgagtttacgttggtggttaggtggtggttcgcctaacgtactaccgttacgacgtaacgtaaccgtaccggtaaaacggggtcccgttacggacctattccctaccgaagaccgtaactaaacgttacccaaaaggtaacgtaaccggttgtaacgtcgtacgagacggtaanacggaacgaacggccgtaaggaagacgggtaccgacggaaccgttacgggtaccgtttatacggtgtaacgacggtaaaagtaccccgtacgttacggttagggtcgggtttacggggttacgtaaaccgttaaccggtttcggggttaacccgggtttaccgttcccgggggttcgggggtaaacccccgggg

SEQ ID NO: 76049 - DNA, 884 bp, Homo sapiens
  misc_feature: GYAE6OF01A7CJ1.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggtcttattttaaaaggtgtcctattgtgaggtgctagttgttggagtcgtgggggagcttagacagccgtgggggtcctgagactctctgtgcagcctcgtgtacttctacctttgaactaactatcgccatgagcgtcgggtccgccgacggtcgtaccgaaggggaacggggcgtagggtacggttagggtccgtacgttaacgttttaagtttccggttaggggtttaagggtggggtttacggggtcgtaaccccgtaacgtaacgttaaccgttaaaccggtacgtaacggtaaacccggttaacccggggttaaaaaccgggggtcccgggttttacccgggaccctaacgttacccgttacccgaaacggtaacggtaaaccgtaaacgttttaaccccgaaaaaacggtaacccggtaaacggggttacggtttaaacgtccctttagggaccctaaaggtaacttacgggaaaacctaacggaccgttaacgggaacggaacggacccgggtaaacggggtaaccgttaacccggggttacccgtttttaagtttaaccgttcggggttaaccggaaacgggaaaaaccgtaaccggtaacccgtttagggttacggggtttacgggggttacggggttttaaccgtaaacccgttaacgggtttacggggttaacgtaacccggggtttcgggtccggggggtaaacccccggg

SEQ ID NO: 76050 - DNA, 953 bp, Homo sapiens
  misc_feature: GYAE6OF01CZZOU.5.73.G07.1.454.CMB.1.raw
  modified_base (178)..(178): a, c, t, g, unknown or other
  misc_feature (178)..(178): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggtctaattttaaaaggtntccattgtgaggtgctagttggttggaggtcggtggggggaggtcttaaggtacaggtcccggttggggggtcccctggacggtacctcctccgtggtcgacgacgtccgttcgtaggtacttaccgtacccgttttagaaacctaaaccttagttcgaccctagttacggacgtccggttaccgggggtccccgacccgacgggtcccgtaccgggaagggggtaaacgggggtccgttggggtacgggttcggggtttcctacggttaaggttttacgtttcgggttgggttaaggggttgggtttcggggacgtaccccgtaaacgtaacgttaacccgtaaccggtacgtaaacggtccccggttaaaccggggttaaacccgggggttccccgggttacccggaccctaaccgttcccgtacccggtaaacgggaacgtaaacccttaaaccgttaaccccgaaaacggttaaaccgggtaaccgggtttacggtttaaccttacggttacgaaccgtaaagtacgtttaacgaaaccgtaccggtccgtaagggaaacgggtaccggaccgggaacgggtacccgttaaccgggtttaccgttttaacgttacgtttacggtacggtaaaccggtaaacgtaccccggttacccgttaccgggttagggggtttccgggggtttaagggtttaacccgttaccggtaaacccgggtttcgggtttacccggtaccccgggttcggggttacccggggtaaaccccgggg

SEQ ID NO: 76051 - DNA, 688 bp, Homo sapiens
  misc_feature: GYAE6OF01CEF0J.5.73.G07.1.454.CMB.1.raw
  modified_base (259)..(259): a, c, t, g, unknown or other
  misc_feature (259)..(259): n is a, c, g, or t
  modified_base (442)..(442): a, c, t, g, unknown or other
  misc_feature (442)..(442): n is a, c, g, or t
  modified_base (503)..(503): a, c, t, g, unknown or other
  misc_feature (503)..(503): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttaattttaaaaggtgtccattgtgaggtgctagttgttggagtcgtgggggaggcttagtacaggccgtgggggtccctgacgactctcctgtgcngcctgtggacttctacctttgacaactatgccatgacgtcgtcgggtcccgccgacggcctccggaaggggaaggggctgggtaggtgggttctcgtagtttagttcggtggttaggtggttgggtcgcccaacgatacgtaccgctaaggaccgtacccgggtaaacgggtcccggttaccncctatccctaccgagtacgaactaaacttcccgaaaagaaccgtacggtgttaatccgtancaaggtataacgaaccgtagaccgtagaaggacggacccgggtaaggaacccgtaacgggttaccctttaattccgtaggtacgaaacggtaaacgtacctaccgtttggtggttcgggggttagggttactaaaccgtacggtttacgggttacgaccggttccggggtcggggtaaccccggg

SEQ ID NO: 76052 - DNA, 881 bp, Homo sapiens
  misc_feature: GYAE6OF01BNZ1M.5.73.G07.1.454.CMB.1.raw
tcagatcagacacgcacgaccggtgctcgatttagctctacgctcaggggtctgagagaggagcccagccctgggattttcaggtgtttcatttggtgatcaggactgaacagagagaactcaccagtggtagttgggctgagtcgtggtctttttcgttggtggtacttaaagttttaaaaggtgtacctagttggtggtaggtgcgtaggttggttgggaggtcggtggggggacggtcttaggtacgaggtccggtcggggggtccctggacgtaccttcctccgtggtcgaccgtacgtccttcggtcggtactttcctaaccgttttagaacctaaaccttagtcgtacctaagtcggtacggtccggttcggggtacccgccgaacggggtccgtacccgggaaggggggtaacggggtccgtaggggtacggttcgggtcgttacggtaagtttacgttcgggttgggtaggtgggttggtcgtacccgtaactacgtaccgtaacgtacgaacgtacccggttaaaccgggtaaacggggtcccggttaccgaccgtaacgttcctaacccgaaggtaacgtaaactaacgttaaccccgaaagtaaaccggtacggtagttacgtcggtacgacgtaacggtaactacggaaccgtacgaccgtagggaacggtacccggaaccgggtaacggtaacccgttaccggggtttaacgtttacgttacggtaacggtacgggaaacccgtaaaagtccccgttacggttacggtttaggggttcgggggttaccggttaacggttaaacggttaccgggtttacggggtacccggtaaccgggtttcgggggaacccggggttaaaccccgggg

SEQ ID NO: 76053 - DNA, 690 bp, Homo sapiens
  misc_feature: GYAE6OF01E43O2.5.73.G07.1.454.CMB.1.raw
  modified_base (175)..(175): a, c, t, g, unknown or other
  misc_feature (175)..(175): n is a, c, g, or t
  modified_base (179)..(180): a, c, t, g, unknown or other
  misc_feature (179)..(180): n is a, c, g, or t
  modified_base (205)..(205): a, c, t, g, unknown or other
  misc_feature (205)..(205): n is a, c, g, or t
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
tcagatcagacacgcacgaccggtgctcgatttagctctacgctcaggggtctgagagaggagcccagccctgggattttcaggttgttttcatttggtgatcaggactgaacagagagaactcaccatggagtttgggctgagcggtgtcgtttctaggcgctaatttaaaggncatnnagtgcagttgtgagtcgtggggagnttagacagccgtggggcctgganctctcctgngcagcctntggattctacctttagaactaaacttgcgccagtcgacgtcgtcgggtaccnccgaggtccctacgggagggaaggggtcctgggagttcgggtacttcgtaaagttgttacgggtggttaggttcggtgtcgaccgtactattacgacgcgaagtaccgtacgggtaaacggtccgtacgacacgttcaccgaagacgtaaactacgtacaaacggtaacgtcgtagtactcgtagacgtaagagtaacgaacacgccgtgggaacgtaccggaccgggtaacgtaaccggtacccgtttaacgtttaacgttacggcggttaaccggaacggtaaaaactcccgtaccctttagggttagggttaccggggggtttagtacggttaaccgtaaccggtttgggttaaccccggacggttaccggggtccgggttaaacccggg

SEQ ID NO: 76054 - DNA, 837 bp, Homo sapiens
  misc_feature: GYAE6OF01DKROQ.5.73.G07.1.454.CMB.1.raw
tcagatcagacacgcacgaccggtgctcgatttagctctacgctcaggggtctgagagaggagcccagccctgggtattttcaggttgttttcatttggtgatcaggactgaacagagagaactcacagtggaggtttgggctgagcttggttcttttttcttggtggtacttaagttttaaaaggtgtcctattgtgaggtgctagttggtggtagtcgtgggggagtcttagtacacggccggttcgggggtccctgacgtacctctccgtgtgcacgtcctagttcggtactttaccttaacccgttttacgaacctaaaccttagttacggacccgtaagttggaacggttcccggttacggggttccccggacccggtacgggtacccgttacccgggaaaggggggtaacggggtccggttaggggtacggtttggggttacgttacgttacggtttaacggtttcgggttaggttaggggttcgggtttggtaccgtacccgtaacgtaacttaccgtcggaccgtacggtaaccgtaaccgggttaaccggggttaaccgggtcccgggttacccgaccgtaaccttccgtacaagaacgtaaacttaacgttaaccgaaacgtaaacggtttaaccggtttatccgttaccgaagtaatacgttaacgaaccgtacggtcaaggtaccgaacgaccgggacggtaccgttaccggtttacgtttattaggtacgtacgagtaaacgcttacgtggttagggttcgggttagttacgtaacggttaccggtttacgggcctaacggggtcggtccggggtaaacccggg

SEQ ID NO: 76055 - DNA, 760 bp, Homo sapiens
  misc_feature: GYAE6OF01B2TO5.5.73.G07.1.454.CMB.1.raw
  modified_base (631)..(631): a, c, t, g, unknown or other
  misc_feature (631)..(631): n is a, c, g, or t
tcagatcagacacgcacgaccggtgctcgatttagctctacgctcaggggtctgagagaggagcccagccctgggattttcaggtgttttcatttggtgatcaggactgaacagagagaactcacagtggagtttgggctgagcgtggtctttttcttggtggtcttaagttttaaaaggtgtcctagttggtgaggtgcgtaggttggttgggtagttcgggtggggggtaggtcttaaggtacgacggtccgggttcggggggtccctggacggtacctcctccgtgtcgacacgtcctcgtgtacttcctacgtttcgaactaatagtcgacctagtggacgtcggtcgggtcccgccgtacgggccgtaccgggaggggtaacgggtcggtagggtaggttcgggtcgttacgttaggtttagtttcgggttagggttacgggttggttcgggtaccgtaccctaacgtacgttaaccggtacgaccgtaacgtaccttaccgtaaacggtaaccggggtcccggttaccgaccgtacttccgtacgaacggtaaccgaacttaaaccgttaaccgaaacggtaaaccgtaggttactaactcggagaccgtaagacgtacgtaacncggccgtaggaccggacgtacgacggtacgtaccggttactttagcgtagcgaaaccgaagtacccttcggtggtcggttggggtttaggacgttaaccgtggttacggtctacgggttccgggacggg

SEQ ID NO: 76056 - DNA, 788 bp, Homo sapiens
  misc_feature: GYAE6OF01C3O1W.5.73.G07.1.454.CMB.1.raw
  modified_base (199)..(199): a, c, t, g, unknown or other
  misc_feature (199)..(199): n is a, c, g, or t
  modified_base (557)..(557): a, c, t, g, unknown or other
  misc_feature (557)..(557): n is a, c, g, or t
tcagatcagacacgcacgaccggtgctcgatttagctctacgctcaggggtctgagagaggagcccagccctgggtattttcaggttgttttcatttggtgatcaggactagaacagagagactcacagtggtagttggctgagtcgttggtcttttcgtggtgtacttaagtttaaaggtgtctagttgtgtaggtgngtagttggtggtaggtcgggtggggaggtcgttaagtacgtacggccgggtcgggggtacctggacgtctcgtcgtgtcgcgacgtccgtcgtcggttacttaccgttacggttaactaacctaacgttactccgaccgtaggttagacggttccggggtccggccccggaccggtacggtaccgaccggggaagggggacggggtcggtaaggtcgggttacggttacttacggtaggttttaggtcgggttaggttcgggttaggttcggactaaccagtaaccgtcgtaaccggcaaccggtaaaccggttacccggggtaagggtcccgggtacctctaacgtaccaccggaanaaccggtaacttaacgtacccgaaaaggtaaccgtaacgggttactagtcgtagacgtaagacgtaacgaacgtagacgtagaccggcggaaccggacgaaccggttcgttaaccgttagttaccgtaggtacgaaccgtaaacgtaccgtcggtaggttcgggtacggggttacggttacgtacgttagggttaccgtacgggtacccggtggggtaccgggtaaccggg

SEQ ID NO: 76057 - DNA, 1012 bp, Homo sapiens
  misc_feature: GYAE6OF01EU0H9.5.73.G07.1.454.CMB.1.raw
tcagatcagacacgcacgaccggtgctcgatttagctctacgctcaggggtctgagagaggagcccagccctgggattttcaggttgttttcatttggtgatcaggactgaacagagagaactcaccagtggtaggtttgggctgagcgtggttctttttcgtgtggtacttaagttttaaaaggtgttacctattggtggaggtgtcgtaggtttggttggtaggttcggtgggggaggtcgttaggtacgacggtccgggttcggggggtaccctaggtacgtaccgttccgtccgtaggtcgcgacgtccgttcgtcggtacttaccgttaccgtttacgaacctaacgtagtaccgaccgtaagttcggacggtccggttccgggtaccgaccgacggtaccgtacgggaagggggtaacgggcgttaggggtcggtttacgggtcttacgttaaggtttacggtttcgggttgggtagggttacgggtacggttaccgaacccgtacgtaacgttaccgtaaccgacggtaaccggtaaacccggtaccggggttaaacccggggtcccggtttaccgaacccttacggttaccgtacccgtaaacgtaaaccgtaacgttaaacccgttaaaccgaaaccggtaacgggttacggttacgtaacgtttacccgaacggtacgtaaacgtaaccggttaacggaaaaccggtccggtaaaccgttacggggaaaccggtacccggggtaaccgggtaaacccggggttaaccccggtttaaacccgggttttacggttttaaaacccgttacgggttaaacggggaaacccggttaaaaccccgggtaaacgttaaccccggtttaacccggggtttgggttttaacggggggggtttacggtttaaccggggttttaaacccgtaaacgggtttaccgggttttacgggggtaacccggtttaaccccgggggtcggggggttaccccgggtaaaaccccgggggg

SEQ ID NO: 76058 - DNA, 743 bp, Homo sapiens
  misc_feature: GYAE6OF01ANVSO.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggcttatttaaaaggtgtccattgtgaggtgctagttgttggagtcgtgggggaggcttagtacagccgtgggggtccctgagactctcctgtgcagcctcgtggtacttctacctttgacaactatgacctatgacgtcgtcgggtcccgccgacggcctaccgaggggaacggggtcgtaggggaggttcgggtccgtcgtaacggtttagttacgggttagggttaggttgggttggtcggtacccgtaaccgtaacgttaacccgtaccggtacgaacgtaacccggggttacccgggttaaaacgggggtccccggtttaccggacccgtaacgttccgtacccgtaacggtacgaacctaaactttaccccggaaaacgtaaccggtaccgggttaggtaactccgtacgacgagtactacggaacgacgcgtagacggtacggccggtaaggtacctacggttacccgtttagtaccgtgtacgaccggtaaagacccgtaccctaggttagggtcgggttagggttacgttaacgtaacgttcgggttaccgtccgttcgggtccggggtacccggg

SEQ ID NO: 76059 - DNA, 728 bp, Homo sapiens
  misc_feature: GYAE6OF01BI5J2.5.73.G07.1.454.CMB.1.raw
  modified_base (717)..(717): a, c, t, g, unknown or other
  misc_feature (717)..(717): n is a, c, g, or t
tcagatcagacacgcacgaccggtgctcgatttagctctacgctcgaggggtctgagagaggagcccagccctgggattttcaggtgttttcatttggtgatcaggactgaacagagagaactcaccagtggtagttgggctgagcgtggttcttttcgtgtggtcttaagttttaaaggtgtcctattggtgaggtgtctagttggttggagtcggtgggggagtcgttagtacgacggccggtcgggggtccctggacgtacctcgtcgtgtgcgacgtcctgtggtacttccgtaccttagaacctaactagtcgaccagtggacggtcggttccggggtcccgtacgacgggtccgtaccgggaaggggacggggtcgtagggtcggttacgggtctacgttaggttacggtttcgggtaggttacgggtgggtttacggccggtaacctaacgtagtaacccgtacggacgtaacggtaacccgtacgggtaaacgggtcccgtccgactaccgtcacgaagacgacttaacgtacgaaacgacggtagtagtactcgtaggactagtacgtaacgacacggtcgtaggacggtacgaccggtaagtacccggtacggttaccttagacgtaggtacgaacgtaacgtcgtccggtggttcgggtcgggttcgttaacgacgtttacggttcggtaccggcgttcccggggnggtaacccggg

SEQ ID NO: 76060 - DNA, 617 bp, Homo sapiens
  misc_feature: GYAE6OF01CIKZR.5.73.G07.1.454.CMB.1.raw
  modified_base (258)..(258): a, c, t, g, unknown or other
  misc_feature (258)..(258): n is a, c, g, or t
  modified_base (363)..(363): a, c, t, g, unknown or other
  misc_feature (363)..(363): n is a, c, g, or t
  modified_base (392)..(392): a, c, t, g, unknown or other
  misc_feature (392)..(392): n is a, c, g, or t
  modified_base (450)..(450): a, c, t, g, unknown or other
  misc_feature (450)..(450): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttattttaaaaggtgtccattgtgaggtgcagttgttggagtcgtgggggagtcttagtacgagccgtgggggtccctgagtactctcctggtgcngcctctggtattcctacctttgaactaacttatgcctagtgagtccgtgggtcccgccagggcctaccggaggggaaggggcgtgggaggtggtctcgtaggttnttcggtggtagtggtgtgcacatacacgnacgactaccggtaaaggcccgttcgcctatctaccgagacgactaaacttcccgaaanaccgacggtnatcgnganagangaacagcctgaagacgccgacggacaccggttccgttagttaccgtggtacgacgtaaagccgtacccttggtagggtttcggggttagggttacgtaacggtaacgttcgggttaccgtaccgttccggggtggggtaccccgg

SEQ ID NO: 76061 - DNA, 685 bp, Homo sapiens
  misc_feature: GYAE6OF01BK8ER.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttattttaaaagtgtccattgtgaggtgcagttgttggagtcgtggggaggcttagtacagccgtgggggtccctgagacctctcctgtgcagcctctggacttcacctttgacctaactatcgccatgagcgtcggtccgccgacggccgtccgaggggagggcgtgggaggtggtctctagtttagttcggtggtagtggtggtgccactatacgtacgcaacgtacgtaccggtaaaggtcccgttcgcctacttcctaccgaagacgaactaacgttacccgaaagtaaccgaggtagtatcgtgacagtagtacgaacgacgtccgtaggaacgacggacccggtaacgggtaacccgtaccgggttacccgtttttaagtacgttacgggtacgtaaaccgggtaaaaccgtacccgtaacccgtttgggttacggggttggggtttacgggttagttaaaccgttacggttacgggtttaccggacggttcccggggtcgggggttaaaccccggg

SEQ ID NO: 76062 - DNA, 723 bp, Homo sapiens
  misc_feature: GYAE6OF01AXX9E.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtctttttcttgtggcttaagttttaaaaggtgtccattgtgaggtgctagttgttggagtcgtgggggaggtcttagtacagccgtgggggtccctgagactctcctgtgcagcctcgtggtacttcctacctttgactaactactcgaccagtgagcgtcggggtccgccgaggccgtccggaaggggacgggcgtagggtaggtcgggtctacgtaggtttagttcggtaggtaggtggtacggtcgacctactaattaccgacgtacgaacgtaccgtaaccggtaaacggggtcccgttaccgacctaacgtccgtaaccgaagaacgtaacctaaacttacccgaaaagtaaccgtacgggttataactccgtaggacctaaggaactagaaccgacgtccgtaggaacgtaccggaccggtaacgggaccttaaccgggttacccgttttaatccgtaggtacgaaaccgaaacgtacccgtccgttacggtggggttaggggttacgggttactaaaccggtacgttacggggttacccacgggttccgggttacggggaaccccggg

SEQ ID NO: 76063 - DNA, 635 bp, Homo sapiens
  misc_feature: GYAE6OF01A7XQS.5.73.G07.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (347)..(347): a, c, t, g, unknown or other
  misc_feature (347)..(347): n is a, c, g, or t
  modified_base (398)..(398): a, c, t, g, unknown or other
  misc_feature (398)..(398): n is a, c, g, or t
  modified_base (499)..(499): a, c, t, g, unknown or other
  misc_feature (499)..(499): n is a, c, g, or t
  modified_base (515)..(515): a, c, t, g, unknown or other
  misc_feature (515)..(515): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggtaggtttgggctgagcggtgtcgttttctaggtcggcttaagtttaaaggtgtccattgtgaggtgtnggttgttggngtggtgggggaggtcttagtacgcgtccgtgggggtccctgacgctcctctgtgcgtcgcttcgtgacttctacttanacctaatagtcgacctanaggcgcgtcgggtccgcgacggtccgtaccggaggggaagggngtagggcgtgggtactcgtagttgtggtaggttgtggtacgtcgacgtacncgtacgacgaatacgtaccgtaacgggtaacggtcccgttcgacctacgtccgacacgtacgtaactaacgtaacgaacgtaacggtaggtactcgtacgngtacagtctaacgacnccgtacgaggacgacgacgtacgacgtacgttacttagtaccgtaggtacacgaactccgtcgtggttaggttcgggaagttacacggttacggtcgtaggtccggtcggccgggtaacg

SEQ ID NO: 76064 - DNA, 778 bp, Homo sapiens
  misc_feature: GYAE6OF01EJPGX.5.73.G07.1.454.CMB.1.raw
tcagatcagacacgcacgaccggtgctcgatttagctctacgctcaggggtctgagagaggagcccagccctgggattttcaggtgtttcatttggtgatcaggactgaacagagagaactcaccatggagtttgggctgagcgtggtctttttcttgtggcttaattttaaaaggtgtcctattgtgaggtgcagttgttggagtcgtgggggagtcttagtacagccgtcgggggtccctgagactctcctgtgcacgcctcgtggtacttcctacctttgaactaactatcgacctaagtgacgtccggtcggggtcccgaccggacgggtccgtaccgggaagggggacggggtccgtaggggacggttcgggttactcgttaggttttaacgtcgggttagggtagggttgggttacgggttcgacccgtacgtaacgtacccgtaacgaccgtaacgtacccggtacccgggtaaaacggggtccccggtttaccgaccctacgttcctaccgaacggtaacgtaacctaaacttacccgaaagtaaccgttaacgggttcgtaacttcgtacgaacgtagtaacgtaacggaacctcggaccgtagggaaacgtaccgggaccggtaacgggtaaccgtaccgggttaccgttttaagtaccgtggtaaccgaacggtaaacgttaccgtcccgttaggtcgggttagggttacgttagtaaccgttacggttcgggttaccgtaggttcccggggtcgggtaaccccggg

SEQ ID NO: 76065 - DNA, 729 bp, Homo sapiens
  misc_feature: GYAE6OF01BZ1VR.5.73.G07.1.454.CMB.1.raw
  modified_base (354)..(354): a, c, t, g, unknown or other
  misc_feature (354)..(354): n is a, c, g, or t
  modified_base (393)..(393): a, c, t, g, unknown or other
  misc_feature (393)..(393): n is a, c, g, or t
  modified_base (702)..(702): a, c, t, g, unknown or other
  misc_feature (702)..(702): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtctttttctgtggtcttaagttttaaaaggtgtcctattgtggaggtgcgtagttggttgggaggttcgtaggggggtaggtcgtttaaggtacaggtcccggttcgggggggtccctggacgtactcctccgttgtgccgacgtcctcgtggtacttcctaacctttgacctaaactatgaccagtgagtcgtcgggtccgccgnggtccgtcggaggggaaggggctgggacggttggtcgtntaggttatttcggtgggtaggtggtggtcgacctagataccgtacgctacgaccgtacggtaaacgggcccggttacgaccgtactaccgtaccgaagacgaactaacgttaccaaacggtaaccgagggttagtacttcgtagaccgaagtacgtacgaaacgtcgacgtaggaacggacggacccggaagggaaccttaccgggttaaccttttacgtacggtggtacgaaacggtaaaccacgtacccgttagggttcggtttgggggttacggttaacggtaccgttacggttaccggggttacncgggttccgggtccggggtaacccggg

SEQ ID NO: 76066 - DNA, 749 bp, Homo sapiens
  misc_feature: GYAE6OF01CL0SS.5.73.G07.1.454.CMB.1.raw
  modified_base (261)..(261): a, c, t, g, unknown or other
  misc_feature (261)..(261): n is a, c, g, or t
tcagatcagacacgcacgaccggtgctcgatttagctctacgctcaggggtctgagagaggagcccagccctgggatttttcaggtgttttcatttggtgatcaggactgaacagagagaactcaccatggagtttgggctgagctggtctttttcttgtggtctattttaaaaggtgtccattgtgaggtgctagttgttggagtcgtgggggagtcttagtacagccgtgggggtccctgagactctctgtgcagcctntggtattcgactttgaacactatgccatgagcgtggtcccgccgaggcctccggaggggaagggcgtaggaggtcgggtcttcgtagtttagttcggttgggtacggttgggtagggttcgacccgaacgtacttaaccgtacgacgaacggtacccgttaacccgggttaaaccggggtcccgggttaccgacccgtaacgttcccgtacccgtaaggtaaccgaacctaaaccgtttacccgaaaacggaaccgtaacggggttagttaacgtccgtagaacgtagtaacgtacggaacacggtaccgtacggaaggaccggaccggaacgggtaccgtaacccgggttaccttttacgttaacgttggtaccgacgaaaccggtaacccgtaccgttcggttggggttacggggttacgggttacggttaaccgtaacgggtttcgggttacggtaccggttccggggtccggggtaaccccggg

SEQ ID NO: 76067 - DNA, 687 bp, Homo sapiens
  misc_feature: GYAE6OF01CYYNE.5.73.G07.1.454.CMB.1.raw
  modified_base (180)..(180): a, c, t, g, unknown or other
  misc_feature (180)..(180): n is a, c, g, or t
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
  modified_base (311)..(311): a, c, t, g, unknown or other
  misc_feature (311)..(311): n is a, c, g, or t
  modified_base (361)..(361): a, c, t, g, unknown or other
  misc_feature (361)..(361): n is a, c, g, or t
tcagatcagacacgcacgaccggtgctcgatttagctctacgctcaggggtctgagagaggagcccagccctgggattttcaggttgttttcatttggtgatcaggactgaacagagagaactcaccatggtaggtttgggctgagcgtgtcgtttctaggtcggtctaatttaaaggtntcctagttgtggaggtgtctagttgttggagtcggtagggggacgtcgttagtacgacggtccggttgggggtccctaggacgtctcgtctgngcacgtcctgngtacttctacctttgaactaacgttcncgctagtcgcggtcgtccgggccgcgacgtccggacgggaggggtacggnggttgggtacggttcggtacgtggtttacgttaggttcggttagggtgggtggttacggccgtaactaacgtacgtaaccgtaccgacgtaaccgtaccggtaaccgggtaccggtcccgtacaccgtactaccgacgaagaacgtaactaacgtacgaaacgacgtacgtacgtagtcgtcgagtacgagtaacgacgtacgcgacggaccgacggacgtacgtccgttacgttagtacgtaagtagaacgtacgtacgtcgtaccggtggttaggttggttcgtaacgttacggtgttccggtacgcgggtcggtcggaaccgg

SEQ ID NO: 76068 - DNA, 660 bp, Homo sapiens
  misc_feature: GYAE6OF01EMB1T.5.73.G07.1.454.CMB.1.raw
  modified_base (178)..(178): a, c, t, g, unknown or other
  misc_feature (178)..(178): n is a, c, g, or t
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (276)..(276): a, c, t, g, unknown or other
  misc_feature (276)..(276): n is a, c, g, or t
  modified_base (593)..(593): a, c, t, g, unknown or other
  misc_feature (593)..(593): n is a, c, g, or t
  modified_base (603)..(603): a, c, t, g, unknown or other
  misc_feature (603)..(603): n is a, c, g, or t
  modified_base (637)..(637): a, c, t, g, unknown or other
  misc_feature (637)..(637): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctggagcggtcgtcggtttctaggcggctaatttaaaggngtcatgtgagtgangttgtgcgngtggggagcgttagangccgtggggtcctgagctctctgtgatanccgtntgtacttcaccgtttgaacaacgtntcgtccagtgagttcgcgggtacccgcggacggccgtaccccgggggaagggtccgtaaggtgggttacggttcctagtaaggtttagttccgggttggtaaacgggtcgggttaggtcgtaacccgagttaacacccgtttaggacctaacggtaacgtacccgggtaaacgggttccggtaccgtcgaatttccccgagtaacgacgtaaccgtaaacttacgaaacgaacggtcggtgtaacgttcgaatccgagtataccggaagacgccgaagctaacgggccgtagaccttacgggtcctttagacttcgngtaacccganaccccttggtaccgtggtagggtcgtcgtaacgngtcgtcgagtcgtggcgtacggg

SEQ ID NO: 76069 - DNA, 726 bp, Homo sapiens
  misc_feature: GYAE6OF01BUW4R.5.73.G07.1.454.CMB.1.raw
  modified_base (318)..(318): a, c, t, g, unknown or other
  misc_feature (318)..(318): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccagtggagttgggctgagctggtcttttctgtggcttaatttaaaaggtgtcctagttgtgaggtgctagttggtggagtcgtgggggaggtcttagtacgaggccgtggggggtccctggagactctcctgtgcagcctcgtggtacttcctacctttgaactaactatcgccagtgagtcgtacgggtccncgacggccgtaccggaaggggaacgggcgtagggacggtgggtctcgtaggtttacgttcggttggtaggtggtacggtcgaccgaacgtaacgtaaccgtaaccgacgtaacggtaaaccggttaacccgggtaaaaccggggtcccggtttaccggacccgttaacgttcccgtacccgaaagggtaacctaaacgtaaaccttaacccggaaaagtaaccgtacgggttagtaactccgtagacgaagataacgaacgacgtacgtaaggacgtaccggaccggaggtaaccgtacgggttacccgtttataccgtggtacgaaccgaaacgtccgtcgttcgtgggttcggggtacgttagaccgtacgttcgggttaccgacggttcggggtacgggtacccg

SEQ ID NO: 76070 - DNA, 896 bp, Homo sapiens
  misc_feature: GYAE6OF01EK6YU.5.73.G07.1.454.CMB.1.raw
tcagatcagacacgcacgaccggtgctcgatttagctctacgctcaggggtctgagagaggagcccagccctgggattttcaggttgttttcatttggtgatcaggactgaacagagagaactcaaccagtggagtttgggctgagcgtggtctttttcttgtggtacttaattttaaaaggtgtctattgtgaggtgctagttgttggagtcggtgggggagtcttagtacgagccggtcgggggtcccctggacgtaccttcctccgtggtcgcacgtccttcgttggtaacttccaaccgttttacgaacctaaacttagtcgtacctagtacggacggtccggtcggggtcccgtaccgacgggccgtaccgggaagggggacggggcggtagggtaggtcgggttactacgttagttttacgttcgggttggttacgggttgggttcgggtcgacccgtaacgtaacgtaccgtaaccgacgtaccgtaaacccggttaaccgggtaaacggggtcccgttaccgtaccgtacgttcctaccgaacgaacgtaacctaaacgttaacccgaaaagtaaccgtaacgggttacttaccgttcgtacggtaactacggtaacgttaaccgaaacggttaccgaccgtaagggtaaccgggaaccgtaaccccgggggtaacggttaaaccccggttacccgggttttaaccgttttaacgttaaccgggtacggtaaccgggtaaaccggaaaaacccgttaccgttacccggttcggggttaggggtttacgggggtttacgggtttaacccgttaaaccggttaaaccgggttttcgggtttacccgggttaacccgggttaccggggggtcggggtaaaaccccccgggg

SEQ ID NO: 76071 - DNA, 761 bp, Homo sapiens
  misc_feature: GYAE6OF01D7OCF.5.73.G07.1.454.CMB.1.raw
  modified_base (307)..(307): a, c, t, g, unknown or other
  misc_feature (307)..(307): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggtacttaattttaaaaggtgtcctattgtgaggtgctagttgttggagtcgtgggggagcttagtacagccgtgggggtccctgagactctcctgtgcagcctctggtattcacctttgactactatgcctatgagcgtcgggtccncgaggtcctacggaggggagggcgtgggaggttggtactcgtagtttacgttcggttggtacggttgggtgtcgacctaacgtatacgtacgacgtaggtacccgttaccgggttaaaacggggtcccggttaccgtaccctaacgttccgtacccgaaaggaagtaacccgtaaacgtttaaacccgaaaacggaaaaccgttaccgggttacgttaaacgttccgttaggaaccgtaaaggaagttaccgaaacgacggtacccgttaggaacgtaccggaccgggaaacggttaccggtaaccggttaccgttttagttaccgtacggtacggtaaaccgaaaacgggtaccctaccggtttcggttaggggttcgggggttaacgggtttacgtaacggtttaaccgttgggtttaccggtaccggttacggggttcggggaaaccccgg

SEQ ID NO: 76072 - DNA, 708 bp, Homo sapiens
  misc_feature: GYAE6OF01CW5G4.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcttttcttggtggcttaattttaaaaggtgtcctattgtgaggtgcagttgtggagtcgtgggggagcttagtacagccgtgggggtccctgagacctctcctgtgcagtcctctaggtacttacctacctttagaacctaactatccgaccaatggagccgtcgggtcccgccagggcctaccggagggaacggggtcgtgggaggtgggtcttacgtagttagtcggtggtaggtcggtggtcgccgaactagtaaccgtaacgcgtaaacgtacccgtaaccggtaaacggggtcccgtaccgacctagtccctacacggaacacgtaaacttacccgaaaagtaacttaaccgggtttataccgttaggaccaagtactagtaaccgcgtaccgtggaagaccggtaccggaacggtaccgtacggttaccgtttaacttacgtacgtacggaacgtaaacggccttaaccgttcggtagggtagggttgggtaaccttaccgtaaccggttggtacccgtacgttcccggggttaggggacccgtaacccgggg

SEQ ID NO: 76073 - DNA, 694 bp, Homo sapiens
  misc_feature: GYAE6OF01EXFID.5.73.G07.1.454.CMB.1.raw
  modified_base (148)..(148): a, c, t, g, unknown or other
  misc_feature (148)..(148): n is a, c, g, or t
  modified_base (250)..(250): a, c, t, g, unknown or other
  misc_feature (250)..(250): n is a, c, g, or t
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (533)..(534): a, c, t, g, unknown or other
  misc_feature (533)..(534): n is a, c, g, or t
  modified_base (547)..(548): a, c, t, g, unknown or other
  misc_feature (547)..(548): n is a, c, g, or t
  modified_base (634)..(634): a, c, t, g, unknown or other
  misc_feature (634)..(634): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgngtttctaggtggctattttaaaaggtgtcattgtgaggtgcagttgttggagtctggggggagcttagtacagccgtgggggtccctgagctcgtcctgtgncacgtccgtcgtggtacttacctaccgtttacgtaacctaactaactacgtacctactcgtacggntacnggggttccccgaccgcgtacggtaccggtaccgggaacggggacgggtacggtaggggtacgggttcggtcgtacgttaggttacgttacggttagggttagggttcggggttcggtacggtaccgtacgtacgtaacgtacgtacgtacgtacggtaccgggtaacgggtcccgttaccgtaccgtacctccgtacgaacgaacgtaacctnnaactaacgaacgnntacgtaccggtacgtacgtcgtacgaacgtaacgacgtacgtaacgtacgtacgacgacggtaccgacggacggtaccgtaccggntacgttacgttacggtcgtacgaacgtaacgtacgtacgtagtcggttggttagggtacg

SEQ ID NO: 76074 - DNA, 738 bp, Homo sapiens
  misc_feature: GYAE6OF01APYOP.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttggctgagctggtctttttcttgtggcttaattttaaaaggtgtccattgtgaggtgctagttggttggagtcgtgggggaggtcttagtacaggccggttcggggggtccctgacgtacctctccgtgtgctacgcctctggtacttcctaccgtttgaacctaacttatcgcctagtgacgtcgtcgggtcccgccgtacggccgtccggaggggtaacggggcgtcgggtaggtcgggtcttcgtacggtttagtttcgggtagggttaggttgggttcggtcgtcccgtacgtaacgtacgtaccgaccgacggtacccgttacccgggtaaacgggtcccggttacgccctacgtccctaccgaagacgaaccttaaacctaccgaaacggtaaccgtaacggttagtacgtacgtacacggtacgaacgttacggaactaccgggcctaaggaacggtacggacccgtaacgggaccttaaccggggttcctttagtaaccgtggtaccgaacgtaaaaccgccgtacgttggtgggttggggttcggtagtaccgttacggtcggttccggaccggttccgggtcggggtaacccgg

SEQ ID NO: 76075 - DNA, 823 bp, Homo sapiens
  misc_feature: GYAE6OF01E4KY0.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggtagtttgggctgagctggtctttttcttgtggtcttaattttaaaaggtgtccattgtgaggtgctagttgttggtagtcgtgggggagtcttagtacgacgtccggtcgggggtccctgacgtacctccgtcctgtcgcagtcctcgtggtacttcctaccgtttgaacctaacttatcgacctagtggacgtcgtcggggtcccgccgacggtccgtaccggaagggggacggggtcggtagggtagggttcgggtccttacgtaaggtttagtttccgggttagggttagggttcgggttcgggtacgtacccgtaacgtaaccgtaaccgtaccgtaccgtaacggtacccgttaaacccggggtaaaaccggggtcccggtttacccggaccctacgtccctaacccggaacgaacgtaactaaaccgttaacccgaaacggtaaaccggtacggtacgttacgtacgtacgaccgaagtacgtaacgaactcggacccgttaggaaccggtaacggaccgggtaaaccgggtaaccgtaccggggttttaacccgttttaacgttacgttacggtaccggtaaccgaaacgtaccccgtacgttcggttagggttagggttacgggttaacgtaaccgttaacggttcgggtaacccgtcgggttccgggtcggggtaaaccccggg

SEQ ID NO: 76076 - DNA, 732 bp, Homo sapiens
  misc_feature: GYAE6OF01APV20.5.73.G07.1.454.CMB.1.raw
  modified_base (194)..(194): a, c, t, g, unknown or other
  misc_feature (194)..(194): n is a, c, g, or t
tcagatcagacacgcacgaccggtgctcgatttagctctacgctcaggggtctgagagaggagcccagccctgggatttttcaggtgttttcatttggtgatcaggactgaacagagagaactcaccatggagtttgggctgagctggtctttttcttgtggcttaattttaaaaggtgtccattgtgaggtgnagttgttggagtcgtgggggagtcttagtacagccgtgggggtccctgacgactctcctgtgcacgcctcgtggtacttcctacctttgaactaactagtcgccatcgagtcgtcgggtcccgccgaggccgtccggaggggacgggtcgtaggaggttcggtctacgtagttttagttcgggtaggttaggttcggttggtcgcccgtaactacgtacgtacgacgtaacggtaccgtaccgggttaaaccggggtccgtttccggaccctaacgttccgtaccgaagacgaactaacgttacccgaaacgtaaaccgacggttagtactcgtcgtacagtaatacgaacgtacgacgtagaacgaccggaccggacggtaccgtaccggttaacccgtttagtaccgttaggtaccgtaaacggaaccgtaccgtaccgtttcggttaggggttcggggtttacgggtttacgttaacccggttaacggttccggttaaccggttacggttccgggggtccggggtaaaccccggg

SEQ ID NO: 76077 - DNA, 698 bp, Homo sapiens
  misc_feature: GYAE6OF01B09SH.5.73.G07.1.454.CMB.1.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (348)..(348): a, c, t, g, unknown or other
  misc_feature (348)..(348): n is a, c, g, or t
  modified_base (370)..(370): a, c, t, g, unknown or other
  misc_feature (370)..(370): n is a, c, g, or t
  modified_base (410)..(410): a, c, t, g, unknown or other
  misc_feature (410)..(410): n is a, c, g, or t
tcagatcagacacgcacgaccggtgctcgatttagctctacgctcaggggtctgagagaggagcccagccctgggtattttcaggtgttttcatttggtgatcaggactgaacagagagaactcaaccagtggtaggtttgggcttgctggttcttttttcgttgtcggtattaagtttttaaaaggtgttacctattggtagaggttcgctaggtttgtgggtcgtggtagggggtagtcgttagacgacgtccggtcggggtaccctggactcctctcgtgnacgcgtctcgngtacttcctacgttanaccaatntcgactagtgacgtcggtcggaccgccggngtccgtacggaggggacggggngtagggtggtcggtactgtaagttgtggtggtggtggtgngctatacgtacacgactaacgtacgttacgggaacggtccggtccgctaacgttccaccggataaccgtaaactacggtaacccaaaacggtacggtacgttagtaaccttgaccgataaagggtatacgaaacgtcgacgagacgacggtaacggagtaccgttagttacgtttatacgtagggtaccaaacggtacaaccggttcttcggggttagggttcggggttacgttacgtagtaaccggtttcgggtagaccggggttcggacgggtccgtaacccgggg

SEQ ID NO: 76078 - DNA, 592 bp, Homo sapiens
  misc_feature: GYAE6OF01AX7TY.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttattttaaaaggtgtccattgtgaggtgcagttgttggagtcgtgggggagcttagtacagccgtgggggtccctgagactctcctgtgcacgcctctggattcctacctttgactaacgtatgtcagtgagcgtcgggtccgccgaggcctccgaggggaagggtcgtgggagtgggtctcgtagttattcgtggtagtggtggtcgccactatactacgcagaccgtaccggtaaacggccgttcgctatcctcagacgaactaattacccaaagaacgtacggtagtactctgcaagtactagaacagtcctaggagacgccggaagactaagtcggtactttagtacgtgtacgaacgtaaagtcctacttcggtggttgggttggttacgtaacgtacgttggttacgcgttcgggtaccgggg

SEQ ID NO: 76079 - DNA, 767 bp, Homo sapiens
  misc_feature: GYAE6OF01ADSV9.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggtagttgggctgagctggtcttttcttgtggtcttatttaaaaggtgtcctatgtgtaggtgcgtagttggttggtagtcggtgggggaggtcgttagtacgtacggccggtcggggggtccctggagtactccgtccgttgtcgcgacgtccttcgtggtacttcctaccttgaacgtaactatcgacctagtcgagtcgtcgggtccgcgacggccgtaccggaggggacgggtcgtcgggtaggttgggtcctacgtacgttagttcgggtaggtagggttggttcggtcgtaccacgtagtaccgtacgccgtacggtaccgttaaccgggtaacgggtcccggtacccgtcctacgtccgtacccgagaaccgtaacctaacttaacccgaaacgtaaccggtacggttacgtactacgtcggaaccgtagacgtacggaaactcgtaacccgtacggaacgggtacgaccgggtaacggtaacccggttacggttaccgtttaacgttacggtcggtaagtacggtaaacggtacccgtaccggttcgggttagggttcggggttagggtttacggtaccgttaacgggttccgggttaacgttcgggggtacccggtcggtaaacccgggg

SEQ ID NO: 76080 - DNA, 879 bp, Homo sapiens
  misc_feature: GYAE6OF01DOH10.5.73.G07.1.454.CMB.1.raw
tcagatcagacacgcacgaccggtgctcgatttagctctacgctcaggggtctgagagaggagcccagccctgggtattttcaggttgttttcatttggtgatcaggactgaacagagagaactcaccagtgggtagtttcgggctggagcgtggtcttttcgtgtggtactaagtttaaacggtgtactatgtgaggtgctagttggtggagtcgtagggggtacgcgttagtaccgaggccggttcgggggtacctaggacgtccttcgtccgtggtcgacgtacgtccgtagttaggttaacttccgtaccgttaacgtaacgtaactactcggacctatacggacggcggtttcccgggaccgccggtaacggtcccgtacgggaaacggggtacggggtacggtacggtaggttacgggtaccgttagttaaccggtttagggttcggtagggttagggttggtcgggtacgttaaccgaacttaacgtaaccgtaccgtacggtaaacccggtaccgggttaaccggggtaaaccggttcccggttccgtaccgacgttacccgtaaccgaacgtaacgtaaccgttaacgtaaacccgtaaacgggaacggttacgtaagttacgtacgtacaccgtaagttacgtaaccggaacggtcggaactaggaaccgggtcccggtaaccgaacgggtacccggttaacggttacccgtttaggtaacggttagtacggaacccggtaaacgtaaccccgggttgtaacggggttacgggttcggggtttacggggtaaaactttaccgggttaaaacgggttcccggtttaaacggaaccccggggtttcggggtaacccgggttaaacccgggg

SEQ ID NO: 76081 - DNA, 583 bp, Homo sapiens
  misc_feature: GYAE6OF01BKVSF.5.73.G07.1.454.CMB.1.raw
  modified_base (172)..(172): a, c, t, g, unknown or other
  misc_feature (172)..(172): n is a, c, g, or t
  modified_base (252)..(252): a, c, t, g, unknown or other
  misc_feature (252)..(252): n is a, c, g, or t
  modified_base (349)..(349): a, c, t, g, unknown or other
  misc_feature (349)..(349): n is a, c, g, or t
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
  modified_base (415)..(415): a, c, t, g, unknown or other
  misc_feature (415)..(415): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtgtttctaggtgctatttaaaggntcatgtgagtgcagttgttggagtcgtgggggaggcttagtacagccgtggggggtccctgagctctcctgtgcagcctntggattcacctttgacatatgccatgagtctgggtccgccaggctccgaggggaagggctgggagtgggtctagtgttatgtggtgtggtgcgcacntactacgcagactcggtaaaggccggttnccatcctcagacganaattacccaagaacacgggttntatcgtacgactagacgtagaacgtacgcgtagaacgacggaccggacggtaccgtaccggttactttagtacgtagtacgaacgaacgtaccgtccgttaggttggggttcgggttcggttacgtaacggtacggttacggttaccggcggttcgggtcgggaccgg

SEQ ID NO: 76082 - DNA, 848 bp, Homo sapiens
  misc_feature: GYAE6OF01B7VDA.5.73.G07.1.454.CMB.1.raw
  modified_base (216)..(216): a, c, t, g, unknown or other
  misc_feature (216)..(216): n is a, c, g, or t
  modified_base (276)..(276): a, c, t, g, unknown or other
  misc_feature (276)..(276): n is a, c, g, or t
tcagatcagacacgcacgaccggtgctcgatttagctctacgctcaggggtctgagagaggagcccagccctgggattttcaggttgtttcagtttggtgatcaggactgaacagagtagaactcaccatggtagtttggctgagtctggtctttttcgttgtggtacttaagtttttaaaagtgttacctagttgtgaggtgctagtttgtaggngtcggtggggagtcttagacaggccgtcgggggtaccctgacgtactctccgtgtcgacncgtccgtacgtggtacttccttaaccgtttacaactaaacttactacgtacctagtcggtacgtccgtcggggtacccgcgtacggcgtaccgggaaggggacgggtcgtgggtacggttggtacttcgttaggttacgtttcgggtaggttacggttgggtcggtacgtacccgactaacggtaccctaaccgtacgtaacgtaaccggttaccgggtaaacggttcccggtccgtaacttcgtacccgtaccgaaggtaacctaacgtaaacgttacccgaaacgtaacggtacggttaacgtactttccgaagactaacgacgttaaacgaaccgttccgactaaggaacgggccggtaccggaaacggggtaaccctttacccggggttaaccgtttttaacggttacgttagggtacccgaaaacgggttaaaaccccgcggtttaaacccgtttgggttagggggttttccggggttaacgggtttttaacgaaacccggttttcggggtttaccgggtttacggaacccccggggttttggggcccggggggttaaacccccggg

SEQ ID NO: 76083 - DNA, 771 bp, Homo sapiens
  misc_feature: GYAE6OF01B9PJO.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggtagtttgggctgagcgtggtctttttcttggtggtacttaattttaaaaggtgtcctattgtgaggtgcgtagttgttggagtcggtggggaggtcttagtacgagccgtgggggtccctgacgtaccttcctccgtgtcgcgacgtccttcgtggtactttccgtaccttttacgaacctaaacttaagtcgcctagtggacgtccgtcgggtcccgccgacggcgtaccggaaggggacgggtacgtgggtaggttgggtccttcgtaagtttcgttcggttaggttaggttgggtaggtcgtacctaacgtaacgttacgtaccgacgaacgtaccgttaccgggtaaaacgggtcccggttccgaccctacgtccgtacccgaagaacgtaaacgtaaccttaacccgaaacgaacccgtaacggtacgttactacgttacgacgtaaggtaacgtacgaacgtaccggtacgtacgggaacggtaaccgacgggtaaccggtaaccgtaccggttaccgttttaacttacgttacggtacggaacgtaaacgaccgtaccgttcggttgggttgggttacgggttacgttaacgttacggttacggttacgtacggttcgggtcgggtaacccggg

SEQ ID NO: 76084 - DNA, 797 bp, Homo sapiens
  misc_feature: GYAE6OF01DC5BR.5.73.G07.1.454.CMB.1.raw
  modified_base (270)..(270): a, c, t, g, unknown or other
  misc_feature (270)..(270): n is a, c, g, or t
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
tcagatcagacacgcacgaccggtgctcgatttagctctacgctcaggggtctgagagaggagcccagccctgggatttttcaggtgttttcatttggtgatcaggactgaacagagagaactcaccatggagtttgggctgaactggtctttttcttgtggacttagttttaaaaggtgtcctattgtgaggttgctagtttgttggacgtggtgggggagcttagtacgagccggttgggggtccctgagactctctgtcgcagcctntgtacttcacctttgactaactatcgcagngagcgtcggccnccgacgcgtaccggaggggacgggcgtgggagtcgggtacttcgtaggttacgttcggttggtaggtgggttggacgccgtaactagttacctacggcgtaaggtaaccccgtacgggtaaacggggtccccggttacgtaccctacgttccgaccgtaaggaaccgttaaacgtaaaccgttaaacccgaaaagggttaaccgtaacgggtttacgtaaccgtttaccgtaggtaaccgtaagtaaccgtaaggaaacccgtaacgtacggttacgggaaacggtacgggacccggtaacggggaccgttaacccgggtttacctttttaaacgtccggttaacggtacggtaaaccgaaaaccggttacctacccgtttacgggttgggtttacgggggttacggtttaaacgttaaccggtacggtttccggggttaaccgtccgggttaccgggttggggaacccccggttaaacccgggg

SEQ ID NO: 76085 - DNA, 796 bp, Homo sapiens
  misc_feature: GYAE6OF01D5X33.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttggtggtcttaattttaaaaggtgtccattgtgaggtgctagttgttggagtcgtggggagcgttagtacagccgtcgggggtccctgacgacctctccgtgtgcgacgtcctgtaggacttcctacctttagaacctaactagtcgacctagtcgtagccgttacggggtccgaccgacggccgtaccgggaagggggaacgggcgttagggtaggttacgggtcttacgtagtttacgttcggttagggtaaggttggtacgggtcgacctaacgtactaaccgtacggactaacggaaccgtttacccgggtaaacgggtcccggttccgtaaccgtatacccgtaaccgaaggtaacgtaactaaaccttacaaaacggaccgtaaggttacgtagttactaggacgttagaacttacgaaacctcgtaccgtaggaaggtaccgaccgggtaacggtaaccgttacccgggtttaacgttttaacgttccgtaagggttaaacccgggaaacctaaacgggtaaccctaccgttgggtttaggggtttcggggggttcggtttaaaccttacggtaccggttttagggttacccccggtaagggtttcccgggggtaccggggaaaaccccgggg

SEQ ID NO: 76086 - DNA, 883 bp, Homo sapiens
  misc_feature: GYAE6OF01D5UNE.5.73.G07.1.454.CMB.1.raw
  modified_base (198)..(198): a, c, t, g, unknown or other
  misc_feature (198)..(198): n is a, c, g, or t
tcagatcagacacgcacgaccggtgctcgatttagctctacgctcagggggtctgagagaggagcccagccctgggattttcaggtgttttcatttggtgatcaggactgaacagagagaactcaccatggagtttgggctgagctggtctttttcttggtggtcttaagttttaaaggtgtcctattggtgaggtgntagttggttggagtcggtgggggagtcgttagtacgaggtccggtcggggggttccctaggacgtaccttccttccgtggttcggccacgtccgtcgtaggtacttcctacctttagaactacttagtcacctagtacggacggtccggtcggggtaccccgccggtacgggaccggtaccggggaaggggggaacgggtccggttaggggtacgggttcgggttaccttaggttaggttttacggtttccgggttagggttaggggttgggtcggtccgaaccgtaccgttaacgttaacccggtaacggacgtaaaccggtaacccggtttaacccggggtaaaccgggttccccgggttacccgaccgttacttcccgtaacgacggtaaacgaaccttaaaccgttaaacccggaactaaaccggtaccggttagttactcgtacgaccgtagtaaccgtacggaacctcgtacggtacggacggtacccggacgggtaacgggtaccgtaaccggtttaccggtttattaccggtcgggtaaacgtaaccgaaacgttacccgtcccgggtttaagggttacggggtttcgggggtttaacgttaccggtaaacccggtttacggttttacgggtaccccggttaccggggttccgggggtacccgggtaaaccccgggg

SEQ ID NO: 76087 - DNA, 682 bp, Homo sapiens
  misc_feature: GYAE6OF01EYGIX.5.73.G07.1.454.CMB.1.raw
  modified_base (178)..(178): a, c, t, g, unknown or other
  misc_feature (178)..(178): n is a, c, g, or t
  modified_base (321)..(321): a, c, t, g, unknown or other
  misc_feature (321)..(321): n is a, c, g, or t
  modified_base (512)..(512): a, c, t, g, unknown or other
  misc_feature (512)..(512): n is a, c, g, or t
  modified_base (531)..(531): a, c, t, g, unknown or other
  misc_feature (531)..(531): n is a, c, g, or t
  modified_base (542)..(542): a, c, t, g, unknown or other
  misc_feature (542)..(542): n is a, c, g, or t
  modified_base (587)..(587): a, c, t, g, unknown or other
  misc_feature (587)..(587): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtctttttcttgtggcttaattttaaaaggngtccattgtgaggtgctagttgttggagttcgtgggggagtcttagtacaggccgtgggggtccctgagactcgtcctgtgcagcctcgtggacttctacctttagaactaattagtcgaccagtggagcgttcggggtcccnccgaagggtccgtaccggaaggggaacgggtctgggtaggttcgggtcttacgtagtttacgttcggttaggtaggtggttcggtacgaccgactacgtacgtaccgacgtaacggtaaccgttaaccggtaaacgggtcccggttacaccgtattccaccgaagacgaacctaatacccgaaagtaacgnggttagactgtcgacgtanaagtacgaacncgtcgtagacggccgtacgtaacggaccgtacgttaccgttttanacgttggagtaaccaaacgttcgtaccgtgggttagggttggggttagttacaaccgttagggtcgttaccgaacggttcgggaggggtaacccg

SEQ ID NO: 76088 - DNA, 845 bp, Homo sapiens
  misc_feature: GYAE6OF01AV6Q1.5.73.G07.1.454.CMB.1.raw
  modified_base (208)..(208): a, c, t, g, unknown or other
  misc_feature (208)..(208): n is a, c, g, or t
tcagatcagacacgcacgaccggtgctcgatttagctctacgctcgaggggtctgagagacggacgcccagccctgggtattttcaggttgttttacatttggtgatcaggactggaacagagagtaactcaccagtggagtttggctgagcgtggttctttttcgttgtgtacttaagttttaaaggtgtactagttgtggaggtgngtagttgttggagtcggtggggagtcttagtacgacggccgtcgggggtcctgacgtactcctcctgtgcgatcctgtgtacttcctacgttagacctaactagtcgacgtaagtcggacgtcgtcgggccgcgacggtccgtaccggaggggacggtcgtagggtacggttggtaccttacgttaagtttacggttacgggttgggttaacgttggggttaccggtacgtaccctaacgttacgtacccgttaacggaccggtaaccggtaacccggtttaaccggggtaacgggtccccggttaccgtaccttaccgtaccgttaacgtaacgtaacgtaaccttaacgttaaccggaaacgtaaccgtaacgggttacgttaacgtacggttacgacgtaaacggtacgtaacggaacctaaggtacccgtaaggtaaccggaaccggtaccgggtaacggtaaccggtttaccgggttacgttttaacgttaccgttacggtaacggtaaaccggaaaccgttaccggttacccggttgggttacgggttcggggtttacgggttaaccgttaaccggtttaccggttacgggtttacccgtacggggttaccgggtcccgggggtaacccgg

SEQ ID NO: 76089 - DNA, 912 bp, Homo sapiens
  misc_feature: GYAE6OF01BFV9U.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagtcgtggtcgtttcgtaggtcggtactaagtttaaaaggtcgtaccgattgtgaggtgacgtagttggttaggacgtcgtacgggggtaggtctttaacggacgacggtcccggtcggggggttacccctggacgtaccttccgtccgtggtcgaccgagtcccttgtacggtaacttcctaccgttacgacctaacttacgtacgtaccagtacggtacgtcgtcgggtcccgccggacgtccgtaccggaagggggtacgggtcggtacgggtacgggtcggttaccgttacgtaggtttaccggttggttacggggttacggttggtccggtcgacccgtaacgtaaccgtaacgtacccggtctaacggtacccgacgtaacggggtaaaccgggtcccggttaccctaacccgtacctacccgtaaccgaggtaaacgtaaccttaacccgtaaacccgtaaaggaaccggttaccggtacgttaccgttaacgtccgttaaagaacggtttacgaacggaaacccggacgtaacccggttaacggaccggaaaccgggtaccgggtaaacggttacccccgggtaccggtttaaacccggtttaacggttaccccggttaggtacccggttaaaacccggaacccgttaaacccgttacggtttaccgggttcgggggttacccggggtttaagttccgggtaaacccggttttaccgggggttagttacccccggggtcgggttacccggggttaacccgggg

SEQ ID NO: 76090 - DNA, 764 bp, Homo sapiens
  misc_feature: GYAE6OF01CE22A.5.73.G07.1.454.CMB.1.raw
  modified_base (607)..(607): a, c, t, g, unknown or other
  misc_feature (607)..(607): n is a, c, g, or t
  modified_base (624)..(624): a, c, t, g, unknown or other
  misc_feature (624)..(624): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggtaggtttgggctgagcttggtctttttcttggtggtacttaagttttaaaaggtcgtcctagttgtggaggtgctaggtttggttggagtcggtgggggtaggtcttagtacgaggtccggtcgggggtccctggacgacttccgttccgtggtcgccgtacgtccgttcgttggtacttccgttaaccgttttacgaaacctaaaccgttatcgtaccagtcggacggtccggttcggggtccccgaccggacggtcccgtaccgggaaggggggacggggtcggtagggtagggttcgggttccttagttaacggtttacggtttcgggttgggttaaggttgggttacggtccgaccctaacgtaactaaccgtacgacgtacgtaccgttaaccgggtaaacgggtcccgttacaccgtactcgtaccgaagaacgtaactaactacgaaacgtaacgtacggtgtactcgtnacgatacgtaagaacgngtaccgtagacggtacgacgggtacgaccgtaccgtttacgttagtacggtgtacgaacggtaaacgccgttacgtgggttaggttgggttcggtaacgtacgtacggttcggtaccgtccgggtcggtcgggaacccgg

SEQ ID NO: 76091 - DNA, 831 bp, Homo sapiens
  misc_feature: GYAE6OF01CD31Z.5.73.G07.1.454.CMB.1.raw
  modified_base (161)..(161): a, c, t, g, unknown or other
  misc_feature (161)..(161): n is a, c, g, or t
tcagatcagacacgcacgaccggtgctcgatttagctctacgctcaggggtctgagagaggagcccagccctgggtattttcaggttgttttcatttggtgatcaggactgaacagagagaactcaccagtggtaggtttggctgagtctggttctttttntgtggacttaagtttaaaggtcgtactagttggtgaggtgtacgtaggtttggttgggaggtcgggtaggggggacgtactttaggtacgacggtccggttacgggggtccctaggaacgtcctccgtcgttcgcgaccacgtccttcgtaggtacctttacgtaccgtttacgaactaactatacggctacggtcggcggtcggtccgggtccgaccggacggtccgtaccggaacgggggtacggggtcggtagggtacgggttcggtcgttacggtacggttacggttcggttagggtttacggtggtcggtcgtaccgacgtaacgtaacgtaccgaacgaccggtacccggtaaccgggttaaacgggtccccggtttaccgacccgtacgttaccccgacgaaccggtaacgtaaacgtaaacccgttaacgtaaacggtaaccggtttaacggtttactacggtacgtactaacggataccgtaacacggtacgtaggaacggtacgaccgggtaacggtacggttaccggttaaccgttaacggttagtacggtaacgaaacgtacgtaacccgtacgttcgggttggttacggggtacggttacgttaacgtacgggttcggttacgtaccggggttcggaccggggcggttaacccgggg

SEQ ID NO: 76092 - DNA, 816 bp, Homo sapiens
  misc_feature: GYAE6OF01CLQSR.5.73.G07.1.454.CMB.1.raw
  modified_base (193)..(193): a, c, t, g, unknown or other
  misc_feature (193)..(193): n is a, c, g, or t
tcagatcagacacgcacgaccggtgctcgatttagctctacgctcaggggtctgagagaggagcccagccctgggattttcaggtgttttcatttggtgatcaggactgaacagagagaactcacatggagtttgggctgagctggtctttttcgttgtggtacttattttaaaaggtgtccattgtgaggtncgtagttggttggtagtcggtgggggtaggtcttaggtacgtacggccggtcggggggtccctgacgtactcctccgtgtcgcgacgccttcgtggtacttcgtacctttagaacctaacttagtcgacctagaggtacgtcggtaccggggtcccgccggagggtccgtaccgggaagggggaacggggccggttaggggtacgggtttcgggttaccgttacgttaacgggtttacgttttccggggttacgggttaggggttcgggttcgggtaccgtacccgtaacgtaacttaacccggtaaccgacgtaaccggttaccggttaaacccgggtaaacggggtccccggttcgtaccctaacgtcccgtaccgaaggaaccgtaacgtaaaccttaaccggaaacgtaacggttaccggtagttactaccgtagactacggtaagtaactaacgacggacgttagaacggccggaccggacggaacggttaccggttacgttttactaacggttgtaccggaacgtaaccgtacgtaccggttcgttaggggtcgggtttacgtacgttaccggtaacggtttccgggtagtacccggtcgggtaccggggtacccgg

SEQ ID NO: 76093 - DNA, 739 bp, Homo sapiens
  misc_feature: GYAE6OF01AEDNB.5.73.G07.1.454.CMB.1.raw
  modified_base (597)..(597): a, c, t, g, unknown or other
  misc_feature (597)..(597): n is a, c, g, or t
tcagatcagacacgcacgaccggtgctcgatttagctctacgctcaggggtctgagagaggagcccagccctgggtattttcaggttgttttcatttggtgatcaggactgaacagagagaactcaccatggtagtttggctgagcttggtctttttctgtgtacttaagttttaaaggtgtcctattgtgaggtgctagttgtggagtcggtgggggaggtcttaggacacggtccggttcggggggtccctgacgtaccttctccgtgtgcacgtcctcgtggtacttccgtacctttgaactactactcgctagtcgacgtccgttcggggtccccgaccgacgggccgtaccgggagggggtaacggggtcgtagggacgggttcgggtcttacggttaggtttacgttcgggttggttagggttgggttcggtacgcccaacgtagtacccgtacggcgtaacggtacccggttaaccggggtaaaccggggtcccggttaccgaccctatcccgaccaaggtaacctaactaaacttacccgaaaagtaccggtacggttatacgtcgtagaccgtaagacgtaacgaacncggtaccgaggaacggacgaccgggacggtacctacggtttaccgttatcggaggtacgaaacgtaacccgacttccggttggtgggttgggtacggttactaaccggttaggtcggtacggcgttcggggcgggtaacccg

SEQ ID NO: 76094 - DNA, 731 bp, Homo sapiens
  misc_feature: GYAE6OF01D06HF.5.73.G07.1.454.CMB.1.raw
  modified_base (238)..(238): a, c, t, g, unknown or other
  misc_feature (238)..(238): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
tcagatcagacacgcacgaccggtgctcgatttagctctacgctcaggggtctgagagaggagcccagccctgggattttcaggttgttttcatttggtgatcaggactgaacagagagaactcaccagtggtaggtttgggctgacgctggtctttttcttgtggcttaagttttaaaaggtgtcctagttggtgtaggtgctaggtttggttggagtcgtgggggagcttagtacncgccggtgggggtccctgacgacgctcctgtcncganctctggtacttcctaccgtttagaactaacgttatcgcctaagtgcgtcgttcgggtaccccgacgtacggtccttaccggggaggggtaacggggtcgtgggtacgttgggtactcggttagtttacgtttcggttaggtacgttggtacgtgacccgaatacgtacgtaacgctaacggaacccgttacgggtaaacggggtccttccgaccgtatccgtaccgagaagtacctaacttaaccgaagtaacgtacggttagtactgtcgtacgacgtagagaaccgtagtccgtagacggtacgaccggtaaggtaccgacggttaccggttttatacgggttcgtacggaaacgtaaccgtacgtacccggttgttgggttcgggtttccggttagttaacggttaccggttccggtttaaccggcccggttcgggtccgggtaaacccgggg

SEQ ID NO: 76095 - DNA, 836 bp, Homo sapiens
  misc_feature: GYAE6OF01E3WSA.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttattttaaaaggtgtcattgtgaggtgcagttgttggagtcgtgggggaggtcttagtacgagccgtggggggtccctgagactctcctgtgcacgccttctggattccacctttgaactaactatcgccatcgacgtcgtcggggtcccgaccgacggtccgtaccggaagggggtaacgggggtccgtaggggtacggtttcggggtccttacgtacggttttacgtttcgggttgggttacgggttgggttgggtcgaccccgtaacgtaacgttaaccgtaccggacctaacgggtaaccccgttaacccggggttaaaaacgggggtccccgggttttaccgggacccttaaacgttcccgtacccgaaaggtaaccgtaaccgtaaactttaccccgaaaacggtaaacccgtacgggttacgttactcgtacggacagactacgaaccgagtcccgtagggaacgacggaccggaacgggtaccgtaaccgggttaccgttttaacgtacgttcggtaacggtaaaccggaaaacgtacccgtaaccccgttgggttaccggggtttcggggggttacgggtttaaccggttaaacggttacccgggttttaccgggttaacccgggtacccggtttcccggggaccggggggttaacccccgggg

SEQ ID NO: 76096 - DNA, 782 bp, Homo sapiens
  misc_feature: GYAE6OF01BZC13.5.73.G07.1.454.CMB.1.raw
tcagatcagacacgcacgaccggtgctcgatttagctctacgctcaggggtctgagagaggagcccagccctgggattttcaggttgttttcatttggtgatcaggactgaacagagagaactcaccatggtagtttgggctgagcgtgtctttttcttgtggtcttaagttttaaaggtgtccagttgtgaggtgcgtagttggttggagtcgtgggggaggtcttagtacgacgtccggtcggggggtccctggacgtacctccttccgtgtcgcgcgtcctcgtgtacttctacctttgactaactatcgaccagtcgagtccgtcgggtcccgccgacggtccgtaccggagggggaacgggcgtagggtaggttcgggtcttacgtaggtttacgtttcggttggttaggttgggttcggtcgacctaacgtacgttaaccgtaccggacgtaacgtaccgttaccgggtaaacggggttcccgttaccgaccgtacgtcctaccgaagtacgaactaacttacccgaaaagtaccgtagttagttactcgtagactaagacttaacggaaccacgtaccgtaggaacggtaaccggacggtaaccgggaccgttaaccgggttacgttttacgttacgtaggttaaccgaacggtaaaccgtacccgttacggttacggtttacgggggttacgggttacggttttaacggaccgtttaacggtttccggggtttaaccgacggggtttcccggggaacggggttaacccccgggg

SEQ ID NO: 76097 - DNA, 689 bp, Homo sapiens
  misc_feature: GYAE6OF01EDH5M.5.73.G07.1.454.CMB.1.raw
  modified_base (163)..(163): a, c, t, g, unknown or other
  misc_feature (163)..(163): n is a, c, g, or t
  modified_base (213)..(213): a, c, t, g, unknown or other
  misc_feature (213)..(213): n is a, c, g, or t
  modified_base (256)..(256): a, c, t, g, unknown or other
  misc_feature (256)..(256): n is a, c, g, or t
  modified_base (348)..(348): a, c, t, g, unknown or other
  misc_feature (348)..(348): n is a, c, g, or t
  modified_base (513)..(513): a, c, t, g, unknown or other
  misc_feature (513)..(513): n is a, c, g, or t
  modified_base (544)..(544): a, c, t, g, unknown or other
  misc_feature (544)..(544): n is a, c, g, or t
tcagatcagacacgcacgaccggtgctcgatttagctctacgctcaggggtctgagagaggagcccagccctgggattttcacggtgttttcaatttggtgatcaggactgaacagagagaactcaccaatggagtttggctgagctggtcttttcttgtgtnttattttaaaaggtgtcattgtgtagtgctagttgttggagtcgtggggngtctagtacagccggtcgggggtcctgacgacctcgtcctgtncacggtcctcgtggtacttactacctttcgactaactatcgccagtggacgtcgtcgggtcccgccgtaggtcgtaccggaaggggtagggngttcgggacgttggttccgttcgtagttcgttaggttggtaggttggtcgtcgcctaagtactacgtacgacaacgtaccgtaccgggtaaaggttcccggtacgacctacttccgaccgagtaaccacttaaacttaccctaaacggtaaacttcgtttaaacncgtacggacgtaacgataacggacttaccgnggtaacgaggacgacggcgtactccggttacctttagtactagtacgaacgtaacgcctacggttcggttagggttgggtacggtttacgtaacgttccgggttacgttcgtaccgggttccggcgggtacccggtaaacccggg

SEQ ID NO: 76098 - DNA, 865 bp, Homo sapiens
  misc_feature: GYAE6OF01CLAGS.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccagtggagtttgggctgagcgtggtcttttcttgtgacttaattttaaaggtgtccattgtgaggtgcgtagttggttggagtcgtagggggaggtacgttagtacgaggtccggttgggggtccctggacgtacctccgtaccgtggtcgaccacgtccctacgtaggtacttccgtaacccgttttagaacctaacttagtacgaccctaagtcggacgtccggtcgggtaccccggaccgtacgggtacccgtacgggaacggggaacggggtcggtagggtacgggttcgggttacgttacgtaggttttacgttacgggttagggttacgggttggttacgggtacgacccgtaacgtacgttaaccgtacgaccgtaaccggtaacccgttaccgggtaaaacggggttcccggttaccgtaccgtaacgttcccgtaaccggaagtaaccgtaaccgtaaacgttaacccgaaacggtaaccggtaacggttacggttacctacggtaccgtaaccgtaagtaagtaaccgaaacgtacggtacgtaacggaacggtaccgggacccggtaagggtaacccgtacggtttaaccttttagtaccgtggtaaccggaaaccgaaacggtacccgtacgtttccgggttagggtttcggggttacgggttaagttaaacccgtcgggtttacgggttaccgaaccggttccggggggtacccgtaaacccggggg

SEQ ID NO: 76099 - DNA, 794 bp, Homo sapiens
  misc_feature: GYAE6OF01CC4ZI.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggtaggtttgggctgagcgtggtctttttcttggtggtcttaagttttaaaaggtgtcctattggtgaggtgtctagttggttgggtagtcggtgggggaggtcttacgtacgacggtccggttcgggggggtcccctggacgtaccttccttccgtggtcgcacgtccttcgtggtacttctacctttacgaactaactatcgcctaagtgacgtccggtcgggtcccgccgacggtccgtaccgggaacgggggaggggcgttaggggacgggttgggtaccgtacgtacggttttaggttccgggttaggtggggtttgggttggtacgtacccgaactacggtaaccgtaccgaaccgtaacggtacccgttaaccggggtaaacggggtcccggttaccgccggtaaccttccgtaacccgaaaggtaacgaaaccttaacgttaacccgaaagtaccggtacggttaattctacgtcggacaggttactaacggaactgtccgagaacgggtaccgacgggaggaaaccgttccgggttactttagtcgaggttaaccgacggtaaaaccgtccgtaccggttaggtttcgggtagggggtttcgtaaacttacggtacggttcgttacgggaccgttgggggtacccggtaacccgggg

SEQ ID NO: 76100 - DNA, 973 bp, Homo sapiens
  misc_feature: GYAE6OF01EO2WI.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggtagtttgggctgagctggttctttttcgttgtggtacttaagtttttaaaaggtgttcctaatttggtaggtaggtgctaggtttggttggagtcggtagggggagtcgttagtacaggtccggtacggggggtccctaggacgtaccttccgtccgtaggtcgtccgacggtccttcgtagggttactttccgttaacccgttttacgaacctaacgttacgtcgacctagtcggaacgtcggttacggggtccccgaccgtacggtccggtaccggaagggggtaacggggtccgttagggtaggttcggggttaccttacggttaaggttttacgtttcgggttagggtttacgggttgggttacgggtacgtaccccgtaacgtaaccgttaaccgttaaccggacgtaaaccggtaaccggtttaacccgggggttaaaaaccggggtcccccgggtttaacccgggaccccttaacctttccccggtaacccgtaaacgggtaaccgttaaacccgtttaaaacccgtttaaccccggaaaaacgggtaacccgttaacgggtttaccggttaacttaccggtacggtacccgtaaaggtaacccttaacgggaaacccgtaccgggtacccggtaagggaaccgggtaacccgggtaacccgggtaaaccggtaacccgggttacccgggttttacgtttaaacggtttacccggtaggtaacccgtaaaccgggtaaaccgtaccccgttccgtttaggtgggggttcgggttaacgggttacgtacgtaacccggtttggttaacccggtcggtcgggtaccggggtaacccgg

SEQ ID NO: 76101 - DNA, 741 bp, Homo sapiens
  misc_feature: GYAE6OF01BCFNK.5.73.G07.1.454.CMB.1.raw
  modified_base (141)..(141): a, c, t, g, unknown or other
  misc_feature (141)..(141): n is a, c, g, or t
  modified_base (143)..(143): a, c, t, g, unknown or other
  misc_feature (143)..(143): n is a, c, g, or t
  modified_base (152)..(152): a, c, t, g, unknown or other
  misc_feature (152)..(152): n is a, c, g, or t
  modified_base (179)..(179): a, c, t, g, unknown or other
  misc_feature (179)..(179): n is a, c, g, or t
  modified_base (254)..(254): a, c, t, g, unknown or other
  misc_feature (254)..(254): n is a, c, g, or t
  modified_base (422)..(422): a, c, t, g, unknown or other
  misc_feature (422)..(422): n is a, c, g, or t
  modified_base (592)..(592): a, c, t, g, unknown or other
  misc_feature (592)..(592): n is a, c, g, or t
  modified_base (724)..(724): a, c, t, g, unknown or other
  misc_feature (724)..(724): n is a, c, g, or t
tcagatcagacacgcacgaccggtgctcgatttagctctacgctcaggggtctgagagaggagcccagccctgggattttcaggtgtttcatttggtgatcgaggactgaacagagacgactcaccatggagtttggctgngngtgtctttntagtgctagtttaagtgtcatgtgagngcagtgtgagtcgtggggagtcttagtacgacggtccgttcgggggtccctggacgactccgtccgtagtcgacncggtcctgtggtacctttctaaccgtttagaacctaacgtaactcgtaccgtaagtgtacgtccgttcggggacccgaccgtacggtccgtaccggaaggggggaaggtccggttaggacggttcgggtcttaggttagtttacgtcggtagggtaggtggtacggtnacccgtactaatacccggtaacacggtacctaaccgggtaacccgggttaaacgggcccggggtttccctaccttaaccggttccacgtaacgtaacgaagttaacctttacccgaaacgaccgtgggttaactcgtaactcgaagtaacgacgtacgaacgtacccggnaacggtaggaccgggtacaaccgggtaaccgttacggtcctttaaggtcgtaaccgtacgacgtaaccctacggttcggttaggtcgggtttaggtcgtaaaccttcgggtacgtacggacccgtttcgggngggttaaccgggtcccg

SEQ ID NO: 76102 - DNA, 525 bp, Homo sapiens
  misc_feature: GYAE6OF02G4MCX.5.73.G07.1.454.CMB.1.raw
  modified_base (149)..(149): a, c, t, g, unknown or other
  misc_feature (149)..(149): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgngtttctaggtggctatttaaaggtgtcattgtgaggtgcagttgttggagtctgggggaggcttagtacagcctggggggtccctgagactctcctgtgcagcctctggattcacctttgacaactatgccatgagctgggtccgccaggctccagggaaggggctgggagtgggtctcagttattcgtggtagtggtggtgccacatactacgcagactcgtaaagggccggttcgccatctccagagacaattccaagaacacggtgatctagcagatgaacagcctgagagccgaggacacggtccgtttatactgtgacgaagacactctggtggtgggttgacgtacgtggttcgacgtcggtgggacccg

SEQ ID NO: 76103 - DNA, 585 bp, Homo sapiens
  misc_feature: GYAE6OF02GA33E.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtgtttctaggtcggctaatttaaaggtgtcatgtgaggtgcagttgttggagtctgggggaggcttagtacagcctggggggtccctgagactctcctgtgcagcctctggattcacctttgacaactatgccatgagctggtccgccgaggctccagggaaggggcgtgggaggtgggtcgtcgtagttagttcggttggttaggtggtgggtcgcgacactactacgacagacgtaccggtaacgggtaccggtacgacactctccacgagaacaactacaacgaacgaacggtagtactctgacgagatagaacacgacgtgagacgaccgacggacgacggtaccgtttacttacgtagtagacgaacgacgacctacgtggtgggttgggttaggttacgtacgttacggttcggtacgtcggtcgggtcgg

SEQ ID NO: 76104 - DNA, 563 bp, Homo sapiens
  misc_feature: GYAE6OF02F6QAS.5.73.G07.1.454.CMB.1.raw
  modified_base (147)..(147): a, c, t, g, unknown or other
  misc_feature (147)..(147): n is a, c, g, or t
  modified_base (427)..(427): a, c, t, g, unknown or other
  misc_feature (427)..(427): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggngtgtttctaggtggctatttaaaggtgtcatgtgaggtgcagttgttggagtctgggggaggcttagtacagcctggggggtccctgagactctcctgtgcagcctctggattcacctttgacaactatgccatgagctgggtccgccaggctccaggggaaggggctggagtgggtctcgagttattcgtggtagtggtggtgccacatactacgcagactaccgtaaagggccggttcgcctatcctccagagacaattccaaagaacacggtgtatntgcagatgaacagcctgagagccgaggacacggtccgtttatacgtagtgacgaaagaccgtaacctcgtacgggttggggttacggtttgtaaccgtaacgttcgggttaccacggttcggttcggggaacccgg

SEQ ID NO: 76105 - DNA, 613 bp, Homo sapiens
  misc_feature: GYAE6OF02IEZ4H.5.73.G07.1.454.CMB.1.raw
  modified_base (147)..(147): a, c, t, g, unknown or other
  misc_feature (147)..(147): n is a, c, g, or t
  modified_base (171)..(171): a, c, t, g, unknown or other
  misc_feature (171)..(171): n is a, c, g, or t
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggngtgttctagtggctatttaaaggngtcatgtgagtgcagttgttggagtctggggaggcttagtacagcctggggggtccctgagactctcctgtgcagctctggattcncctttanacaactactcgacatgagtcgtcggtccgccgacggcgtaccgacgggacgggtcggtggtaggtggtcgtcgtagttagttacggtggtaggtggtggtcgcgactactacgtacgacgacgtacgtaccggtaacgggtaccggtcgtccgtactacgtacgacgacgactaactacgaacgaacgtacggtacgtatactgacgagagtagacacgacgtagagacgacgacggacgtacgtacgttacgttacgtacgtacgtacgaacgtaacgtacgtacgtcggtgggttaggttacggttacgtaacggttacggttacggtacgtacggtcgggtaccgg

SEQ ID NO: 76106 - DNA, 539 bp, Homo sapiens
  misc_feature: GYAE6OF02F0C0P.5.73.G07.1.454.CMB.1.raw
  modified_base (529)..(529): a, c, t, g, unknown or other
  misc_feature (529)..(529): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggcttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccagggaaggggctggagtgggtctcagttatcgtggtagtggtggtgccacatactacgcagactccgtaaagggccggttcgccatcgtccagagacaattccaaagaacacggtgtatctgcagatgaacagcctgagagccgagacacggtacctttatacgtgtcgcgaaacgctacctctggtgggtgggtttgtacgaacgttggttaccgacgttcggnggggtacccg

SEQ ID NO: 76107 - DNA, 536 bp, Homo sapiens
  misc_feature: GYAE6OF02H0CAW.5.73.G07.1.454.CMB.1.raw
  modified_base (361)..(361): a, c, t, g, unknown or other
  misc_feature (361)..(361): n is a, c, g, or t
  modified_base (490)..(490): a, c, t, g, unknown or other
  misc_feature (490)..(490): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagcctggggggtccctgagactctcctgtgcagcctctggattcaccctttgacaactatgccatgagctgggtcccgccaggctccgaggggaagggctggagtgggtctcagttattcgtggtagtggtggtgccacntactacgcagactccgtaaagggccggttcgccatctccagagacaattccaaagaacacggtgtatctgcagatgaacagcctgagagccgaggacacggtccgtttatactgtgacgaagacacctntggtgggtggttgtactacgtggttaccgcgtcggtgggtacccgg

SEQ ID NO: 76108 - DNA, 557 bp, Homo sapiens
  misc_feature: GYAE6OF02H4LPL.5.73.G07.1.454.CMB.1.raw
  modified_base (358)..(358): a, c, t, g, unknown or other
  misc_feature (358)..(358): n is a, c, g, or t
  modified_base (395)..(395): a, c, t, g, unknown or other
  misc_feature (395)..(395): n is a, c, g, or t
  modified_base (446)..(446): a, c, t, g, unknown or other
  misc_feature (446)..(446): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggcttttctgtggctattttaaaaggtgtccattgtgaggtgcagttgttggagtcgtgggggaggcttagtacagcctggggggtccctgagactctcctgtgcagcctctggattcacctttgacaactatgccatgagctgggtcccgcaggctccgagggaaggggctgggagtgggtctcagttattcgtggtagtggtggtgccanatactacgcagactccgtaaagggccgttcgccatcnccagagacaattccaagaacacggtgtatctgcagatgaacagcctagagngaccgaggaccgacgtccgtttatacgtgtacgacgaaagaccgaccttcgtgggtagggttgggttacgtaacaacggttcggttccgacgttccgggtcggggacccgg

SEQ ID NO: 76109 - DNA, 554 bp, Homo sapiens
  misc_feature: GYAE6OF02I2G5P.5.73.G07.1.454.CMB.1.raw
  modified_base (444)..(444): a, c, t, g, unknown or other
  misc_feature (444)..(444): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgcgttttctagtggctatttaaaaggtgtcattgtgaggtgcagttgttggagtctgggggaggcttagtacagcctggggggtccctgagactctcctgtgcagcctctggattcacctttgacaactatgccatgagctgggtccgccaggctccagggaaggggctggagtgggtctcgagttatcgtggtagtggtggtgccacgatactacgcaagactccgtaaagggcccggttacgccctatcctccgagagacaattccaaagaacacggtagtatctgcagatgaacngcctgacgagccgagacacggtccgtttatactgtagacgaaagaccaaccgttctacggtgggtggtttagaacctaacgttgggttccaacgttcgggcgggtacccg

SEQ ID NO: 76110 - DNA, 562 bp, Homo sapiens
  misc_feature: GYAE6OF02GAPJ0.5.73.G07.1.454.CMB.1.raw
  modified_base (147)..(147): a, c, t, g, unknown or other
  misc_feature (147)..(147): n is a, c, g, or t
  modified_base (170)..(170): a, c, t, g, unknown or other
  misc_feature (170)..(170): n is a, c, g, or t
  modified_base (172)..(173): a, c, t, g, unknown or other
  misc_feature (172)..(173): n is a, c, g, or t
  modified_base (176)..(178): a, c, t, g, unknown or other
  misc_feature (176)..(178): n is a, c, g, or t
  modified_base (180)..(180): a, c, t, g, unknown or other
  misc_feature (180)..(180): n is a, c, g, or t
  modified_base (183)..(183): a, c, t, g, unknown or other
  misc_feature (183)..(183): n is a, c, g, or t
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (194)..(195): a, c, t, g, unknown or other
  misc_feature (194)..(195): n is a, c, g, or t
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (218)..(219): a, c, t, g, unknown or other
  misc_feature (218)..(219): n is a, c, g, or t
  modified_base (222)..(222): a, c, t, g, unknown or other
  misc_feature (222)..(222): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (232)..(232): a, c, t, g, unknown or other
  misc_feature (232)..(232): n is a, c, g, or t
  modified_base (235)..(236): a, c, t, g, unknown or other
  misc_feature (235)..(236): n is a, c, g, or t
  modified_base (238)..(239): a, c, t, g, unknown or other
  misc_feature (238)..(239): n is a, c, g, or t
  modified_base (241)..(241): a, c, t, g, unknown or other
  misc_feature (241)..(241): n is a, c, g, or t
  modified_base (243)..(243): a, c, t, g, unknown or other
  misc_feature (243)..(243): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggngtgttctaggcgcattaaggtcntnngtnnntntgngngnggngntnngcgtggtcgngngctctctgngnnctngntctctnanatnncnngngngtcgcgcgcgcgcgaggaggngnggngtgtcgtgtagtgtgtgtggtggtgtcgcacacgtacgtacgacgacgtacgtacggtaacgggtccggtccgacctactactacacgaacgaactaacgtacgaaacgtaacgtacggtagtacgtcgtcgacgagtagtagacgacgcgacgagacgacgacggacgtaccgtacgttacgttacgttacgtacgacgaacgaaccgtaaccgtacgttcgggttgggttacggttacggttaacggttacggttaccggttaccggtaccggtcgggtaccgggtaccgg

SEQ ID NO: 76111 - DNA, 565 bp, Homo sapiens
  misc_feature: GYAE6OF02JB36N.5.73.G07.1.454.CMB.1.raw
  modified_base (434)..(434): a, c, t, g, unknown or other
  misc_feature (434)..(434): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctcgggtccgccgaggctaccgaggggaggggctgggaggtgggtctcgagttattcgtggtagtggtggtgccacactactacgcagactccggtaaagggccggttcgccatctccagagacaattccaaagtaacacggtttanctgcagatagaacagcctgagacgccgagacgacggtccgtttatacgtgtacgacgaagaccaccgttcgtggtggggttaggttcgtaacgtacgttggttaccgacgttcggtcggggcctaacgggg

SEQ ID NO: 76112 - DNA, 533 bp, Homo sapiens
  misc_feature: GYAE6OF02GA863.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccgagggaaggggctgggagtgggtctcagttattcgtggtagtggtggtgccacatactacgcagactccgtaaagggccggttcgccatctccagagacaattccaaagaacacggtgtatctgcagatgaacagcctgagagccgaggacacggccgttatactgtgacgaagcacctcgtggtgggtggttagtacaacgttggttacgcgttcggtgggacccgg

SEQ ID NO: 76113 - DNA, 563 bp, Homo sapiens
  misc_feature: GYAE6OF02HCJL9.5.73.G07.1.454.CMB.1.raw
  modified_base (360)..(360): a, c, t, g, unknown or other
  misc_feature (360)..(360): n is a, c, g, or t
  modified_base (428)..(428): a, c, t, g, unknown or other
  misc_feature (428)..(428): n is a, c, g, or t
  modified_base (445)..(445): a, c, t, g, unknown or other
  misc_feature (445)..(445): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggcttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccgaggggaaggggctggagtgggtctcgagttattcgtggtaggtggtggtgccanatactacgcagactccgtaaagggccggttcgccatctccagagacaattccaaagaacacggtttancgtgacagatcgaaacngcctagacgagccgaggacaccggtcgttttaatacgtgtacgacgaacgacaccttcgtggtggggtggttagaccgtaacgttcgggttaccgacgtcggtaggggcctaacgggg

SEQ ID NO: 76114 - DNA, 559 bp, Homo sapiens
  misc_feature: GYAE6OF02H46G2.5.73.G07.1.454.CMB.1.raw
  modified_base (258)..(258): a, c, t, g, unknown or other
  misc_feature (258)..(258): n is a, c, g, or t
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtcgtttctaggtggcaattttaaaggtgtccattgtgaggtgcagttgttggagtctgggggaggcttagtacagcctggggggtccctgagactctcctgtgcagcctntggattcacctttgaccaatatgcatnagctggtccgccnggcgtccgagggaagggcgtggaggtgggtcgtcagttagttgtggtagtgtggtgcacatactacgacagactaccgtaaacgggtaccggttcgccgactctccacgagacaactactaacgaacacgtaggtatcttgcagatgacagcgtagagagcgacggacgacgtaccgttacttactagttcgacgtaacgacgaacctctcggtggttggttaggtacgtacgtaggttcggtacgtcgtgggtacccggg

SEQ ID NO: 76115 - DNA, 571 bp, Homo sapiens
  misc_feature: GYAE6OF02F4D2I.5.73.G07.1.454.CMB.1.raw
  modified_base (451)..(451): a, c, t, g, unknown or other
  misc_feature (451)..(451): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtcgtttctaggtggctatttaaaggtgtcattgtgaggtgcagttgttggagtcgtgggggaggcttagtacagcctggggggtccctgagactctcctgtgcagcctctggattcacctttgacaactatgccatgagctgggtccgccaggctccgaggggaagggctgggagtgggtctcgagttattcggtggtagtggtggtgccacatactacgcagactaccggtaaagggccgttcgccatctccagacgacaattccaaagaaccacggtagtactcgtgcaaggactagaacncgcctggaacgacggaccgaggacacgggtcctttaatacgtgtcgacgaagcctaaccgttcgtggttgggtggttacgtaacgtacggttcggttcgacgttcgggacgggtacccgg

SEQ ID NO: 76116 - DNA, 535 bp, Homo sapiens
  misc_feature: GYAE6OF02G33XL.5.73.G07.1.454.CMB.1.raw
  modified_base (358)..(358): a, c, t, g, unknown or other
  misc_feature (358)..(358): n is a, c, g, or t
  modified_base (439)..(439): a, c, t, g, unknown or other
  misc_feature (439)..(439): n is a, c, g, or t
  modified_base (448)..(448): a, c, t, g, unknown or other
  misc_feature (448)..(448): n is a, c, g, or t
  modified_base (472)..(472): a, c, t, g, unknown or other
  misc_feature (472)..(472): n is a, c, g, or t
  modified_base (479)..(479): a, c, t, g, unknown or other
  misc_feature (479)..(479): n is a, c, g, or t
  modified_base (499)..(499): a, c, t, g, unknown or other
  misc_feature (499)..(499): n is a, c, g, or t
tcagatcagacacgcacgaccggtgctcgatttagctctacgctcaggggtctgagagaggagcccagccctgggattttaggtgttttcatttggtgatcaggactgaacagagagaactcaccatggagtttgggctgagctggcttttcttgtggctattttaaaaggtgtccattgtgaggtgcagttgttggagtctgggggaggcttagtacagccgtggggggtccctggagactctcctgtgcagcctctggattcacctttgacaactatgccatgagctgggtccgccaggctccgagggaaggggctggagtgggtctcgagttatcggtggtagtggtggtgccanatactacgcagactccgtaaagggccggttcgccatctccagacgacaattccaaagacacggtgtatctgcagatgaacngcctgagcnccgagacacggtcctttatactgngacgaanacacctctggtgggtggttnaacacgtggttcgacgtcggtggggcctaaccgggg

SEQ ID NO: 76117 - DNA, 644 bp, Homo sapiens
  misc_feature: GYAE6OF02HNZVP.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtgtttctaggcggctatttaaaggtgtcattgtgaggtgcagttgttggagtcgtgggggaggcttagtacagccgtggggggtccctgagactctcctgtgcagcctctggattcacctttgacaactatgccatgagctgggtcccgccgaggctccgaggggaagggctagggaggtgggtctcgtagttattcggtggtagtggtggtgcacgatactacgcagacctccggtaaagggcccgttacgcatcctccagacgacaattccgaaagaacgtacggtgtaactcgtcgacagtactagaacgacgtccgtaggaacggacggccggaaggaacccgtaccggggttacccgtttttaacgttaacgttcggttacggaaccgtaaaaggaccctaaccgttccggttgggttggggttaccgggtttagttaacccgtaacggtttcgggtttaccggaccgtttcgggtcggggggtaacccgg

SEQ ID NO: 76118 - DNA, 673 bp, Homo sapiens
  misc_feature: GYAE6OF02JOM79.5.73.G07.1.454.CMB.1.raw
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (376)..(376): a, c, t, g, unknown or other
  misc_feature (376)..(376): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcgttttctagtggctattttaaaggtgtccattgtgaggtgcagttgttggagtcgtgggggaggcttagtacagccgtgggggtccctggagactctcctgtgcagcctcgnggtnttcacctttgaacaactatgccatgacgtcgtggtcccggcgacggcctccggaggggaacgggcgtggagtgggtctcgagtttagtcgtgggtgtggtgggtcgccanacttacgtcgcacgacgtaccggtaaacggtccggttcgctacgtccaccgagacgactaacttaccgaagaaccgaggttgtaactcgttcgacgtagattacgaaacgtcgtaccgaggaacgaccggacccggaaacggtaacgtacccgggttaccgtttaaactttaccgggtgtaacgtaacggtaaaccgtacccgtaaccgttgggttcgggttacggggtttacggtttaacgtacccgttaacggttccggttaccggtacggtttacccggggacggggtacccgg

SEQ ID NO: 76119 - DNA, 633 bp, Homo sapiens
  misc_feature: GYAE6OF02FLW9G.5.73.G07.1.454.CMB.1.raw
  modified_base (300)..(300): a, c, t, g, unknown or other
  misc_feature (300)..(300): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagttttgggctgagcggtgtcgtttctaggtcggctatttaaaaggtgtcattgtgaggtgcagttgttggagtctgggggaggcttagtacagccgtggggggtccctggagactctcctgtgcagcctctggattcacctttgacaactatgccatgagctgggtccnccaggctccgagggaaggggctggagtgggtctcagttattgtggtgtggtgggtcncanactacacgcacgaaccgttaccggtaaacgggtcccggttccgacctactcctaccgacggaacgaacctaaacttaccgaaaacgaaaccgtacggtacgtactcgtacgctaagacgtacgaactacgtcgtaggacgacgaccggaaggaacgtacggttacgtttaacgttacgtacgtacggacgaaacgaccgtaccgttacgtggggttcgggttaggttacgttaacgtacgttacgggttccgacgttcgggacgggtacccgg

SEQ ID NO: 76120 - DNA, 708 bp, Homo sapiens
  misc_feature: GYAE6OF02JHD41.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtcttttcttgtggctattttaaaggtgtcattgtgaggtgcagttgttggagtcgtggggaggcttagtacagcctgggggtccctgagactctcctgtgcagcctctggattcacctttgacaactatcgccatgagcgtgggtccgccgaggctccgaggggaacggggcgtgggaggtgggtctcgtagtttagttcggtaggttaggtggtgggtcgcccgtacgactacgtacgcgtaagtaccgttccggtaaaaggggtcccggttacgcccgtaattccgtacccgtaagaacggtaacctaacgtttacccgaaaaggaaccgttaacgggttttaactccggtaggacccaaggtactacggaaactacgtccgttagaggacgacccggaaagggaacctacccggggttaaccgtttttataacggttcgtacggaaccgtaacgaccgtaacccgttcggtagggttacgggggttcgggttacgtaaccgtaaccggttgggtttacccgaaccggttcggggttaccgggggacccgtaaccgggg

SEQ ID NO: 76121 - DNA, 575 bp, Homo sapiens
  misc_feature: GYAE6OF02GQTAS.5.73.G07.1.454.CMB.1.raw
  modified_base (451)..(451): a, c, t, g, unknown or other
  misc_feature (451)..(451): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagcgtgggtccgccaggctccgaggggaaggggctgggagtgggctcagttattcggtggtagtggtggtgccagatactacgcagactccgtaaagggccgttcgcctatccgtccagcgacaattccgaagaaccgaggtcgtagtctgacctagatagaaacngcctaggacgaaggcccgaaggaccgacgggtccttttaagtacgtgtacgtacgaacgccgtaacttccgtggtggggttcggttagtaccgaagttcggtacgtacgttcgggcggtaccgg

SEQ ID NO: 76122 - DNA, 533 bp, Homo sapiens
  misc_feature: GYAE6OF02GLAHT.5.73.G07.1.454.CMB.1.raw
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
  modified_base (473)..(473): a, c, t, g, unknown or other
  misc_feature (473)..(473): n is a, c, g, or t
  modified_base (488)..(488): a, c, t, g, unknown or other
  misc_feature (488)..(488): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggctttttcttgtggctattttaaaaggtgtccattgtgaggtgcagttgttggagtcagggggaggcttagtacagcctggggggtccctgagactctcctgtgcagcctctggattcacctttgacaactatgccatgagctgggtccgccaggctccgaggggaaggggctgggagtgggtctcagttatcgtggtagtggtggtgccacatactacgcagactccgtaaagggccgttcgccatctccagagacaattccaaagaacacggttanctgcagatgaacngcctgagacgcgagcacggtccgtttaatacttgngacgaagacaccgtntcgtgggtggttgactaatcgggtacacgtcgtcgggctaacggg

SEQ ID NO: 76123 - DNA, 569 bp, Homo sapiens
  misc_feature: GYAE6OF02FP7EO.5.73.G07.1.454.CMB.1.raw
  modified_base (148)..(148): a, c, t, g, unknown or other
  misc_feature (148)..(148): n is a, c, g, or t
tcagatcagacacgcacgaccggtgctcgatttagctctacgctcaggggtctgagagaggagcccagccctgggattttcgggtgttttcatttggtgatcaggactgaacagagagaactcaccatggagtttgggctgagcgtgngttttctaggtggctattttaaaaggtgtcattgtgaggtgcagttgtttggagtctgggggaggcttagtacagcctggggggtccctgagactctcctgtgcagcctctggattcacctttgacaactatgccatgagctgggtccgccaggctccgaggggaagggctggaggtgggtctcgagtttattcgtggtagtggtggtgccacatacgtacgcgagacgtaccgtaacgggaccggtcgccacgtctccgtagagacaacttacaagaacacggtgtagtactgacagatgaacacgacctgagacgacgacggacgacggtaccgtttattactgtggacgaacgacgacccgttcgtggtgggtggttgtacgtacgtaggttccgacgtcggtcgggtccgaaccggg

SEQ ID NO: 76124 - DNA, 670 bp, Homo sapiens
  misc_feature: GYAE6OF02JD63J.5.73.G07.1.454.CMB.1.raw
  modified_base (148)..(148): a, c, t, g, unknown or other
  misc_feature (148)..(148): n is a, c, g, or t
  modified_base (303)..(303): a, c, t, g, unknown or other
  misc_feature (303)..(303): n is a, c, g, or t
  modified_base (523)..(523): a, c, t, g, unknown or other
  misc_feature (523)..(523): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgngtttctaggtggctatttaaaggtgtccattgtgaggtgcagttgttggagtcgtgggggagcttagtacagccgtgggggtccctgagactctcctgtgcagcctctggcttcacctttgactaactatgccaatgacgcgtcgggtccgccgnggcctccgagggaacgggcgtggaggtgggtctcgagttgttcgtggtagtggtggtgccgatatacgtaacggcagtaccgtccggtaaaagggtcccggtttccggccgtaacttccgttacccgaaggaacgtaaccgtaaactttacccaaaaggtaaaccctaaacgggttacggtaaattcccgttaggaccgtaacgttagacgtaaacgacncccgttaggaacgacgaccggtacggaaccgaccggttaccgttttaagtacccgtgttaacgcggtaaagccgtaacgtcgtgggtgggttacggtacgttacgtaacggtttcggtaccgtaacggttcgggtcgggtacccggg

SEQ ID NO: 76125 - DNA, 666 bp, Homo sapiens
  misc_feature: GYAE6OF02FFHM7.5.73.G07.1.454.CMB.1.raw
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (178)..(178): a, c, t, g, unknown or other
  misc_feature (178)..(178): n is a, c, g, or t
  modified_base (183)..(184): a, c, t, g, unknown or other
  misc_feature (183)..(184): n is a, c, g, or t
  modified_base (228)..(228): a, c, t, g, unknown or other
  misc_feature (228)..(228): n is a, c, g, or t
  modified_base (349)..(349): a, c, t, g, unknown or other
  misc_feature (349)..(349): n is a, c, g, or t
  modified_base (517)..(517): a, c, t, g, unknown or other
  misc_feature (517)..(517): n is a, c, g, or t
tcagatcagacacgcacgaccggtgctcgatttagctctacgctcaggggtctgagagaggagcccagccctgggattttcaggtgttttcatttggtgatcaggactgaacagagagaacctcaccagtggagtttgggctgagcggtgtcgttcgtagtgactattaagntcntgngagtnntgttgtgagtgtagggatctagcgcggtcgtcgggtacctgacnctcgtctaggcgacctgtcctgtactactcgtacttacgacaacttcgcgcctaggtcgtccggtcgtccggcgaacgtacggtccggtacgggtaaggacgggtgttggtcgtccggttntaacggttagttccggtggtaccgggtgttcggtacacaccgttactaccggactaaccgtacggaaccggtaccggttaacccggtcggtccctacacctacgaccaacggaatttaccaaaccgttaacgtaaccacggttaaccgtcggaagttcctaccggaanacgtaacgtacgacgtccgacgtaggtacgaccggtaaccgtaggtaccgtacgttacgactacggcaacgtactcgtacgtcgttagggtcgtacggttacgtacgtacgttcgtcggtacccggcggtaccgtaccggaccgtaccg

SEQ ID NO: 76126 - DNA, 560 bp, Homo sapiens
  misc_feature: GYAE6OF02GIZ1B.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccgagggaaggggctggagtgggtctcagttattcgtggtagtggtggtgccacatactacgcagactccggtaaagggccggttcgccatctccagagacaattccaaagaacacggtgtatctgacagatgaacagcctagagacgccggaggaccacgggtccgtttaattacgtgtgacgaaagaccaccgttcgtggtcggggttgggttagtaccgtacgttgggttaccgacgttcgggtggggacccgg

SEQ ID NO: 76127 - DNA, 542 bp, Homo sapiens
  misc_feature: GYAE6OF02HUUHC.5.73.G07.1.454.CMB.1.raw
  modified_base (395)..(395): a, c, t, g, unknown or other
  misc_feature (395)..(395): n is a, c, g, or t
  modified_base (422)..(422): a, c, t, g, unknown or other
  misc_feature (422)..(422): n is a, c, g, or t
  modified_base (474)..(474): a, c, t, g, unknown or other
  misc_feature (474)..(474): n is a, c, g, or t
  modified_base (531)..(531): a, c, t, g, unknown or other
  misc_feature (531)..(531): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctgggtcccgccaggctccaggggaaggggctgggagtgggtctcagttattcgtggtagtggtggtgccacatactacgcagactcgtaaagggccgttcgccatcnccagagacaattccaaagaacacggtntatctgcagatgaacagcctgagacgccgaggaccacggtcctttatactgngacgaagaccgaccttctggtgggtggttgtaacgtacgttggttccgacttcgggnggggaacccgg

SEQ ID NO: 76128 - DNA, 582 bp, Homo sapiens
  misc_feature: GYAE6OF02F0V8W.5.73.G07.1.454.CMB.1.raw
  modified_base (433)..(433): a, c, t, g, unknown or other
  misc_feature (433)..(433): n is a, c, g, or t
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtcgtttctaggtggctatttaaaaggtgtcattgtgaggtgcagttgttggagtctgggggaggcttagtacagcctggggggtccctgagactctcctgtgcagcctctggattcacctttgacaactatgccatgagctgggtcccgccaggcctccgaggggaaggggctgggagtgggtctcgagtttagtcgtggtagtggtggtgccagatactacgtagactaccggtaaaggcccggttgccagtcctccagacgacaattccaaagaacacgggtntatctgcagntagaacngcctagacgagccgaagacacgggtccgtttaataccgtgttcgacgtaaggacctaccgtcgtaggttcggggttgggttactaacctaaggtttgggttccaacggtccggttgggggccctaaccgggg

SEQ ID NO: 76129 - DNA, 545 bp, Homo sapiens
  misc_feature: GYAE6OF02FQMDX.5.73.G07.1.454.CMB.1.raw
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggcttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccgagggaaggggctgggagtgggtctcgagttattcgtggtagtggtggtgccacatactacgcagactcgtaagggccgttcgccatctccagagacattccaagaacacggtntatctgcagatgaacngcctgagagccgaggacacgtccgttaatacgtgtcgacgaagacctcctcgttggtagggttcgggttcgtaacgtaacgttcggttcgacgttcgggtggggtaccccg

SEQ ID NO: 76130 - DNA, 530 bp, Homo sapiens
  misc_feature: GYAE6OF02F4KAY.5.73.G07.1.454.CMB.1.raw
  modified_base (485)..(485): a, c, t, g, unknown or other
  misc_feature (485)..(485): n is a, c, g, or t
  modified_base (521)..(521): a, c, t, g, unknown or other
  misc_feature (521)..(521): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccgagggaaggggctgggagtgggtctcagttattcgtggtagtggtggtgccacatactacgcagactccgtaaagggccggttcgccatctccagagacaattccaaagaacacggtgtatctgcagatgaacagcctgagagccgaggacacggcctttatactgtgcgaaagcacctntgtgggtggttgtacgaactggttacgacgttcggngggtacccg

SEQ ID NO: 76131 - DNA, 666 bp, Homo sapiens
  misc_feature: GYAE6OF02JM2I6.5.73.G07.1.454.CMB.1.raw
  modified_base (479)..(479): a, c, t, g, unknown or other
  misc_feature (479)..(479): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagcctggggggtccctgagactctcctgtgcagcctctggattcacctttgacaactagtgccatgagcgtgggtcccgtcacggcctccgaggggaacgggctgggagtgggtctgagttagtcggtggtagtggtggtgccactatacgtacgcagacgtaccggtaaagggtcccgttacgcctatccgacgagacgacaacgttcccaaagtaccgacggtacgtaactcgtagaccgtagtacgtacgaaacncggtaccgtaggaacggaccggaaccggaacgggaacccgtaaccgggtttacccgtttaagttaccgtagggtaccgtacggaaacggtaccctaccgttcgtacggggttacggggttacgggtttaacgtaacccgtaaggtttccgggtaccggtaaccggttcgggtaccggggtaacccgg

SEQ ID NO: 76132 - DNA, 762 bp, Homo sapiens
  misc_feature: GYAE6OF02H5DBP.5.73.G07.1.454.CMB.1.raw
  modified_base (149)..(149): a, c, t, g, unknown or other
  misc_feature (149)..(149): n is a, c, g, or t
  modified_base (173)..(173): a, c, t, g, unknown or other
  misc_feature (173)..(173): n is a, c, g, or t
  modified_base (253)..(253): a, c, t, g, unknown or other
  misc_feature (253)..(253): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgngtttctaggtggctatttaaaggngtcatgtgaggtgcagttgttggagtctgggggaggcttagtacagcctggggggtccctgagctctcctgtgcagcctntggattcacctttgacaactatcggccatgagctggtccgccaggcgtccgacgggaaggggcgtaggtaggtggggtcgtcctaggttagtttcggttgggttaggttgggttgggttgggtccgaccataacttaacggccagacgtcccgtaaaacggggtaccgggtttaccggtaccgacgtacttcccacgaaggaacgaaactttacccctaaaagtaaaccgaaacccgggtcgggttaaacgtttacgttacgtacgtaagtaacgtaacgtaacgtaacgtaccgtacggaacggaaccggaccgggaacgggtaaccggtaaccgggttaaccggtttaacgtttaaccgttacggttacggtaaccggtaaaccggtaaccgtaacccgttaccggttacgggttacggggtttacggggtttaccgggttaaccggttaaccggttaaccgggttaccgggttaccggttaccggggttaccggggtaacccgggg

SEQ ID NO: 76133 - DNA, 573 bp, Homo sapiens
  misc_feature: GYAE6OF02FRQFU.5.73.G07.1.454.CMB.1.raw
  modified_base (300)..(300): a, c, t, g, unknown or other
  misc_feature (300)..(300): n is a, c, g, or t
  modified_base (435)..(435): a, c, t, g, unknown or other
  misc_feature (435)..(435): n is a, c, g, or t
  modified_base (451)..(451): a, c, t, g, unknown or other
  misc_feature (451)..(451): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcttttcttaggtggctaattttaaaaggtgtccattgtgaggtgcagttattggagtctgggggaggcttagtacagcctggggggtccctgagactctcctgtgcagcctctggattcacctttgacaactatgccatgagctgggtccnccgaggctccgagggaaggggctgggaggtgggtctcgagttattcgtggtagtggtggtgccacatactacgcagactccggtaaagggcccggttcgccatcctccagacgactaattccaaagaacacggtntatctgcagatgaacngcctgagacgaccgaggacgaccggtacgtttatacctgtacgacgaaagccaccgtctagggtgggttaggttacgtaaccgtaacgttcgggttacgaccgttcgggtaggggaccccgg

SEQ ID NO: 76134 - DNA, 535 bp, Homo sapiens
  misc_feature: GYAE6OF02HBSK0.5.73.G07.1.454.CMB.1.raw
  modified_base (401)..(401): a, c, t, g, unknown or other
  misc_feature (401)..(401): n is a, c, g, or t
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
  modified_base (485)..(485): a, c, t, g, unknown or other
  misc_feature (485)..(485): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccaggggaagggctgggagtgggtctcagttattcgtggtagtggtggtgccacatactacgcagactccgtaaagggccggttcgccatctccaganacaattccaagaacacggtgtactcgtgcagatgaacngcctgagngcgagacacgtctttatactgtcgacgaagacaccgtntggtgggtggttagactacgttggttacgacgttcgggtagggtacccgg

SEQ ID NO: 76135 - DNA, 580 bp, Homo sapiens
  misc_feature: GYAE6OF02I5UNQ.5.73.G07.1.454.CMB.1.raw
  modified_base (201)..(201): a, c, t, g, unknown or other
  misc_feature (201)..(201): n is a, c, g, or t
  modified_base (280)..(280): a, c, t, g, unknown or other
  misc_feature (280)..(280): n is a, c, g, or t
  modified_base (510)..(510): a, c, t, g, unknown or other
  misc_feature (510)..(510): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggcttttctgtggctattttaaaggtgtccattgtgaggtgcagttgttggagtntgggggaggcttagtacagccgtggggggtccctggagactctcctgtgcagcctctggattcacctttgaccaatatnccatgagcgtgggtccgccaggcctccgaggggagggctgggagtggggtctacgagttattcggtggtagtggtggtacgccgacatactacgctagactacccggtaaaggggccgtttcgccctaagtctacccgagacgaacacttaccaaacgtaacgtaacggttacttcgaggtcctaagaatgaaactgcctagagacgcgagacacggtccttatactggnaacgtagactacgtcgtaggtgggtaggttacgagtaactgggttaccagttcgggagggcctaacgggg

SEQ ID NO: 76136 - DNA, 544 bp, Homo sapiens
  misc_feature: GYAE6OF02GDHML.5.73.G07.1.454.CMB.1.raw
  modified_base (423)..(423): a, c, t, g, unknown or other
  misc_feature (423)..(423): n is a, c, g, or t
  modified_base (440)..(440): a, c, t, g, unknown or other
  misc_feature (440)..(440): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccgagggaaggggctgggagtgggtctcgagttattcgtggtagtggtggtgccacatactacgcagactccgtaaagggccggttcgccatctccagagacaattccaagaacacggtntatctgcagatagaacngctgagagaccgaggacacgggtcctttatacgtgtgacgaaagacacctcgtggtgggttggttacgtacaacgttggttacgacgttcggtggggtacccgg

SEQ ID NO: 76137 - DNA, 631 bp, Homo sapiens
  misc_feature: GYAE6OF02GBV9P.5.73.G07.1.454.CMB.1.raw
  modified_base (173)..(173): a, c, t, g, unknown or other
  misc_feature (173)..(173): n is a, c, g, or t
  modified_base (327)..(327): a, c, t, g, unknown or other
  misc_feature (327)..(327): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtgttctaggcggctatttaaaggtntcatgtgaggtgcagttgttggagtctggggaggcttagtacagccgtggggggtccctgagactctcctgtgcagcctgtggattcacctttgaacaactatcgccatgagctgggccgccaggctccgagggaaggggctggagtgggtctnagttattgtggtagtggtggtgccacagtacctaggcagactccggtaaagggccgttcgaccagtctaccgagagacctaaattcccaaagaaaccgtacgggtagtaacttcgttggaccagaacgtagtaacaacgccgtaggagacggaccggacgggacggtaccggtaccggtttaacgtttaccgttagtacgtacgaaacgaaccgtacccgtaccgttacggttgggttacgggttacggttacggttaacgttacggttacggttacggttaccgggtacggggtaacccgggg

SEQ ID NO: 76138 - DNA, 601 bp, Homo sapiens
  misc_feature: GYAE6OF02I1IFN.5.73.G07.1.454.CMB.1.raw
  modified_base (397)..(397): a, c, t, g, unknown or other
  misc_feature (397)..(397): n is a, c, g, or t
  modified_base (406)..(406): a, c, t, g, unknown or other
  misc_feature (406)..(406): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggctttttctgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccgaggggaagggctggagtgggtctcagttatcgtggtagtggtggtgccacatactacgcacgactcgtaaagggccgttcgcatctcaganacatccaanacacggtgtatctgcagatacgaacacgccgtagaggacgaccggaggaccgaccgggttaccgtttaattaccgtagtcgacgaaacgtacccgtaacccgttcgttaggggttcggggttaggggttttacgtaaccggttaacggtttcggggttacccggtaccggttccggggtcggggtaaccccgggg

SEQ ID NO: 76139 - DNA, 569 bp, Homo sapiens
  misc_feature: GYAE6OF02GY1NI.5.73.G07.1.454.CMB.1.raw
  modified_base (400)..(400): a, c, t, g, unknown or other
  misc_feature (400)..(400): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctgggtcccgccaggctccgagggaaggggctgggagtgggtctcagttatcgtggtagtggtgggtgccacatactacgcagactccggtaaagggcccggttcgccatccnccagacgacaattccaaagacacggtagtatctgcagatagaacacgctaggagagccgaggaccgacggtccgtttatacgtgtacgacggaaacgaccaccgttcgtggtagggttgggttatacgtaaccggttgggttaccgtacgttccgggaggggtacccgg

SEQ ID NO: 76140 - DNA, 619 bp, Homo sapiens
  misc_feature: GYAE6OF02HX0N9.5.73.G07.1.454.CMB.1.raw
  modified_base (193)..(193): a, c, t, g, unknown or other
  misc_feature (193)..(193): n is a, c, g, or t
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtcgtttctaggtcggctattttaaaaggtgtccattgtgaggtgnagttgttggagtctgggggaggcttagtacagctggggggtccctgagactctcctgtgcagcctntggattcacctttnacaactatgccatgagctgggtccgccaggcnccaggggaagggtcnggtgtgggtctcaaggtttnttggtggtgttggtggtcncatatactacgacgagactacggtaacggcgtcgacctactcaccgagaacgtaactaacttaccgaaaacgtaaccgacggttattaacgtccgagacgaagactagaacgacgtacgtacgacgacgacggacggtacgtaccggttaccgtttacgttacgtacgtacgacgaacgtaaccgtaccgtcgttcggttcgggttagggttacggttacgtacggttacggttaccggtacggtcggtacgggtaccgg

SEQ ID NO: 76141 - DNA, 549 bp, Homo sapiens
  misc_feature: GYAE6OF02HV79J.5.73.G07.1.454.CMB.1.raw
  modified_base (444)..(444): a, c, t, g, unknown or other
  misc_feature (444)..(444): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagccgtggggggtccctgagactctcctgtgcagcctctggattcacctttgacaactatgccatgagcgtgggtccgccaggctccgaggggagggctgggagtgggtctcgtagttattcggtggtagtggtggtgccacatactacgcagactccgtaaagggccggttcgccatctccagagacaattccaaagaacacggtgtatctgcagatgaacngctgagacgcgaggaccacggtccgtttatacgtgtgacgaaacgccacctcgtggtgggttacggttagtaacgtacgttggttcgacgtcgggtgggacccgg

SEQ ID NO: 76142 - DNA, 616 bp, Homo sapiens
  misc_feature: GYAE6OF02JJ56H.5.73.G07.1.454.CMB.1.raw
  modified_base (174)..(174): a, c, t, g, unknown or other
  misc_feature (174)..(174): n is a, c, g, or t
  modified_base (188)..(188): a, c, t, g, unknown or other
  misc_feature (188)..(188): n is a, c, g, or t
  modified_base (214)..(214): a, c, t, g, unknown or other
  misc_feature (214)..(214): n is a, c, g, or t
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (241)..(241): a, c, t, g, unknown or other
  misc_feature (241)..(241): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
tcagatcagacacgcacgaccggtgctcgatttagctctacgctcaggggtctgagagaggagcccagccctgggattttcaggtgtttcatttggtgatcaggactgaacagagagaactcaccatggagtttgggctgagcggcgtggttctaggtcggctaatttaaaggngtcatgtgagtgcngttgtgagtgtggggagcttaagtgngcgtgggtcctagagctctctgngngngctctgtgtctactcgtatactatncatgngtcgtcgtcgcgcgcgcgacggaggacgtggtgtggtcgtgtagtagtcggtggtaggtggtggtcgtacgtacgtacgtacgtacgtacgtacgtacgtacggtaacggtacggtccgtacgtactacgtacgtacgacgtaacgtaacgtacgtaacgtaacgtacgtagtacgtacgtacgtacgacgtacgtacgtacgacgacgtacgacgacgacgacggtacgtacgtacgttacgttacgtacgtacgtacgtaacgtaaccgtaccgtacggtcggttacggttacggttacggtacgtacggttaccggttacggtacggtacggtacggtacgg

SEQ ID NO: 76143 - DNA, 776 bp, Homo sapiens
  misc_feature: GYAE6OF02GTH4S.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgcttttctgtggctattttaaaggtgtccattgtgaggtgcagttgttggagtcgtgggggaggcttagtacagccgtggggggtccctgagactctcctgtgcagcctctggattcacctttgacaactatgccatgagcgtcggggtcccgccgacggcctccgaaggggaacggggcgtgggaggtgggtctcgtagtttagttcggtggtaggtggttggtgacccacgaattacgtaacgcgaacgtaaccgttaccgggtaaaacggggtcccgggtttaccgaccctaacgttccgtacccgaagtaacggaacctaaacgttacccgaaaagaaaccggtacggttacgttaactcgtagaccgaagaacgttacgaaacgtacgccgttagggaaacgtacgggacccggaaaggggaccgtaacccggggttaccgtttttaaacgttaccgtacgggtttacgggaacccggtaaaaacggtacccgtaaccccggtttacgggtttacgggggtttacgggggtttacggggtttaacgttaacccggttaacccggggttttgggtttaaccccgggtaccgggtttacccgggggttacgggggtaaccccccggg

SEQ ID NO: 76144 - DNA, 542 bp, Homo sapiens
  misc_feature: GYAE6OF02FYDRD.5.73.G07.1.454.CMB.1.raw
  modified_base (420)..(420): a, c, t, g, unknown or other
  misc_feature (420)..(420): n is a, c, g, or t
  modified_base (436)..(436): a, c, t, g, unknown or other
  misc_feature (436)..(436): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccgagggaaggggctgggagtgggtctcagttattcgtggtagtggtggtgccacatactacgcagactcgtaaagggccggttcgccatctcagagacaattccaagaacacggtntatctgcagatgaacngctagagagcgaggacacggtcgtttatacctgtgacgaagaccacctactggtgggtcggttagtacgtaacgttcggttacgacgttcgggtcgggtacccggg

SEQ ID NO: 76145 - DNA, 553 bp, Homo sapiens
  misc_feature: GYAE6OF02H6WOX.5.73.G07.1.454.CMB.1.raw
  modified_base (433)..(433): a, c, t, g, unknown or other
  misc_feature (433)..(433): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgaggactctcctgtgcagcctctggattcacctttgacaactatgccatgagctggtccgccaggctccgaggaagggctggagtggtctcgagttattcggtggtagtggtggtgtccacatactacggcagactaccggtaaagggcccggttcgccatctcagagacaatacaagaacaacggtagtatctganacgatagaacagcctgaagacgaccgaggaccgacgtaccgtttaataacgtgtagacgaaagaccaactccgtgtgggtggttgtacgtaactcggttacgacgtcggtgggaacccgg

SEQ ID NO: 76146 - DNA, 611 bp, Homo sapiens
  misc_feature: GYAE6OF02IVZ74.5.73.G07.1.454.CMB.1.raw
  modified_base (329)..(329): a, c, t, g, unknown or other
  misc_feature (329)..(329): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggcttttctgtggctattttaaaaggtgtccattgtgaggtgcagttgttggagtctgggggaggcttagtacagcctggggggtccctgagactctcctgtgcagcctctggattcacctttgacaactatgccatgagctgggtccgcaggctccgagggaagggctgggagtgggtctcgngttattcggtggtagtgggttggtgccgacatactacgtcaacgtactacccggtaaagggcccggttcgaccatcctccagacgacaattcccaaagaccacggtgacttctgccagatagaacgtagccctaggaacggacggacccgagggaccaccgggttcccgtttaagtacgtggtacgaccgaaaaggcctaaccgttacgtggttcgggggtagggtttacgtaaccgtaacgttccggggtttaccgaccggttcgggcgggggtaacccgg

SEQ ID NO: 76147 - DNA, 560 bp, Homo sapiens
  misc_feature: GYAE6OF02HR50W.5.73.G07.1.454.CMB.1.raw
  modified_base (326)..(326): a, c, t, g, unknown or other
  misc_feature (326)..(326): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctgggtcccgcaggctccagggagggctggagtgggtcncgtagttattcggtggtagtggtggtgccacatactacgcagactccggtaaagggcccggttcgccatctcagagacattcaagaacacggtatatctgcagatagaacagctaggagaggcccgaggaccgacggtccgtttaatacgtgtgacgaaggtaccacgttcgtggtcgggttgggttagtaccgtaacggttggttaccgtacggttcggtcggggtaacccgg

SEQ ID NO: 76148 - DNA, 552 bp, Homo sapiens
  misc_feature: GYAE6OF02F3PSQ.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggcttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccgagggaaggggctggagtgggtctcagttattcgtggtagtggtggtgcacatactacgcagactcgtaaagggccgttcgcatctcagagacaattaccaagaacacggtagtatctgcagactgaacacgcctagagacgaccgaggacacgggtaccgtttattacgtgtcgacgaacgacgtaaccctgtaggtgggttggttgtacgtacgttcggttacgaccggttcggtcgggtacccgg

SEQ ID NO: 76149 - DNA, 536 bp, Homo sapiens
  misc_feature: GYAE6OF02I4AM8.5.73.G07.1.454.CMB.1.raw
  modified_base (329)..(329): a, c, t, g, unknown or other
  misc_feature (329)..(329): n is a, c, g, or t
  modified_base (356)..(356): a, c, t, g, unknown or other
  misc_feature (356)..(356): n is a, c, g, or t
  modified_base (443)..(443): a, c, t, g, unknown or other
  misc_feature (443)..(443): n is a, c, g, or t
  modified_base (471)..(471): a, c, t, g, unknown or other
  misc_feature (471)..(471): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtgtttctaggtggctattttaaaggtgtcattgtgaggtgcagttgttggagtctgggggaggcttaggtacagcctggggggtccctgagactctcctgtgcagcctctggattcacctttgacaactatgccatgagctgggtccgccaggctccgaggggagggctgggagtgggtctnagttattcgtggtagtggtggtgccanatactacgcagacctcgtaaacgggccgttcgccatcctaccgagagacaacttccaaagaacacggtgtactctagcagatgaacncgctgagacgcgagactacgtcttatgngtagacgaacacctacgtgtggtgggttagttagtactagttcggtcgacggtcggtcgggaccg

SEQ ID NO: 76150 - DNA, 738 bp, Homo sapiens
  misc_feature: GYAE6OF02IIMIE.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttctgtggctattttaaaaggtgtccattgtgaggtgcagttgttggagtctgggggaggcttagtacagccgtggggggtcccgagactctcctgtgcagcctctggattcacctttgacaactatgccatggactcggtccggtccacggcgtcctacggggaagggggcggtcggtaggtgggtcgtcctaggttacgtttacggttcgggtaggttagggttggggttggcccgacctataaccgttaccgtacgacgaaccgtacccgttaaaacggggtacccgggttcccgggtcccgaacctaccgttacccgtacgaacggaaccgaaacttaaccgtaaaccgaaacgaaccggtacggtacttacgtcgtacgaacgtagtacgtaaaccgaacgtacctacggtaggaacggtaccggacgggaaccgaaccgggtaccgggtttactttaacgtcggttaggaagtaaacgaacgacccgttaccgtcggttaggggttggggtttacggttacgtaaccgttcggtttacgggttaccgtccgggttacgggtcccgggacggtaaccccggg

SEQ ID NO: 76151 - DNA, 545 bp, Homo sapiens
  misc_feature: GYAE6OF02I0WWB.5.73.G07.1.454.CMB.1.raw
  modified_base (357)..(357): a, c, t, g, unknown or other
  misc_feature (357)..(357): n is a, c, g, or t
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
  modified_base (477)..(477): a, c, t, g, unknown or other
  misc_feature (477)..(477): n is a, c, g, or t
tcagatcagacacgcacgaccggtgctcgatttagctctacgctcaggggtctgagagaggagccccagccctgggattttcaggtgttttcatttggtgatcaggactgaacagagagaactcaccatggagtttgggctgagctggctttttctgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccgaggggaaggggctggagtgggtctcagttatcgtggtagtggtggtgccanatactacgcagactccgtaaagggccggttcgccatctccagagacaattccaagacacggtgtatcgtgcagatagaacngcctgaacgngaccgaggacgacggtccgtttattacgngtgacgaaagacacctcgtggtggggttggttgtacgtacgttggttcgacgttcggtgggtacccgg

SEQ ID NO: 76152 - DNA, 604 bp, Homo sapiens
  misc_feature: GYAE6OF02G7JFP.5.73.G07.1.454.CMB.1.raw
  modified_base (463)..(463): a, c, t, g, unknown or other
  misc_feature (463)..(463): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctattttaaaaggtgtccattgtgaggtgcagttgttggagtcgtgggggaggcttagtacagccgtggggggtccctgagactctcctgtcgcagcctctggattcacctttgacaactatgccatgagctgggtcccgccgaggcctccgaggggaacgggctgggagtgggtctcgtagttattcggtggtagtggtggtcgccacatacacgcaacgacgtaccggtaaacgggccggttcgaccgtactcctaccaaggaacgaacctaaacttaccgaaagtaacctacggtttanctgacagatagaacagcctgagacgacggacgtacaaccggtctttaagtacgtgtagaacgtaacacctaccgtcgtaggtggggtacggttacgtaactaacgttcgggttaccacggttcggacgggacccaacgggg

SEQ ID NO: 76153 - DNA, 562 bp, Homo sapiens
  misc_feature: GYAE6OF02GERAX.5.73.G07.1.454.CMB.1.raw
  modified_base (358)..(358): a, c, t, g, unknown or other
  misc_feature (358)..(358): n is a, c, g, or t
  modified_base (436)..(436): a, c, t, g, unknown or other
  misc_feature (436)..(436): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgtttctaggtcggctaatttaaaggtgtcattgtgaggtgcagttgttggagtctgggggaggcttagtacaggcctggggggtccctgagactctcctgtgcagcctctggattcacctttgacaactatgccatgagctgggtccgcaggctccgaggggaaggggcttgggagtgggtctcgtagttattcgtggtagtggtggtncgacatactacgcagactaccggtaaagggcccggttcgacctagtcctccagacgactaattccaaagaacacggtntatcagcagatgaacagcctgagacgtcgaggacgacggttccttattacgtgtgaccgaagtaccactcgtacggtgggttacggttagactacggttgttaccgacgttcgggcgggtacccgg

SEQ ID NO: 76154 - DNA, 580 bp, Homo sapiens
  misc_feature: GYAE6OF02GUGAJ.5.73.G07.1.454.CMB.1.raw
  modified_base (361)..(361): a, c, t, g, unknown or other
  misc_feature (361)..(361): n is a, c, g, or t
  modified_base (456)..(456): a, c, t, g, unknown or other
  misc_feature (456)..(456): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaggtgtccattgtgaggtgcagttgttggagtcgtggggaggcttagtacagccgtgggggtccctgagactctcctgtgcagcctctggattccacctttgacaactatgccatgagctggtccgccaggctccgagggaacgggctggaggtggtctcgtagttagttcgtggtaggtggtggtcgccanactactacgcagactccggtaaacgggtccggttacgctatctaccagacgactaattccaaagaaccgacggtagtactcgtgcagatagaacncgacctgacgcggaccgaggaccgacggtaccgtttatacgtgtcgacgaacgaccaccgttcgtgggttgggttacggtttagaccgtacggttggtccgtacgtcgggtacgggtaacccgg

SEQ ID NO: 76155 - DNA, 704 bp, Homo sapiens
  misc_feature: GYAE6OF02IIB8J.5.73.G07.1.454.CMB.1.raw
  modified_base (177)..(177): a, c, t, g, unknown or other
  misc_feature (177)..(177): n is a, c, g, or t
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
  modified_base (274)..(274): a, c, t, g, unknown or other
  misc_feature (274)..(274): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtcgtcgtttctaggcggctaatttaaaggtntcatgtgagtgcagttgttggagtgtggggaggtnttagacagccgtggggggtccctggagacttctcctgtgnacgcctgtggtcttctcctttnaacaactatcgccatgagtcgttcgggtacccgcgacggccgtaccggaaggggaacgggcgtagggtagggtcggtctacgttagttagttggttggtggtggtcgtcgcactactacgtacgactacgtaacgttaaccgggtaacgggtcccgtcgaccgtactaccgacgaggaacctaactaacgtaacgaaacgaacgtgggttataacgtcgtaacgctaagtacgaacgacctacggccgagaaccggaccgacggaacggaccgtttaccggttaaccgttttagacgttacggacaaccggaaaccgttccttaaaccggttacggttaggggttgggtttaccggttaaaacggtccgttaaccggggttaccggtttacccgggtaaccgggtttaccggggtcggtaaaccccgggg

SEQ ID NO: 76156 - DNA, 545 bp, Homo sapiens
  misc_feature: GYAE6OF02HSPDX.5.73.G07.1.454.CMB.1.raw
  modified_base (257)..(257): a, c, t, g, unknown or other
  misc_feature (257)..(257): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctntggattcacctttgacaactatgccatgagctgggtccgccaggctccgagggaagggctggagtgggtctcagttattcgtggtagtggtggtgccacatactacgcagactccgtaaagggccggttcgccatctccagagacaattcaaagaacacggtagtatctgacagatagaacagcctgagacgaccgaggaccacggtccgtttatacgtgtgacgaaagacgactacgtggtgggtggttgtaccgtacgtggttaccgacgttcggtgggtacccgg

SEQ ID NO: 76157 - DNA, 674 bp, Homo sapiens
  misc_feature: GYAE6OF02IIYYN.5.73.G07.1.454.CMB.1.raw
  modified_base (253)..(253): a, c, t, g, unknown or other
  misc_feature (253)..(253): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtcgttttctaggtggctatttaaaaggtgtcattgtgaggtgcagttgttggagtcgtgggggaggcttagtacagcctggggggtccctgagctctcctgtgcngcctctggattcacctttgacaactatcgccatgagcgtcgggtcccgccgaggccgtccgaggggaggggccgtgggaggtgggtctcgtagtttattcggtaggtaggttcggtggtcgaccgtatactacgtacgtcacgaaccgttaccggtaaacggggtcccggtttacggccctatacccgttccaaggtacgaactaacgttacaaacggtaacgtacgggtcgttaatccgtcgtacagtactacgaacaggtccctaggaggaccgaccgggaacggaccgaccggttccgtttaactacgttaggtggtaccgaaacgtaccgtaaccgttcggttacggggttaggggtttacggttacgttacggtaacgtttcgggtacgtaccggtcgggtacggggtaaccccgg

SEQ ID NO: 76158 - DNA, 628 bp, Homo sapiens
  misc_feature: GYAE6OF02HET2H.5.73.G07.1.454.CMB.1.raw
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
tcagatcagacacgcacgaccggtgctcgatttagctctacgctcagggggtctgagagaggagcccagccctgggattttcaggtgttttcatttggtgatcaggactgaacagagagaactcaccatggagtttgggctgagcgtggcttttctagtggctatttaaaggtgtccattgtgaggtgcagttgttggagtcgtgggggaggcttagtacagccgtggggggtccctgagactctcctgtgcagcctctggattcacctttgacaactatgccatgagctgggtccgccaggcctccgaggggaacggggctgggagtgggtctcgagttagttcgtggtagtggtggngtcacgtntacacgcagacgtacggtaaagggccgttcgcctatctccagagacaattccaagaacacggtgtatctgactagatagaactacgcctaggaacggtcgacccggaaggaacctaccggggttccttttaacgttacgttacggtacggaccggtaaagtacccgtaaccgttcgtagggttcgggggttacgggtttacgtaaccggtaacggtttcgggttacccgtacggttaccgggggtacgggtaaccccgggg

SEQ ID NO: 76159 - DNA, 620 bp, Homo sapiens
  misc_feature: GYAE6OF02FPQSN.5.73.G07.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
  modified_base (393)..(393): a, c, t, g, unknown or other
  misc_feature (393)..(393): n is a, c, g, or t
  modified_base (422)..(422): a, c, t, g, unknown or other
  misc_feature (422)..(422): n is a, c, g, or t
  modified_base (444)..(444): a, c, t, g, unknown or other
  misc_feature (444)..(444): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttggggctgagcggtgtgtttctaggtcggctaatttaaaggtgtcattgtgaggtgcagttgttggagtntgggggaggcttagtacagcctggggggtccctgagctctcctgtgcagcctctggnttcacctttgacaactatgccatgagctgggtccgccaggcctccgagggaacggggctggcgtgggtctcagtttntcggtggtagtggtggtgccantactagcagactcgtaacggccgttcgcagtcncagagactagttaccaagtaacacgggtntatctcgactagagtgaaaccncgtacaggaaggcggaccgtaacggtaccgtaccgggtttaccgtttaagttaccgtaggtacgaacgtaacgtacccgtaccggttaggttcggggtcgggtttacgggttaacgttaaccggtaccgggtttcgggttacccggtaccgggttccggggtaccggggtacccgg

SEQ ID NO: 76160 - DNA, 553 bp, Homo sapiens
  misc_feature: GYAE6OF02HTQ3V.5.73.G07.1.454.CMB.1.raw
  modified_base (190)..(190): a, c, t, g, unknown or other
  misc_feature (190)..(190): n is a, c, g, or t
  modified_base (258)..(258): a, c, t, g, unknown or other
  misc_feature (258)..(258): n is a, c, g, or t
  modified_base (356)..(356): a, c, t, g, unknown or other
  misc_feature (356)..(356): n is a, c, g, or t
  modified_base (459)..(459): a, c, t, g, unknown or other
  misc_feature (459)..(459): n is a, c, g, or t
  modified_base (494)..(494): a, c, t, g, unknown or other
  misc_feature (494)..(494): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgttttctaggtggctatttaaaggtgtcattgtgaggtgcngttgttggagtcgtgggggaggcttagtacagccgtggggggtccctgagactctcctgtgcagcctntggattcacctttgacaactatgccatgagcgtggccgcaggctccgagggacgggctggagtgggtctcgtgttattcgtggtagtggtggtgccanatacacgcagacctaccggtaaaggcccggttcgcctagtcctccgagacgactaacttccaaagaccaggtagtatctggcaggatagaacacgcctagagngccgaggaccaggtccgttatacgtgtagacgaanaccgactcgtggtgggttggtagtacgtacgtggttacggacttccgggggtaacccgg

SEQ ID NO: 76161 - DNA, 537 bp, Homo sapiens
  misc_feature: GYAE6OF02FHS9G.5.73.G07.1.454.CMB.1.raw
  modified_base (256)..(256): a, c, t, g, unknown or other
  misc_feature (256)..(256): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggcttttcttgtggctattttaaaaggtgtccattgtgaggtgcagttgttggagtctgggggaggcttagtacagcctggggggtccctgagactctcctgtgcagcctntggattcacctttgacaactatgccatgagctgggtccgccaggctccagggaaggggctgggagtgggtctcagttattcgtggtagtggtggtgcacatactacgcagactccgtaaagggccggttcgcatctcagagacaattcaagaacacggtgtatctgcagatgaacagcctgaggagccgaggacgacggccgtttattactgtgacgaagaccgacctcgtggtgggttggttggtaactacgttggttacgtcgtcgggtgggtacccgg

SEQ ID NO: 76162 - DNA, 544 bp, Homo sapiens
  misc_feature: GYAE6OF02HLM7B.5.73.G07.1.454.CMB.1.raw
  modified_base (363)..(363): a, c, t, g, unknown or other
  misc_feature (363)..(363): n is a, c, g, or t
  modified_base (450)..(450): a, c, t, g, unknown or other
  misc_feature (450)..(450): n is a, c, g, or t
  modified_base (496)..(496): a, c, t, g, unknown or other
  misc_feature (496)..(496): n is a, c, g, or t
  modified_base (516)..(516): a, c, t, g, unknown or other
  misc_feature (516)..(516): n is a, c, g, or t
  modified_base (538)..(538): a, c, t, g, unknown or other
  misc_feature (538)..(538): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagcctggggggtccctgagactctcctgtgcagcctctggattcacctttgacaactatgccatgagctgggtcccgccaggctccgaggggaaggggctgggagtgggtctcagttattcggtggtaggtggtggtgccanatactacgcagactaccggtaaagggccggttcgcctatcctccagagacaattccaaagaacgacggtgtatctgacagatgaacngcctggagacgccgaggacaccgggtctttaatcgtgtcgacgaancctactctggtgggtggttntacacgttggttcacgtcgggnggaccg

SEQ ID NO: 76163 - DNA, 721 bp, Homo sapiens
  misc_feature: GYAE6OF02FZ805.5.73.G07.1.454.CMB.1.raw
  modified_base (254)..(254): a, c, t, g, unknown or other
  misc_feature (254)..(254): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcgttttcttaggtggctaattttaaaaggtgtccattgtgaggtgctagttgttggagtcgtgggggaggcttagtacagccgtgggggtccctgagactctccngtgcagcctctggattctacctttgaacaactatcgccagtgagcgtgggtcccgccgaggcctccggaggggagggcgtggtaggtggtctcgtagtttattcggtggtagtgggtggtcgccactataccgtacgctacgacctaccggtaaacggggtcccggtttaccgacctacgtcctacccgagtaacgaactaacttacccgaaaacggtaaccgtaccgggttataaccgttcgtacggactaagtacgttaaggaaccgtaggtcccgtaaggaacggaacgggtacccgggaagggtaaccccgacgggttaaccttttacgtttaacgtacggttaggaacccgggtaaaacgacccgtaacccggttcggttacggggttcggggttaggtttacggtaaccgttaacggttcgggttaccggtacggttccggggtacggggtaacccccggg

SEQ ID NO: 76164 - DNA, 565 bp, Homo sapiens
  misc_feature: GYAE6OF02FTMRY.5.73.G07.1.454.CMB.1.raw
  modified_base (494)..(494): a, c, t, g, unknown or other
  misc_feature (494)..(494): n is a, c, g, or t
  modified_base (510)..(510): a, c, t, g, unknown or other
  misc_feature (510)..(510): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagcctggggggtccctgagactctcctgtgcagcctctggattcacctttgacaactatgccatgagctgggtccgccaggcctccgaggggaaggggctgggagtgggtctcagttattcgtgggtagtggtggtgccacatactacgcagacctacccggtaaaggggcccggttcgcctatcctccagacgaactaattcccgaaagaaccacgggttgtatcctgacagatgaacagcctggagacgccgaggccacggtctttatcgngtgacgaagcaccgtntgggtgggttggttacgtactaacgttgggttaccgacgtcgggtggggacccgg

SEQ ID NO: 76165 - DNA, 676 bp, Homo sapiens
  misc_feature: GYAE6OF02GVZU2.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtgtttctaggtcggctaatttaaaggtgtcattgtgaggtgcagttgttggagtcgtgggggaggcttagtacgagccgtggggggtccctgagactctctgtgcagcctctggacttcacctttcgaccaactatcgcctatgagtcgtcgggtcccgcgacggtctccggaggggaaggggctgggaggtgggtctcgtagttattcggtggtagtggtggtcgcacgatactacgacagtactaccggtaaacggggtcccggttcggacctacgttccaccgtaagacgaaactaacttacccgaaaagtaacgtaaccgggttgtaacgttccgttggaccgtaaacgtagttacgaaaccgaacgtccgtaagaaccgggacggacccggaaggaaccgtaccggggttaccttttaaacgtacgttagtaccggagtaaaccgaccgtaacctggttacgggttgggttagggtttcaaccgttaacggttcggtacgtaccggtcgggtacgggacccgg

SEQ ID NO: 76166 - DNA, 584 bp, Homo sapiens
  misc_feature: GYAE6OF02I3ZJU.5.73.G07.1.454.CMB.1.raw
  modified_base (260)..(260): a, c, t, g, unknown or other
  misc_feature (260)..(260): n is a, c, g, or t
tcagatcagacacgcacgaccggtgctcgatttagctctacgctcaggggtctgagagaggagccccagccctgggattttcaggtgttttcatttggtgatcaggactgaacagagagaactcaccatggagtttgggctgagctggctttttctgtggctattttaaaaggtgtccattgtgaggtgcagttgttggagtcgtgggggaggcttagtacagccgtggggggtccctgagacctctcctgtgcagcctntggattcacctttgacaactatgccatgagctgggtccgccaggctccaggggaagggcgtggagtgggtctcgagttagttcgtggtagtggtggtgccacatactacgcagactccggtaaagggccggttcgccatcctaccagagacaacttcccaagtaacctacggtttatctagcagtatagaacacggcctgacgagccgaaggaccgacggtaccttttatacgtgtcgacgaacgacctaccgtcgttaggtgggttagggttcgtacgtaacgtcgggtttaccggacgttcgggtcggggccgtaaccgggg

SEQ ID NO: 76167 - DNA, 591 bp, Homo sapiens
  misc_feature: GYAE6OF02GYL5G.5.73.G07.1.454.CMB.1.raw
  modified_base (453)..(453): a, c, t, g, unknown or other
  misc_feature (453)..(453): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctgggggtccctgagactctcctgtgcagcctctggattcacctttgacaactatgcccatgagcgtgggtccgccgaggctccgaggggaaggggcgtgggaggtgggtctcgagttagttcggtggtaggtggtggtgccgacacgtactacgcagactcgtaaagggccgttcgcatctcagacacaattccaagaacacggtgtatctcgacagatgaacagaccngacgaggaccgacggacgaaccggtccgtttaacttacgtgtacgacgaaacggtaccgacccgttagttcgggttcgggttgggtttacgtaacgtaacgttcgggtttacgaccgttcgggtcggggtaacccggg

SEQ ID NO: 76168 - DNA, 706 bp, Homo sapiens
  misc_feature: GYAE6OF02JWSUP.5.73.G07.1.454.CMB.1.raw
  modified_base (279)..(279): a, c, t, g, unknown or other
  misc_feature (279)..(279): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggcttttcttgtggctattttaaaggtgtccattgtgaggtgcagttgttggagtcgtgggggagcttagtacaggcctggggggtccctgagactctcctgtgcagcctctggattcacctttgacaactangccatgagctgggtccgccaggcctccgagggagggctgggagtgggtctctagttattcggtggttaggtgggtggtcgaccgtacaagttacgtacggcaacggtaccgttaccgggttaaaacgggggtccccggtttacggccctaacgttcccgtacccgaggaacggtaacctaaacgtttacccgaaaacggaaaccctaacggggttacttaaccgtacgttacggaccgaagtagtacggtaaaccgacgtcccgtaggaacggtaacggaccggaagggaacccgtaccgggttacccgttttagtaccgtgtacggaccgaaagtaccccgtaacttcggttagggttacgggttcgggttacgttaaccgtaacggttcgggtttaccgacgttccggggtacggggtaacccgg

SEQ ID NO: 76169 - DNA, 562 bp, Homo sapiens
  misc_feature: GYAE6OF02HJ5Q0.5.73.G07.1.454.CMB.1.raw
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctgggtcccgccaggctccgagggaagggctggagtgggtctcgagttattcggtggtagtggtggtgccacatactacgcagacctccggtaaagggccggttcgccatctccagngaacattccaagaactacggtttanctgcagatgaacagcctgagagccgaggacacgggtccttttaagtactgtgacgaagcctaccgtgtggttggggtggtttagtaaccgtacgttcgggttcgaccgttcgggtcggggccctaaccggggg

SEQ ID NO: 76170 - DNA, 595 bp, Homo sapiens
  misc_feature: GYAE6OF02F90GH.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagccgtggggggtccctgagactctcctgtgcagcctctggattcacctttgacaactatgccatgagcgtgggtcccgccgaggcctccgaggggaaggggcgtagggaggtgggtctcgtagttagtttcggtggtaggtggtggtgccacatactacgcacgactcggtaaacgggccggttcgccactctccagagaacaattccaaagaacacggtatatctgcagatagaacagcctagacgacgaccgacggaacgtaccgggtacctttacttacgtcgtagtacgaaacgaccgtaaccgtcgttgggttggggttggttagtaacgacgtttcgggtaccgtcgttcgggtcgggtaacccggg

SEQ ID NO: 76171 - DNA, 547 bp, Homo sapiens
  misc_feature: GYAE6OF02F66DA.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccaggggaaggggctgggagtgggtctcagttattcgtggtagtggtggtgccacatactacgcagactccggtaaagggccgttcgccatctccagagacaattccaagaaccgacggtgtactctgcagatgaacagcctgagacgccgaggacacgggccgtttagttactgtagacgaaacgactacctcgtggtggggttgggttagtacaacgttggttcgacttcggtggggacccg

SEQ ID NO: 76172 - DNA, 681 bp, Homo sapiens
  misc_feature: GYAE6OF02JN01B.5.73.G07.1.454.CMB.1.raw
  modified_base (172)..(172): a, c, t, g, unknown or other
  misc_feature (172)..(172): n is a, c, g, or t
  modified_base (183)..(183): a, c, t, g, unknown or other
  misc_feature (183)..(183): n is a, c, g, or t
  modified_base (337)..(337): a, c, t, g, unknown or other
  misc_feature (337)..(337): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgtttctagtggctatttaaaggntcatgtgagtncagttgttggagtcgtggggaggcttagtacagccgtgggggtccctggagactcctcctgtgcagtcctcgtgtcttctaccttgactactatcgcctaatcgagtcgtcgggtccgaccgacggtcctaccggaaggggacgggcgtagggnggtgggtctcgtagttagtcggtggtagtggtggtcgtcacgtagtacgtacgtcacgacgtaccggtaaacgggtccggttaccgacctacgttcccgacgtaacggacgtaacccgtaacgttaccgaaaacggtaaaccggtcgggttaactacgtttacccgtagtccgaaagtacgtcgaaaacgctaccgtaggaccgagtaccggaaggtaaccgcggttacgtttaacgtacgtggtaacgacggtaaactacccgtaccgttggtaggggttcgggttacggttacgtaactacgggttaccggttcgaaccgggttcgggtaccgggtaaccgg

SEQ ID NO: 76173 - DNA, 546 bp, Homo sapiens
  misc_feature: GYAE6OF02IH1RZ.5.73.G07.1.454.CMB.1.raw
  modified_base (427)..(427): a, c, t, g, unknown or other
  misc_feature (427)..(427): n is a, c, g, or t
  modified_base (451)..(451): a, c, t, g, unknown or other
  misc_feature (451)..(451): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccgaggggaaggggctgggagtgggtctcgagttattcgtggtagtggtggtgccacatacgtacgcagactccgtaaagggcccggttcgccatctccagacgacaattccaaagacacggtntatctgcagatgacagcctagagngccgaggacaccgggtctttatatgtgacgaaagcgacctgtcggttgggtggttagtaccgaacgttggttacgacgttcgggtgggtacccgg

SEQ ID NO: 76174 - DNA, 556 bp, Homo sapiens
  misc_feature: GYAE6OF02HH3RX.5.73.G07.1.454.CMB.1.raw
  modified_base (298)..(298): a, c, t, g, unknown or other
  misc_feature (298)..(298): n is a, c, g, or t
  modified_base (330)..(330): a, c, t, g, unknown or other
  misc_feature (330)..(330): n is a, c, g, or t
  modified_base (393)..(393): a, c, t, g, unknown or other
  misc_feature (393)..(393): n is a, c, g, or t
  modified_base (419)..(419): a, c, t, g, unknown or other
  misc_feature (419)..(419): n is a, c, g, or t
  modified_base (491)..(491): a, c, t, g, unknown or other
  misc_feature (491)..(491): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaggtgtccattgtgaggtgcagttgttggagtcgtgggggaggcttagtacagccgtggggggtccctgagactctcctgtgcagcctctggattcacctttgacaactatgccatgagctgggtcccnccaggctccgagggagggctggagtgggtctnagttatcggtggtagtggtggtgcacatactacgcagactccgtaagggccggttcgccatcnccagagacacttacaagaacacggtntatctgacagtatagaacagcctagagacgccgaaggacaccgggtctttatacgtgtgaccgaaagtaccnccttacgtggttcggggtggtttagtaccgtaacgttcgggttcaacgttcgggtacgggcccgg

SEQ ID NO: 76175 - DNA, 765 bp, Homo sapiens
  misc_feature: GYAE6OF02IRO4L.5.73.G07.1.454.CMB.1.raw
  modified_base (188)..(188): a, c, t, g, unknown or other
  misc_feature (188)..(188): n is a, c, g, or t
  modified_base (194)..(194): a, c, t, g, unknown or other
  misc_feature (194)..(194): n is a, c, g, or t
  modified_base (309)..(309): a, c, t, g, unknown or other
  misc_feature (309)..(309): n is a, c, g, or t
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtcggtttctaggtcggctaattttaaaaggtgtcattgtnaggtgnagttgttgagtcgtggggagcttagacagccgtgggggtccctgagcctcctctgtgcaggccctgtggattctacctttgacaactatcgccatagagtcgtgggtcccgacgnggtctaccggaggggaagggtcgnggtaggtggtccgtntagttgtcggtggtaggtggtcggtctacacgtactacgtacgacgtaacgtaaccgtaaccgggtaccgggtccggtaccgaccgtacgtacctacccggtaaagaccgtaaacctaacgttaacccggaaaagtaccggtaacggtttactaccgtacggtcctaaggaacgttaataacgtaaccgtaaccggtaccgtaacggtaaccgggaaccggaaccgggtaaccgggaacccggttaacccgggtttaaccgtttaacgtttaacggttacggttaaccggtaacgtaaccggtaacccggtaaccgttaccggttcggggttagggttacgggtttacggttaaccggttaaccgggtttaccggtttaccggttaccgggttaccggggtacccgggtaacccggg

SEQ ID NO: 76176 - DNA, 674 bp, Homo sapiens
  misc_feature: GYAE6OF02HFI77.5.73.G07.1.454.CMB.1.raw
  modified_base (290)..(290): a, c, t, g, unknown or other
  misc_feature (290)..(290): n is a, c, g, or t
  modified_base (557)..(557): a, c, t, g, unknown or other
  misc_feature (557)..(557): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcgtttttcttaggtggctattttaaaaggtgtccattgtgaggtgcagttgttggagtcgtgggggaggcttagtacagccgtgggggtccctgagactctcctgtgcagcctcgtggtacttctacctttgaactaactntcgccatgacgcgttcggccgccgacggctaccggaggggagggtcgtgggaggtgggtctacgtagttacttggtaggtaggttggtggtcgtacctactaacgttaccgtacgacgaacgtaccgttaaccgggtaaacgggtccccggttccgaccgtactcccgtacaacggacgaactaacttacccgaaaagacgtaccggttagtactaccgtggactaagtactaagacctacgcgtaggacgacggaccgaggtaacncgggttacctttaatcgacgtacggacgaacgtaccctacgttcgtgggttcggggttactttacggtaactaccggtttagggttacccgtacggttacggggtcggaacccgggg

SEQ ID NO: 76177 - DNA, 633 bp, Homo sapiens
  misc_feature: GYAE6OF02GWE4I.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggcttttcttgtggctattttaaaggtgtccattgtgaggtgcagttgttggagtcgtgggggaggcttagtacagccgtggggggtccctgagactctcctgtgcagcctctggacttctacctttgaccaactatgaccatgagcgttcgggtcccgccgaggcctccggaggggaacggggcgtgggaggtgggtctcgtagtttattcggtggtagtggtggtgccatatactacgcagacgtaccgtaagggccggttcgcctatcctccgagaacgactaacttaccgaaagtaaccgacgggttataacgtcttgactaggactgaaaccacggcctaggaacggtacgacccggaaggaccgtacgggttaccgtttataccgttgtacgacgaaacgtaccgtaccttggtgggttaggggtggtttaccgaacgttaacggtttgggtacccgtacggttccgggtaggggtacccgg

SEQ ID NO: 76178 - DNA, 533 bp, Homo sapiens
  misc_feature: GYAE6OF02FZSTF.5.73.G07.1.454.CMB.1.raw
  modified_base (398)..(398): a, c, t, g, unknown or other
  misc_feature (398)..(398): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggcttttcttgtggctattttaaaaggtgtccattgtgaggtgcagttgttggagtctgggggaggcttagtacagcctggggggtccctgagactctcctgtgcagcctctggattcacctttgacaactatgccatgagctgggtccgccaggctccagggaaggggctggagtgggtctcgagttattcgtggtagtggtggtgccacatactacgcagactaccgaaagggccgttcgccatctcaganactaattccaagaaccacggtgtatcgtgcagatgaacagcctggagagcccgaggacgacgggtcctttaatcgtgtcgacgaaagccacctgtgtgggttggttgtacacgtggttcacgtcggtggacccgg

SEQ ID NO: 76179 - DNA, 695 bp, Homo sapiens
  misc_feature: GYAE6OF02HNYDU.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctattttaaaaggtgtccattgtgaggtgcagttgttggagtctgggggaggcttagtacagccgtggggggtccctgagactctcctgtcgcagcctctggattcacctttgacaactatcgccatgagcgtcgggtccgccaggcctccgaaggggaacgggcgtgggaggttgggtctcgtagttagttcggtgggttaggtggttgggtcgccacatacctacgcacgacgttaccggtaaacgggtcccggttcgacctacgtacctcccgaagtacgtaactaactttacccgaaaagtaaaccgtaacgggtgttaactccgttagactaaacgtataacggaaaccacggtcccgtaaggacgacggacccggaaggaaccgacccgggttaaccgttttaagttaccgttggtacggaccgtaaaaggtaccctaaccgttcggttggttacgggggttacggtttacggttaacgaaccggtttgggttacccggtaccggtcggggtccggggtaaccccggg

SEQ ID NO: 76180 - DNA, 647 bp, Homo sapiens
  misc_feature: GYAE6OF02G8374.5.73.G07.1.454.CMB.1.raw
  modified_base (360)..(360): a, c, t, g, unknown or other
  misc_feature (360)..(360): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagcctggggggtccctgagactctcctgtgcagcctctggattcacctttgacaactatgccatgagctgggtccgccgaggctccgagggaagggctggagtgggtctcgagttattcggtggtagtggtggtgccanatactacgcagactccgtaaagggccggttcgcctatcctccagagacaacttccgaaagaaaccgtacggtagtatcgtacgtacaacgatacgaacacggtaccctggaacggaagcccggaagggaccaaccggggtacccgttttaattaccgtagtcgggtaccgaaaaaggaccctaaacccgttcggttacgggttgggggtttacggggtttaggttaacccgtaaccggtttggggtttacccggaccggttttacccggggtgggggtaacccccgg

SEQ ID NO: 76181 - DNA, 638 bp, Homo sapiens
  misc_feature: GYAE6OF02GXMTE.5.73.G07.1.454.CMB.1.raw
  modified_base (371)..(371): a, c, t, g, unknown or other
  misc_feature (371)..(371): n is a, c, g, or t
tcagatcagacacgcacgaccggtgctcgatttagctctacgctcagggggtctgagagaggagcccagccctgggattttcaggtgttttcatttggtgatcaggactgaacagagagaactcaccatggagtttgggctgagctggctttttctgtggctattttaaaaggtgtccattgtgaggtgcagttgttggagtcgtgggggaggcttagtacagccgtggggggtccctgagactctcctgtgcagcctctggattcacctttgacaactatgccatgagtcgtcgggtcccgccgaggcctccgaggggaaggggcgtgggagtgggtctctagttattcggtggtagtggtggtcgccanatactacgcagactacggtaaagggccggttcgacatcctccgagacgactaattacccaaagaactacggtatactcgtgacagatgaacagcctaggaagcggaccgaggtaccgtaccgggtccttttaagtaccgttcggtacggaccgtaaacgtacccgtacccttacggtttcggggttaggggttacggggtttactaaccggttacggtttacgggttacccgggaccggtttacggggtaccgggggtaaccccggg

SEQ ID NO: 76182 - DNA, 690 bp, Homo sapiens
  misc_feature: GYAE6OF02G5WH7.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctatttttaaaaggtgtccattgtgaggtgcagttgttggagtcgtgggggagcttagtacgagccgtgggggtccctgagactctcctgtgcagcctctggtattcacctttgactaactatgccatgagctgggtcccgccaggccgtaccgaaggggaggggcgtgggacggttgggtctcgtagtttagtcggttgggtaggttggtcgggtcgcccaacgtatacgtacgcgaacgtaccgtaaccgggtaaacggggtccggttaccgacctactcccgtaaccgaggaacgtaactaaacttacccgaaaagtaaccgtacgggttacgtactcgtagaccgtaagaacgtacgaaaccgacgtcctagggaacgacggaccgaaggtaccgaccgggtttacctttaattaccgtgaccgtaacgaacgacccgtccttggttcgggttaggggttacgggtttacgaaccggttaaccggtttggggttacccgagggtttacccgggacggggtacccgg

SEQ ID NO: 76183 - DNA, 575 bp, Homo sapiens
  misc_feature: GYAE6OF02GCINI.5.73.G07.1.454.CMB.1.raw
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (495)..(495): a, c, t, g, unknown or other
  misc_feature (495)..(495): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagccgtggggggtccctgagactctcctgtgcagcctctggattccacctttgacaactatcgccatgagctgggtccgccaggctccgagggaagggctgggagtgggtctcgtagttagttcgtggtaggtggtggtcgaccacatacgtacgcagacctaccggtaaagggccgttcgccatccncaganacaataccaaagaacacggtatatctgacagatacgacagccaggagacggaccgaaggacgaccgtccgtttaacttacgngtacgacgaacgacgaaccttcgtggttggggtggttacgtaacgtacgttaggttccgacgttcgggtcgggtacccgg

SEQ ID NO: 76184 - DNA, 739 bp, Homo sapiens
  misc_feature: GYAE6OF02H0F1T.5.73.G07.1.454.CMB.1.raw
  modified_base (538)..(538): a, c, t, g, unknown or other
  misc_feature (538)..(538): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggtctaattttaaaaggtgtccattgtgaggtgctagttgttggagtcgtgggggaggcttagtacagccgtggggggtccctgagacctctcctgtgcagcctcgtggtattctacctttgactaactatgccatgagtcgtcgggtcccgcgacggcctcggaagggggagggtcgtgggtacggtgggttctcgtaggtttagttcggttggtaggtgggttcggtcgccgaactattaccgtacgtacacggtaccgttaccgggtaaacgggtcccggttacgaccctacgtccgtaccgaaggaacgaactaaacctttaccgaaaagtaaccgtacgggttagtactactggacaaggtactacggaaaccncggtacctaggaacggtaccggaccgggaacggtacgtaacccggggtttaccgtttttaaagtaccggttaggtaccggaacgtaaaacgtccccgtaaccgtttcggtaggggtttcggggttaacggggttaacgtaaccggttaaccgggtttcgggttaacccggtacggttcccgggggtacgggtaaccccggg

SEQ ID NO: 76185 - DNA, 838 bp, Homo sapiens
  misc_feature: GYAE6OF02HV6D9.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggtagtttgggctgagctggtctttttcttgtggctaattttaaaggtgtccattgtgaggtgcagttgttggagtcgtgggggaggcttagtacagccgtgggggtccctgagactctcctgtgcacgcctctggtacttcctaccttttgaactaactatcgacctatggagcgtcggggtcccgccgacggtccgtaccggaagggggaacggggtcgtggggtaggttcggggttacctcgtaggttttacgttcgggttagggttaggttgggttgggttcggacccgtaacgtaacgttaaccgtaaccggaccgaacgtaacccgtttacccggggtaaaacgggggtccccggtttaccgcccgtaacttcccgtacccgaaggtaacggtaaacctaaaccgtttaacccgaaaacgtaaacccggtaacgggtttacgtaaacttccggttcggaactaaggtaaacgttacggaaacctaccgggtaccgttaggaaacggaccgggaaccggaacgggtaacccgtaacccggggtttaaccgttttttactaaaccggtttcgtacgggtaacggtaaacggtacccgttacccgttacggttaggggtttaggggggtttacgggtttacggttaaccgaaccgggttttcgggtttaacccggtacgttacccgggggttccgggggaaccccgg

SEQ ID NO: 76186 - DNA, 808 bp, Homo sapiens
  misc_feature: GYAE6OF02GB2UW.5.73.G07.1.454.CMB.1.raw
tcagatcagacacgcacgaccggtgctcgatttagctctacgctcgaggggtctgacgagaggagcccagccctgggattttcgaggtgtttcagtttcggtcgatcaggacctggaacacgagagaactcaccatggactttgggctgagctggtcttttctgtggctaatttaaaaggtgtcctattgtcgaggtgcagttgtgagtcgtggggagcgttagtacacgtccgtgggggtccctggacgactcctaccgttggtacgcgagtcccgtcgtggtattcctaccgtttagaccaaaccgtagtacgaccctagtacgtagtccgtacggggttcccgaccgagggtccctaccggaaggggtaacggggtcgttacgggacgggttcgggtacttacgtaaggtttacgttcggtagggttagggtcgggttgggtacgtaccgtaacgtagttaacccgtaacggtacctaaccggtaaccgttacccggggttaaaaccggggtcccggtttaccgacccgtagttcccgtacgaacgtacgaaactaacgttaccgaaaaggtaccgtaacggtgttaacttccgttagacgtaacgtaactacgtaaacctacggttcctagggaacggtaccgtaccgggaaacggaccggtaaccgggttaaccgttttaagttaaccgtgggttaaccgaacgtaaacggcctaccgtttacggtagggtacgggtttacgggtttactaaccggtaacggtttcggttaacccggtccggttccgggtcggggtaaccccg

SEQ ID NO: 76187 - DNA, 555 bp, Homo sapiens
  misc_feature: GYAE6OF02IKTE1.5.73.G07.1.454.CMB.1.raw
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttctgtggctattttaaaaggtgtccattgtgaggtgcagttgttggagtcgtgggggaggcttagtacagccgtggggggtccctgagactctcctgtgcagcctctggattcacctttgacaactatgccatgagctgggtccgccaggctccgagggagggctggaggtgggtctgagttagtcgtggtagtggtgtcgcacatacacgcagactccggtaaagggccgtcgcntctcaganacaattccaaagacaggtnactntagcagatagaacagcctgagcgaccgaggacctacggtacgtttatacgtgtcgacgaaacgcctaaccgttcgtggtcgggttagttacggtacgtacgttcgggttaccgacgttcgggtacgggtaacccgg

SEQ ID NO: 76188 - DNA, 658 bp, Homo sapiens
  misc_feature: GYAE6OF02HEVSX.5.73.G07.1.454.CMB.1.raw
  modified_base (478)..(478): a, c, t, g, unknown or other
  misc_feature (478)..(478): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagccgtggggggtccctgagactctcctgtgcagcctctggattctacctttgacaactatgcccatgagcgtcgggtcccgccgacggcctccgaggggaacggggtcgtgggagtcggggtctcgtagtttagttcggtgggtaggtggtgggtgcctacaatactacgacacgacgtaccggtaaacgggccggttacgcctatcctccagacacaacttaccgaagaacacggtatatctgacagatacgaacncgaccgtagacgacggaccgaaggaacgtacccgggttacgttttactacgttacggtacgaccgaaacggtccgtaacccgttacggttcggggttggggttacggggtttacggttaacccgtaaacgggtttcgggtttacccggtaccggttaccggggtacgggggtaccccggg

SEQ ID NO: 76189 - DNA, 628 bp, Homo sapiens
  misc_feature: GYAE6OF02FVJ5E.5.73.G07.1.454.CMB.1.raw
  modified_base (520)..(520): a, c, t, g, unknown or other
  misc_feature (520)..(520): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgttttctagtggctatttaaaggtgtcatgtgaggtgcagttgttgagtctgggggagcttagtacagcctgggggtccctgagactctcctgtgcagcctctggattcacctttgacaactatgccatgagctgggtcccgccgaggcctccgaggggaacgggtcgtgggagtcgggtctcgagtttattcgtggtagtggtggtacgccacgatactacgcagacctaccggtaaagggcccgttcgcctatctccagaacgacaattaccgaaagtaactacggtgtactctcgcgagactagaacgacgcctagagtacggccgaaagggaccgacggttcccgttttaaagttaccgtagggttnaccgtaaacgtaccgtacccttacggttgggttacggggttcggtttaggtaacccttaacggtttccgggttacggtaacccgttcggggttcggggtaacccccgg

SEQ ID NO: 76190 - DNA, 609 bp, Homo sapiens
  misc_feature: GYAE6OF02F5XA6.5.73.G07.1.454.CMB.1.raw
  modified_base (148)..(148): a, c, t, g, unknown or other
  misc_feature (148)..(148): n is a, c, g, or t
  modified_base (172)..(172): a, c, t, g, unknown or other
  misc_feature (172)..(172): n is a, c, g, or t
  modified_base (292)..(292): a, c, t, g, unknown or other
  misc_feature (292)..(292): n is a, c, g, or t
  modified_base (358)..(358): a, c, t, g, unknown or other
  misc_feature (358)..(358): n is a, c, g, or t
  modified_base (471)..(471): a, c, t, g, unknown or other
  misc_feature (471)..(471): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgngtttctagtcggctatttaaaggntcatgtgaggtgcagttgttggagtctgggggaggcttagtacaggcctggggggtccctgagactctcctgtgcagcctctggattcacctttgacaactatgccatgagctgggtccnccaggcctccgaggggaacgggctggagtgggtctcgagttgttcgtggtagtggtggtcgcctanattacacggcaagtactaccggtaaagggccggtttcgacctatcctccgaagacgaacaacgtttaccaaaggaacctacgggtatactcgtagactaggatacggaaaccncgtctaggacgacggaccgacggaccgtaccggttacgtttaatcgtagtacggacgtaaacgtccgtaacgtggttacgggtgggttacggttacgtaacgtacggtcggttacgacggttacgggtacgggaccgg

SEQ ID NO: 76191 - DNA, 537 bp, Homo sapiens
  misc_feature: GYAE6OF02FLBWO.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctggggaggcttagtacagcctggggggtccctgagactctcctgtgcagcctctggattcacctttgacaactatgccatgagctgggtccgccaggctccgagggaaggggctggagtgggtctcagttattcgtggtagtggtggtgccacatactacgcagactccgtaaagggccggttcgccatctccagacgacaacttccaagaacacggtgtatcgtgcagatagaacacgctgagacgccgaggacgacggtccgtttatactgtcgagaagacactcgtggtgggtggttgtacacgtggttacgacgttcggtgggtacccgg

SEQ ID NO: 76192 - DNA, 735 bp, Homo sapiens
  misc_feature: GYAE6OF02HY8DC.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggtcttaattttaaaaggtgtccattgtgaggtgctagttgttggagtcgtgggggaggcttagtacagccgtgggggtccctgagactctcctgtgcacgcctcgtggtattcctacctttgaacctaactatcgaccatggacgtcgtcgggtcccgaccgacgggtccgtaccggaagggggaacgggcgtagggaggtcgggtcctcgtagtttacgttcggttggtaggtggttgggtcgcctaacgacttaacctacggactaacgaccgtaccggtaaacggggtccggttccgacctatcccgtaccaaggaacaactaacttaccgaaaacgtaaccgcgggttatactcgtacggactaagacgttaacgaaaccgacgtacccgtaggaacgaccgggacccggtaaagggaacccgtaccggggtttaccgttttaactaaccgttcgggtaacggaaccggaaactcccggtaacccttcgggttggggtagggggtttacggttaccgtaacggttaaccggttcgggtttaccgacccggtttcgggacggggtaaccccg

SEQ ID NO: 76193 - DNA, 638 bp, Homo sapiens
  misc_feature: GYAE6OF02GMM53.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcttttctgtggctaattttaaaaggtgtccattgtgaggtgcagttgttggagtcgtgggggaggcttagtacagccgtgggggtccctgagacgtctcctgtgcagcctgtggattcgtacctttgaactaacgttaatcgaccattgagcgtcgggtccgccgaggcctccgaggggaacgggctgggaggtagggtctcgtagttagttcgtggtagtggtggtgccacatacgtacgcagtactaccggtaaacgggccggttcgaccgtactcgtccagagaactaacttaccgaaacgaacgacggttacgtaattcgtacgacgaagacgtagaactagacctaggagtacggaccggaaggacccgacggttaccgtttaacttaccgtaggtcgaacgaacgtacctaccgtcgttagggttcgggttaggttacgttaacgtacggttggtacgtacgttcgggtaccggtaacccggg

SEQ ID NO: 76194 - DNA, 632 bp, Homo sapiens
  misc_feature: GYAE6OF02GPHJ0.5.73.G07.1.454.CMB.1.raw
  modified_base (297)..(297): a, c, t, g, unknown or other
  misc_feature (297)..(297): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctcgggtccnccaggcctccgaggggaacggggcgtgggaggtgggtctctagttattcggtggtagtggtggtgccacgatactacgcagactaccggtaaagggccggttcgccatcctccagagacaattccaagaacacggtgtatcgtagtcaggtatcgaacaggccctaggaacgacgacccgggaagggaccgtaccgggttacccgttttagttaccgtggtaggaccgaaacggtacccgtacccgttcggttacgggttgggggttcgggtttagttaaccgaaccggtttcggggttacccgacggtttacccggggtaggggtacccccggg

SEQ ID NO: 76195 - DNA, 976 bp, Homo sapiens
  misc_feature: GYAE6OF02H1MEX.5.73.G07.1.454.CMB.1.raw
  modified_base (188)..(188): a, c, t, g, unknown or other
  misc_feature (188)..(188): n is a, c, g, or t
  modified_base (334)..(334): a, c, t, g, unknown or other
  misc_feature (334)..(334): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgcttttcttgtggctattttaaaaggtgtcattgtgaggtgntagttgttggagtcgtgggggaggtcttagtacagccgttggggggtccctaggacgacgtcctcctgtgcagcctcgtggactttctaccgtttgactaactatcgccagtgagtcgtggccgcgagctcgagggagggcgtggnggtggtctgtagttacgttcggtggttaggttggttcgggtcgtaccctaacgtacgtaaacgttacgacgtaacggtaacccttaacccggggtaaaaccgggggttccccggttaccgggtaccccttaacgttacccgttaaccccgtaacgggtaaacggtaaaaccgtaaaaccgttttaaacccgaaaaaaccggtaaaacccggtaaccggggttttacgttaaaccgtttaccggttaacggttaaccgaaacgggttaaaccgttaaccggaaaaccgtaaaaccgggttcccgttaaacggggaaaccggggaacccggtaacccccggggaaaacgggggaaccccggtttaaaccccgggggtttttaaaaccccggttttttaaaacggttttaaacccggttttacggggttaaccgggttaaaacccggggtaaaaacggttaacccccgtaaaccccggtttttacccggggtttaagggggttttacccgggggggggtttttaaacgggtttaccggggtttaaaacccgtaacccgggggttttttaaccggggttttaccccggggtttaaaccccgggttttacccgggggggtcccccggggggttaaaacccccggggg

SEQ ID NO: 76196 - DNA, 541 bp, Homo sapiens
  misc_feature: GYAE6OF02F0WVZ.5.73.G07.1.454.CMB.1.raw
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (475)..(475): a, c, t, g, unknown or other
  misc_feature (475)..(475): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagccgtggggggtccctgagactctcctgtgcagcctctggattcacctttgacaactatgccatgagcgtgggtccgccacggctccgaggggaagggggctgggaggtggggtctcgtagttagttcggtgggtagttggtggtgccgacatactacgcagactcgtaaagggccgtcgccatctcagacacaactcaagaacacgtgactctgcanatgaacngcctgagcgcgagacacggtcttatacngtacgacgaacgacacctcgtggtggtacggttgtacgacgttggtacgcgtcggtgggtacccgg

SEQ ID NO: 76197 - DNA, 739 bp, Homo sapiens
  misc_feature: GYAE6OF02I433U.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttctgtggctattttaaaaggtgtccattgtgaggtgcagttgttggagtcgtgggggagcttagtacagccgtggggggtccctgagactctcctgtgcagcctcgtggtattcctaccttttgaaccaactatcgcccaagttgagcgttcggggttccccgccgacgggtcctacccgggagggggaaacgggggtccgtaggggaacggttcggggttcctacgtaaggttttacgtttccgggttagggttaggttgggttgggtcggtccctacgaataacccgttacgccgtaacgtaccgttacccggtaaaagggggtcccggttccgacctagtcccgtaccgaaggaacgaacctaaacgttacccaaaggtaaaccgtacggttagtacgttcgtagacgtaggtatacgaaccagtccgtagacgacggaccggaacggacgaccggtttacgtttaacgttacgtgtacgacgaaacgcccgtaacgttacggttgggttaacggggttcgggtttaactaccggttaacggtttgggttaccggtacggttacggggacgggtaaccccggg

SEQ ID NO: 76198 - DNA, 778 bp, Homo sapiens
  misc_feature: GYAE6OF02GIIRT.5.73.G07.1.454.CMB.1.raw
  modified_base (262)..(262): a, c, t, g, unknown or other
  misc_feature (262)..(262): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctattttaaaaggtgtccattgtgaggtgcagttgttggagtcgtgggggagcttagtacagccgtgggggtccctgagactctctgtgcacgcctgtggnttccacctttgacaactatcgaccatgacgcgtgggtcccgcgacggcctccgaggggaaggggcgtgggaggtgggtctcgtagtttagttcggttagggttaggttgggtgggtcgtcccgaacgtactaactaccggacgaacgtaacccgtacccgggttaaaacggggtccccgggtttacccggacccgtaccgttccgttacccgaaggtaaccggaacctaaacgtttaaccccgaaaaagtaaacccggtaaacggggtttacgttaaccgttaccggttacgacccgtaaggtaacctaacggaaaccacggttacccgtaagggaagacccggggtaacccggaacgggtaacccggtacccgggtttacccgttttaaactttacggttaggtaccggtaacgaaaacggtaccctaaccggttcgttacggggttggggttttacggttacgttaacggttacgttccgggttacgtacggttcgggacggggtaaccccggg

SEQ ID NO: 76199 - DNA, 658 bp, Homo sapiens
  misc_feature: GYAE6OF02GXX03.5.73.G07.1.454.CMB.1.raw
  modified_base (507)..(507): a, c, t, g, unknown or other
  misc_feature (507)..(507): n is a, c, g, or t
  modified_base (570)..(570): a, c, t, g, unknown or other
  misc_feature (570)..(570): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttctgtggctattttaaaaggtgtccattgtgaggtgcagttgttggagtcgtgggggagcttagtacagccgtgggggtccctgagactctcctgtgcagcctcgtggtattcctacctttgacaacttatgccatgacgcgtcgggtccgccaggcctccggaggggaacgggcgtgggaggtgggtctcgtagttagttcggttgggtacggttgggtggtcgccacagtactacgctacggacctaccgggtaaacgggtcccggttccgacctacgttccctaccgaacggacgtaactaacttacccgaaagaaccgtacggttaggtactcgttgactagatagaacngccgtagacgacgccgaaggtaccgtacggtaccgtttacgtacgttggtacgacggtaaacnccgtaaccttacggttggttcggggttacggtttacgtaacgttacggttaccggttaccggtacggttccggggtcgggtaacccgg

SEQ ID NO: 76200 - DNA, 647 bp, Homo sapiens
  misc_feature: GYAE6OF02IVZ97.5.73.G07.1.454.CMB.1.raw
  modified_base (176)..(176): a, c, t, g, unknown or other
  misc_feature (176)..(176): n is a, c, g, or t
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (532)..(532): a, c, t, g, unknown or other
  misc_feature (532)..(532): n is a, c, g, or t
  modified_base (541)..(541): a, c, t, g, unknown or other
  misc_feature (541)..(541): n is a, c, g, or t
tcagatcagacacgcacgaccggtgctcgatttagctctacgctcagggtctgagagaggagcccagccctgggattttcaggtgttttcatttggtgatcaggactgaacagagagaactcaccatggagtttgggctggagcggtcgtcgtttctaggtggctaatttaaaggngtcattgtgtaggtgngtagttgttggagtcgtgggggancgttaagtacngtccgtggggtccctgacgacttccgtctgtggccagcccgttnggtattccgccgtttgaccaacgttntgaccctaagtcgacgtcgtcgggttcccgctaccggccgttaccgagggggtaacggcgtaggcggttacgggtcctgaccggtttattcggtaggtagttgggtcgtcgaccactagtaactcggatacgtacgaccggttaaaggcccgttacgcctacgtccgtaccaggtaactacacgttaacccgaaggtaaaccgtaacggttgtaacctgttacgactcggtaaangtaaaccgngaacttggaataccgcccggaatacgcgttacgttaaactcgtgtacacgtaagcctcgtgaacggtggtacgttatacgcgttcggtaacgcgtcgggataccgg

SEQ ID NO: 76201 - DNA, 705 bp, Homo sapiens
  misc_feature: GYAE6OF02F26PZ.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctaattttaaaaggtgtccattgtgaggtgcagttgttggagtcgtgggggaggcttagtacagccgtggggggtccctgagactctcctgtgcagcctctggattcctacctttgacaactatcgccatgagcgtgggtcccgccgaggctaccgaggggaacgggcgtgggaggtgggtctcgtagttattcggtggtggtggtggtcgccacatactacgcaacgtaccgtaccggtaaacggggtcccggttccgaccctatccgtaccgaaggaacgtaacctaaacgtttacccaaaaggtaaaacccgtacgggttagtacttccgttaggacctaacgaagttacgaaaacctacggccgtaaggaacggaccggaccggaacggaaccgtacccgggttacccgttttaaagttaccgtggttaaccggaacgtaaacgtacccgtaccgttacggttgggttacggggttgggtttacgtaaccgtaacggttacgggttaccgacccggttcgggtacccggggtaaccccgg

SEQ ID NO: 76202 - DNA, 785 bp, Homo sapiens
  misc_feature: GYAE6OF02I0H0S.5.73.G07.1.454.CMB.1.raw
  modified_base (197)..(197): a, c, t, g, unknown or other
  misc_feature (197)..(197): n is a, c, g, or t
tcagatcagacacgcacgaccggtgctcgatttagctctacgctcaggggtctgagagaggagcccagccctgggattttcaggttgttttcatttggtgatcaggactgaacagagagaactcaccagtggtagtttgggctgagctggtctttttcttgtggtcttaattttaaaggtgtcctattgtgaggtgngtaggttgttggtagttcggtggggggaggtcgtttaagtacgaggtccggttcggggggtccctggacgaccgttctccgtgtcgcgagtcctcgtggtacttcctacctttgaacctaacttagtcgacctagtggaggtccggttcgggtcccgcccggacggtccgtccggaaggggggaacggggtcggttaggggacggttcgggtccgttacggttaaggtttacggtttccggttggggttaggttggggttacgggtgacccgtaacgtaacgttaccgtacgaccgtaacggtaaccgtaccgggttaaacgggccggttaaccgcctacgtcctacgaaacggactaaccgtaaacgtttacccgaaagtaaaccgttcgggtacttaaacgtccgtaggacgtaacgagtacgtaaacacgtccgaaggtaacgaccggtcgaaacggtaccggtccggttaccgttttaatgtacggtacgaacgaacaccggttccttaggtcggggtgggttacggtttacgaaccgttacgggttcgtttacccggtaaggtccgggggtccggtaaccggg

SEQ ID NO: 76203 - DNA, 665 bp, Homo sapiens
  misc_feature: GYAE6OF02HK0J7.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacaggccgtgggggggtccctgagactctcctgtgcacgcctctggattcacctttgacaactatgccatgagctgggtcccgccaggcctccgaggggaggggcgtgggaggtgggtctcgagtttattcggtggtaggtggtggtgccgatataccgtacgcaagtaccgtaccggtaaaggggtcccgggttcgcctacgtccgtacccaggaacggacctaaatttacccgaaaggaaaccctacggggttagtaacttccgttaggaccgaaggaattcgaaacgaccggccctagggaacgacggacccgaaggaccgtaccgggtccgtttaaattaccgtggcgacggaaacgtaccgtaccctggttcgggttgggttggggttacgttaacgtacgttcgggttccggtaaccggttccggggcgggtaaccccgg

SEQ ID NO: 76204 - DNA, 851 bp, Homo sapiens
  misc_feature: GYAE6OF02I5A3G.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggcttattttaaaaggtgtccatgtgaggtgcagttgttggagtcgtgggggaggcttagtacaggccgtggggggtccctgacgactctcctgtgcgagtcctcgtggtattcctacctttagaccaactagtcgcctatgacgcgttcgggtccgccgaggcctccggaggggaacgggcgtgggagtcgggtctcgtagttacgttcggtgggttaggtcgggttgggtcgaccgacgtaacttaccgtacgcctaacggtaacccttaacccggggttaaaacgggggtcccggtttccggaaccctacgttcccgtaccgtaaaggtaacgtaaacctaaacttaacccgaaaaaggtaaaccggttaaccgggttagttaaaccgttaccgttagggaccctaaagtaacgttcggaaaaccgtcggtacccgttaggaaacggtaaccggaccggggtaaacgtaaccggtaaccgggttttaacccttttacgttaaaccggttcgggttaaacgaaacccgggtaaaaaccgtccgttaaccccggtttagggttacgggggtttacgggggtttaggggtttttaaaaccggttaaccccgggttaacggggtttttaccggggttaacccggtttacccggggtttaaccggggggttaccccgggggtaaacccccggggg

SEQ ID NO: 76205 - DNA, 548 bp, Homo sapiens
  misc_feature: GYAE6OF02IAJJC.5.73.G07.1.454.CMB.1.raw
  modified_base (364)..(364): a, c, t, g, unknown or other
  misc_feature (364)..(364): n is a, c, g, or t
  modified_base (453)..(453): a, c, t, g, unknown or other
  misc_feature (453)..(453): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
  modified_base (484)..(484): a, c, t, g, unknown or other
  misc_feature (484)..(484): n is a, c, g, or t
tcagatcagacacgcacgaccggtgctcgatttagctctacgctcagggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatgagctgggtcccgccaggctccgaggggaaggggctgggagtgggtctcgtagttattcggtggtagtggtggtgccanatactacgcagactaccggtaaagggccggttcgccatctcagagacaattaccaagaaccaggtgtatctgcagatgaacagctgagnccgagcacggtctttaancgtgngacgaaanccgactcgtggtcgggttggttagtacgtaacgtgggtttaccgacgttccgggtgggacccgg

SEQ ID NO: 76206 - DNA, 711 bp, Homo sapiens
  misc_feature: GYAE6OF02F839M.5.73.G07.1.454.CMB.1.raw
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
tcagatcagacacgcacgaccggtgctcgatttagctctacgctcaggggtctgagagaggagcccagccctgggatttcaggtgttttcattggtgatcaggactgaacagagagaactcaccatggagtttgggctgagcgtggtcgttttcttaggtggctatttaaaaggtgtcattgtgaggtgcagttgtggagtcgtgggggaaggcttagtacgagccgtggggggtccctgagactctcctgtgcgtagcctcgtggacttcacctttgacaactatcgccatcgagctcggggtccgccgaggctccgagggagggctagggagtgggtctcagttgtcgtggtagtggtggtcnccganactactacgcagaccgtaccggtaaagggtcccggtttcaccgtacgtctaccgaaggacgtaaacaacttaccgaaaacgaaccgtaacggtgtaaccttcgtagaccgaagtcgttaagaaaccgcggtacccgtaggaagaaccgggaccgtaacgggaacccgtaacgggttcccgttttaaaacgtttccggtaggttaacccgaccggttaaaaagaaccccgttcggtttaacggttacgggtttacgggggtttaacgggttcgtaaacccggtttaacggttacggggtttaaccggaacccgtttaccggggggcgggtaaccccccgggg

SEQ ID NO: 76207 - DNA, 594 bp, Homo sapiens
  misc_feature: GYAE6OF02JXOXY.5.73.G07.1.454.CMB.1.raw
  modified_base (147)..(147): a, c, t, g, unknown or other
  misc_feature (147)..(147): n is a, c, g, or t
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (315)..(315): a, c, t, g, unknown or other
  misc_feature (315)..(315): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggngtgttctaggcggctatttaaaggtncattgngngtgctagtgtgngtgtgggagnttagtcagccgtggggtccctagagactcgtctgcncgncctgtgnttcacttgacactatcgccatgatcgtgggtccncgngcncgagggacggcgtggagtggtctagngttacgtgtggtacgtggtcgtgaccagtatacgtacgcgacgtaccgtaccgtaaacggccggttccacgcgtaccgtcgacgtgaaccgtaactacgaaggaactagggtacttatccgtagacgagtactacacgcgtacgaggtacgtacgcggaaccggtacgtaccgttacgtttacgtacgttgacggtacaacgtccgtacgttacgtggttacgggttcgttacggtacgttacggttcggttacggaccgttacggggtcggtaaccgg

SEQ ID NO: 76208 - DNA, 756 bp, Homo sapiens
  misc_feature: GYAE6OF02JMQZK.5.73.G07.1.454.CMB.1.raw
  modified_base (264)..(264): a, c, t, g, unknown or other
  misc_feature (264)..(264): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggcttttcttgtggctattttaaaggtgtccattgtgaggtgctagttgttggtagtcgtggggggaggcgttagtacagccgtggggggtccctggagactctcctgtcgcagcctcnggacttcactttgaccaactatgccatgagcgtggggtcccgccacggcctccggaggggaacgggccgtagggagggtcggggtctacgtaggttagttcggtgggttagtgggttggtcgccgactagtacgtacggctaaggaccttacccgggaaaggggtcccggttacgacccgacttccgtaccgaagtaacggtaaacctaacgtttaacccgaaaggtaaacccgtaacgggttacgttaacttaccgttcggaaccgtaacggtaacgtaagaaaccgaccggtacccgtaagggaaccgtacggaccccgggaaggaacccggtaaccggggttacccgttttaacgttacgtacgggttacggaccgggtaaaacggacccgtaacccgttgttacgggggtcggggtttacgggttttaccggtaaaccggtacggttccgggttacggacccggtttcgggggtaccgggtaccccgg

SEQ ID NO: 76209 - DNA, 691 bp, Homo sapiens
  misc_feature: GYAE6OF02GQ0SQ.5.73.G07.1.454.CMB.1.raw
  modified_base (296)..(296): a, c, t, g, unknown or other
  misc_feature (296)..(296): n is a, c, g, or t
  modified_base (536)..(536): a, c, t, g, unknown or other
  misc_feature (536)..(536): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggcttttcttgtggctattttaaaaggtgtccattgtgaggtgcagttgttggagtcgtgggggagcttagtacagccgtgggggtccctgagactcgtcctgtgcagcctgtggatcacctttgacaacgtatgccatgagctcggtccnccgtacggcgtccgaaggggaagggcgtagggaggtcgggttctcgtaggttacgttcgtgggttagtggtggtcgaccgatacgtacgtacgcgaacgtaccgtaccggtaaacggggtcccggttaacgccctaacgtccgttaccgacggaacggtaacctaaacgtttacccgaaaacgtaaaccgtaaccgggtttggtaaccttcggttacggacctaagtaagtacgtaaacncggtaccgtagaggtaaccgccggaacggtaccaccgggttaccttttagtacccgtagacgtaacgaaacgtacccgtaacttccggttggtacgggggttaggttacgtaacgacggtttaccggtcgtacgttccggggtacggtaacccgg

SEQ ID NO: 76210 - DNA, 786 bp, Homo sapiens
  misc_feature: GYAE6OF02IPYAR.5.73.G07.1.454.CMB.1.raw
  modified_base (266)..(266): a, c, t, g, unknown or other
  misc_feature (266)..(266): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttaattttaaaaggtgtccattgtgaggtgcagttgttggagtcgtgggggagcttagtacagccgtggggggtccctgagactctccgtgtgcagcctctggnttcaccttgaccactatcgccatgagtcgtcgggtccgccaggcctcgacgggaacgggcgtgggaggtgggtcgtacgtagttacgttcggtagggtaggtggttgggtacgccgacgtatacgttaccggactaggtaccttaccgggtaaacggggtcccgggttaccgaccgtaacgtcccttaccggaacgaacggtaaccaaaccgtttacccgtaaaacggtaaccgtaacgggttaacgttaccttacgtcggtactaaacgggtacgtaaacggtaaacctacggacccgttagacgggtaaccgggacccgtaaggggaacccgtaccgggtttaacccgtttttaaacggttaccggtttacggttaccgggtaacggtaaaaccggtacccgtaacccggtttacggttacggggttacgggggtttaggggttttaccgttaaccggtaccgggtttacgggtttaaccggtacccggtttccggggtaccgggggttaaccccggg

SEQ ID NO: 76211 - DNA, 661 bp, Homo sapiens
  misc_feature: GYAE6OF02FLJ8C.5.73.G07.1.454.CMB.1.raw
  modified_base (366)..(366): a, c, t, g, unknown or other
  misc_feature (366)..(366): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcgttttcttgtggctattttaaaaggtgtccattgtgaggtgcagttgttggagtcgtgggggaggcttagtacagccgtcggggggtccctggagacctctcctgtgcagcctcgtgattctacctttgacaactatgccatgagcgtgggtccgcgtacggctccgagggagggcgtggagtggtctcagttattcggtggtaccggtggtggtnccgactactacgtacgacgagaccgtaccggtaaagggtcccggtccgaccgactccgtaccgaaggtacgaactaacttaccgaaagtaacgtagggtacgtaactcgttggaccgagacttacggaactacggcccttaggaacgacggaccggagggtaaccgtacgggttacccgttttaaagttacgttgtacgaacgtaacgaaccgtacctcggttaggtggggttacgggttaggttaacgtaaccggttgggttaccggtacgttaccggggtacggggtacccgg

SEQ ID NO: 76212 - DNA, 856 bp, Homo sapiens
  misc_feature: GYAE6OF02IUD05.5.73.G07.1.454.CMB.1.raw
  modified_base (170)..(170): a, c, t, g, unknown or other
  misc_feature (170)..(170): n is a, c, g, or t
  modified_base (182)..(182): a, c, t, g, unknown or other
  misc_feature (182)..(182): n is a, c, g, or t
  modified_base (202)..(202): a, c, t, g, unknown or other
  misc_feature (202)..(202): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcttttctgtggctatttaaagntcatgtgagtgnagttgttggagtcgtggggngtcttagtacagccgtcgggggtccctgacgactctcctgtgcagcctcgtggactttacacctttgaactaactatcgaccagtgagcgttcgggtcccgccctaagggtcccgtaccggaacgggggtaacggggtccgtaggggtacggtttaggggttcccttagttagtttacgtttcgggttggttaaggttcggttgggtaccgtcccgtaaacgtaacttaaccggttaccggaccgtaaacgtaccggtttaacccgggtaaaacggggtccccggttttccgacccgttacgttacccgtaaccgtacggtaaaaccgtaaacttaaacccgtttaaaccgaaaaacgggtaaacccgttacggggtttaacgttaaccgtccgttacgaacgtaccggtaagtaacgaacctaacggttacccgagggtaaaccggccggtaacccggaaggtaacccgttaacccgggtttacgtttttaacgttaaccgttcggtaacggttaaccgaaaggtacccgtaaccgtttacgggttcgggggtttaaccggggtttacgggtttttaacggaacgtttaaacccgggttttccggggtttaaacccgacgggttttaccggggtccgggggttaaaccccggg

SEQ ID NO: 76213 - DNA, 793 bp, Homo sapiens
  misc_feature: GYAE6OF02IPRZJ.5.73.G07.1.454.CMB.1.raw
  modified_base (302)..(302): a, c, t, g, unknown or other
  misc_feature (302)..(302): n is a, c, g, or t
  modified_base (327)..(327): a, c, t, g, unknown or other
  misc_feature (327)..(327): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggaggtttggctgagcgtggtcttttcgtgtggctaatttaaaggtgtcctattgtgaggtgacgtaggttggttggagtcggtgggggagtcgttagtactagccggtgggggtccctggacgacctctaccgtgtcgcagtcctcgtggtacttcctaccttgacctaactntcgcagtggacgcgttcgggtcccncgacggtcctccggagggtaaggcgtggacggtgggtctcgtaaggttcgtcgtggtaggtggtgggttacgccaacgtacgtaaccgtacgacgaacgtaccgttaaccgggtaaacggggtcccggtttaccgacgtacgtacccgtaccgtaacggaaccgtaaacccgttaacgttaacccggaaacgtaaaccggtacggttacgtacgtcgttacgaccgtaagtacgtaaccgtaaccggtacgtccgtaacggaccggtaacggtacccggggtaaagaacccggggttaaccgggtttaccgtttttaaaaccggtcgggtttacgtaacggggtaacccgtaaaaaccggtcccttaacccgggtaggttcgggggttagggttacgggtttaccgttaacgtaccgggtttccgggtaacggtacccggtttgggggtaccccgggtaaccgggg

SEQ ID NO: 76214 - DNA, 708 bp, Homo sapiens
  misc_feature: GYAE6OF02I5YG3.5.73.G07.1.454.CMB.1.raw
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
  modified_base (189)..(189): a, c, t, g, unknown or other
  misc_feature (189)..(189): n is a, c, g, or t
  modified_base (199)..(199): a, c, t, g, unknown or other
  misc_feature (199)..(199): n is a, c, g, or t
  modified_base (220)..(220): a, c, t, g, unknown or other
  misc_feature (220)..(220): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (344)..(344): a, c, t, g, unknown or other
  misc_feature (344)..(344): n is a, c, g, or t
tcagatcagacacgcacgaccggtgctcgatttagctctacgctcaggggtctgagagaggagcccagccctgggattttcaggttgttttcatttggtgatcaggactgaacagagagaactcaccatggagtttgggctgagcggtgtgtttcgtaggcggctaatttaaaggtntcatgtgngtgntagttgtggngtcgtggggagcgttagtacngccggtgggggtcctgagctctccgtgtgacncgcctntggtacttctacctttgaacaactgtcacctagagtaggccgttcgggtcccgccgaggtcctacgggaaggggaagggtcagggnggtgggtctagtagttcgttggttggtaggtcggtggctacgaatcgtaaccgtacgacgtaacggtaccgtacccggtaaaggggtccccggttcccggtaactcgtaccgtacccgaaggaaacgtaaacctttaaacgtaccccaaaaggtaaccggtacgggtttcgttattaccggaccgtaacgggaattaacggtaactaccggacggtacgaggaacgacgggtaccctaagggaccgtacggttctttaaagtccgtgacggaacgtagtaccccttggaccgtttgggagggttaacgttacgtacgttaaccgggtttggtaacccggtcgggttccgggtacggaacccggg

SEQ ID NO: 76215 - DNA, 779 bp, Homo sapiens
  misc_feature: GYAE6OF02HGIFC.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggtagtttgggctgagcgtgtcgttttctgtggcttaattttaaaaggtgtcctattgtgaggtgctagttgttggagttcgtggggaggtcttagtacagccgtgggggtccctgagactcctcctgtcgcacgcctcgtggtacttcctaccgtttagaacctaacttagtacgtccctaagtcgacggtcggttccggggtcccgaccgtacgggcccgttaccgggaagggggaacggggtcggtggggtacgggttgggtacttacgttacgttttagttcggttagggttggttgggttggtacgtaccgtaacgtaacgtttaccgtacgacgtaacggtaacccgttaacccggggttaaaaccggggttccccggtttacccgacccgttacctaccgtccgaaggaacgtaacctaacgttaaccgaaacgtaacggtacggttacgtaactcgttacgactaagactacgaactacgtacgtaggaacgacggaccggagtaacccgtacggtttaaccgtttaacgtacggttcgtacgaacgtaacggtacctaacccgttggtcgggttaggggttacggttacgtaaccggttaggttaccggttacggtaccggttacgggtacgggtaacccgg

SEQ ID NO: 76216 - DNA, 659 bp, Homo sapiens
  misc_feature: GYAE6OF02IJDF9.5.73.G07.1.454.CMB.1.raw
  modified_base (174)..(174): a, c, t, g, unknown or other
  misc_feature (174)..(174): n is a, c, g, or t
  modified_base (254)..(254): a, c, t, g, unknown or other
  misc_feature (254)..(254): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagttggctgagcgtgtgttctaggtggctaagtttaaaggtgcntgtgagtgcagttgtgagtgtggggagcttagcagtccgtggggtacctgaagtctctccgtgtacgctaagcctagtgntctactacgtactactacgtcgtctagtacgacgtcggtcggtccgaccgcggtccgtacggacggacggtcggtacggtacggtcggtcgtcgtagttagttggtggtaggtacggtcggtcgtacgtacgtacgtacgtacgacgtacgtaaccgtaacggtaacgggtaccggtaccgtaccgtacgtacgtaccgtaacgaacgaactaacgtaacgtaaacgtaacgtacgtacgtacgtacgtacgacgacgtacgtacgaacgacgtacgtacgtacgacgacgaacgtacgtacgtacgttacgttacgtagtacgtacgaacgtacgtacgtacggtcggtcggttacggtacggtacgtacgtacggttacggtacggtacggtaccggtaccgg

SEQ ID NO: 76217 - DNA, 822 bp, Homo sapiens
  misc_feature: GYAE6OF02GKIHC.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctattttaaaaggtgtccattgtgaggtgcagttgttggagtcgtgggggagcttagtacagccgtgggggtccctgagactctcctgtgcagcctctggattcacctttgactaactatcgccagtgagtcgtcggggtcccgaccgacgggccttacccggaagggggaacgggggtccgtagggggtacggttcgggggttccttacgtaaggttttaacgtttccgggttaggggtttaggtttggggttggggttacggtaccccgtaacgtaacgtttaaacccgttaccggaccgaaacggtaacccgtttaaccccggggttaaaaaccgggggttccccggggttttacccggacccctaacgtttacccgtaccccgaaaggaacgtaaccctaaacgtttaaccccgaaaaggtaaacccgtaaccgggttacgttaacgttcgttacgaccgaagtacgtaacgaaacgtacgcccgttaggaacgaccggtaccggaacgggtaaccgtaccggggtttaccctttaagttaccgtcggtacgaacgaaacgtacccgtaccgttacgttgggttacgggttggtttaaccgtaacgttacggttaccgggtttaccgaccgggtttacggggcggggtaaccccggg

SEQ ID NO: 76218 - DNA, 667 bp, Homo sapiens
  misc_feature: GYAE6OF02FZDGM.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttctgtggctatttaaaggtgtcattgtgaggtgcagttgttggagtcgtgggggagcttagtacagccgtgggggtccctgagactctcctgtgcagcctctggtattcctacctttgaacctaacttatcgaccagtgacgtcgtcgggtcccgccgaggcctccggaggggacgggcgtggaggtggtctcgtagttagttcggtggttaggtggtggtcgccactacgtacgtacgcgacgtaaccgtaccgggtaaacgggtccggttaccgcctacgtcccgtacgacgtaacgactaacgttaaccaaagtaaccgaacgggttgtactcgtcgacgtagtaatacgaaacgtacgccgtaggaaggaccgacggaaccgggaacgtacgggttaccctttagttacgtggtacgacgaacgtaccgtaacgtcgttacgggtgggttacggttagttaaccgtaccggtttcggtaccggtacggttcgggtacggggtaaccccgg

SEQ ID NO: 76219 - DNA, 647 bp, Homo sapiens
  misc_feature: GYAE6OF02FZSIQ.5.73.G07.1.454.CMB.1.raw
  modified_base (491)..(491): a, c, t, g, unknown or other
  misc_feature (491)..(491): n is a, c, g, or t
  modified_base (514)..(514): a, c, t, g, unknown or other
  misc_feature (514)..(514): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacaggccgtggggggtccctgagactctcctgtgcagcctctggattcacctttgacaactatcgccagtgagctcggggtcccgccgaggcctccgaggggaacggggcgtgggagtcgggtctacgagtttagttcggtggttaggtggtggtcgccactagtactacggacaacgtaaccgtaccggtaaaggggtcccggtttaccgcccgtaagttcctaccgaggacgtaactaaacgttcccaaaagtaaccgtaaccggttttancgttaggacagtagtacgaaacncgtacctaggaagacggccggaagtacgtaccggtactttaatacgtgtacgacgaacgtccgaccgttgtacggtgggttacgggttacaacgttacgtcggttacgacggttcggacgggccgtaacgggg

SEQ ID NO: 76220 - DNA, 827 bp, Homo sapiens
  misc_feature: GYAE6OF02GXSXT.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctattttaaaaggtgtccattgtgaggtgcagttgttggagtcgtggggaggcttagtacagccgtgggggtccctgacgactctcctgtgcagcctctggacttcctaccgtttcgaactaactatcgccaatgagtcgtcgggtcccgcgacggccgtaccggaggggtaacggggcgtagggacggttcgggtccttacgtaaggtttacgttcgggttagggttacggttggggttcgggtcggacccaacgttaacttaaaccgtacgaccgtaacgtaaccgttaacccggggtaaaacggggtccccgggttttaccggaccctaacggtttccccgtaaccgaaggtaacggtaaacctaaacgtttaacccgaaaaggtaaaccgtacgggttacgttaacgttacgttacggaacgtaaacgtaagttaacggaaaaccttcggacccttagggaaacgaccgggtaaccccggaaagggtaaccccggaccggggtttttaacgttttaaacttaacggtcgttaacggaaccgtaaaagtaccccgtaaccggtttcggtacgggggtttacggggttaacgggtttacgtaaaccgttacgggttttaccgggttcccgtaacccgggtttccggggtacggggtaaccccgg

SEQ ID NO: 76221 - DNA, 718 bp, Homo sapiens
  misc_feature: GYAE6OF02HIX6I.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcgttttctggtcggcttaattttaaaaggtgtcctattgtgaggtgctagttgttggagtgtgggggaggtcttagtacgaggccggtcggggggtccctgaggtactcctcctgtgcgtacgcctcgtggacttctaccgtttgaacctaactagtcgaccataggagtcggttcgggtcccgccgacggtccgtaccggaaggggaacgggtccgtgggtaggtcggtcgtacgtagttagttcggtaggttggtcggtcggtgaccgatactaccgtacgacgacgacgttacccgggtaaacgggtccggtacgaccgtaatcctaccgaaggtacgtaaccaaacgttaccgaaactaaacgtaacgggtacgtaacgttcgtacgacgtagtaacgtaagaacacgtaccgtagacgacggtaccggaaggaaccggtccgttacccggtttagtccgttagtaccgacgtaaacgaccgtaaccgttcggttagggtacgggtttacggtacggtacgtaacggttcgggttaccgtacggttcgggtaccgggtacccggg

SEQ ID NO: 76222 - DNA, 675 bp, Homo sapiens
  misc_feature: GYAE6OF02HZFGJ.5.73.G07.1.454.CMB.1.raw
  modified_base (600)..(600): a, c, t, g, unknown or other
  misc_feature (600)..(600): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctattttaaaaggtgtcctattgtgaggtgcagttgttggagtcgtgggggaggcttagtacagcctggggggtccctgagactctcctgtgcagcctctggacttctacctttgacaactatcgcctatgagtcgtcgggtcccgccacggtccgtaccggagggggaagggcgtgggtacggtgggtcctacgtagttacttcggtaggtaggttggtaggtcgccaacgctaacgtacgacacgtaccgtaccggtaaacggggtccgttcgcctatctaccgagacgaactaacgttaccaaagtaaaccacgggtagttactcgtagaccgaagtactagaaccaggtcctaggacggacgtaccggaacggtacccgtaacggtaccgtttaagttaccgtgtaacgtacggaaactaccgaaccgtttcggnggttcggggttaacgggttcgtaacgttaacggtccggtttaccggtacggttccgggtaccggggtaaccccgg

SEQ ID NO: 76223 - DNA, 604 bp, Homo sapiens
  misc_feature: GYAE6OF02F0KLB.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcttttcttgtggctaattttaaaaggtgtccattgtgaggtgctagttgttggagtcgtgggggaggcttagtacagccgtggggggtccctgagactctcctgtgcagcctcgtggattccactttgacaactatgccatgagtcgtggtccgcgaggctaccgagggaggcgtggacgtggtctcgtagttatcgtggtagtggtggtgccatactacgtacgcagtctaccggtaaagggtccgttcgactacgtctcgagagactaacgtaccaaagaacgtacggtagtacttacgtgactaagactagaacacgcgtggagaccgtaggaccgcgttaccgtttaatacgtagtcgaacgtaagacctaccgttggtagggttgggtacggtttcgaaccgtaacggtttcggtaccgtacgtcggggtaccgggtacccgtaacgggg

SEQ ID NO: 76224 - DNA, 649 bp, Homo sapiens
  misc_feature: GYAE6OF02GCE2P.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctatttaaaaggtgtccattgtgaggtgcagttgttggagtcgtgggggaggcttagtacagccgtggggggtccctgagactctcctgtgcagcctctggattcacctttgacaactatgccatgagctcgggtccgccaggctccgaggggaggggctgggaggtgggtctcgagtttagttcggtggtagtggtggtgccacatactacgcagacgtaccggtaaagggccggttcgccatcctaccgagagactaaacttcccgaaagaaccgtaacggttgtacttcgtgacagtatagaaacacgctgacgacgaccggaaggaccgtaaccggttccgttttaagttacgttacggtacgacggtaaaacgtacccgtaacccttcggtttacggggttcgggggtttggtttaacggtaaccgtaaccggtttcggggtttacccggtaaccggtttccggggtaccgggtaaccccgggg

SEQ ID NO: 76225 - DNA, 896 bp, Homo sapiens
  misc_feature: GYAE6OF02GF41G.5.73.G07.1.454.CMB.1.raw
  modified_base (321)..(321): a, c, t, g, unknown or other
  misc_feature (321)..(321): n is a, c, g, or t
tcagatcagacacgcacgaccggtgctcgatttagctctacgctcaggggtctgagagaggagcccagccctgggattttcaggtgtttcatttggtgatcaggactgaacagagagaactcaccagtggaggtttggctgagcgtggtcttttctgtggtcttaagtttaaaggtgtccattgtgaggtgctagttggttggagttcgtgggggagtcgttaggtacacggtccgttcggggggtccctggacgaccgtcgtccgttgtcggcacgcccgttcgtggtaacttccgtacccgtttaggaacctaaacttntcgtaccgattggacgtccggtacgggtccccgaccgtacggtccgtaccggaacgggggtaagggggtcctaggggtacgggttcggggttacctacggtaagttttacgttcggttagggtttaggcggggttgtccgggcctaacgtagtacccggttacgctaaaccggacttaaccccggggttaaacggggtcccgttacgtaccctaactccgtcccgtaacggtagaaccttaacgttaaccgaaagtaaaccggacgttacggtaaccttgttaccggacgtacgtaaacgtcgtaaaacccgtacgggtacccttagggaaaccggacgtaaccccgggaaacggaacccggggttacccggtttaaaccccgttttaaagttcccgggttaacgggttacccggaaaccggttaaaccgggaccctttaaccccggttaccggtttccggggggttaacggggggttttaccggtttaaaaccgggttaacccggttaacggttttacgggttaacccccggttacggggttacccggggtaaccgggggtaaacccccggggg

SEQ ID NO: 76226 - DNA, 936 bp, Homo sapiens
  misc_feature: GYAE6OF02FJTCV.5.73.G07.1.454.CMB.1.raw
  modified_base (170)..(170): a, c, t, g, unknown or other
  misc_feature (170)..(170): n is a, c, g, or t
  modified_base (181)..(181): a, c, t, g, unknown or other
  misc_feature (181)..(181): n is a, c, g, or t
tcagatcagacacgcacgaccggtgctcgatttagctctacgctcagggggtctgagagaggagcccagccctgggattttcaggtgttttcatttggtgatcaggactgaacagagagaactcaccatggagtttgggctgagcgtgtctttctagtgctatttaaagntcatgtgagtncagttgtgagtcgtggggaggcttagtacagccgtgggggtccctgacgacctcgtctgtgcacgtcctacgtcggtattcctaccgttttagaccaaccgttatcggacccctaagttcgacggccttcggggtcccgcgaacggcccttaccggaagggggaacggggtcgttacgggacggttcgggttcccttaacgtacgttttaacgttcggtaggggttacggtgggttggttccgaccgaaccgttactaacccgttaccggccgtaaccggtaaccgtttaacccggggtaaaccggggttccccgggttacccgtacccgtaaccttacccgtaacccgtaaacggggtaaccaaaaccttaacgtttaccccgaaaaacgggaaaaccgttacggggtttaacttaacgttacccgtttacgaaacgtaaccggtaaacgtaacctaaaacccggggtacctaccccggttaaggggaaacggtaccggtaaccccgggggaaaggttaacccgttaacccgggttttaaaacccgttttttaaacgttaacgggtcccggttaaaccgggaaaccggttaaaacccggtacccctttaaacccgggttcggttttaccgggggggttttaaccggggggttttacggggtaaaacccgtttaaaccccgggttaaccggttttacccgggggtttcccgaaccggggtttttcccgggggacccgggggttaaaacccccggg

SEQ ID NO: 76227 - DNA, 621 bp, Homo sapiens
  misc_feature: GYAE6OF02HKFD3.5.73.G07.1.454.CMB.1.raw
  modified_base (553)..(553): a, c, t, g, unknown or other
  misc_feature (553)..(553): n is a, c, g, or t
  modified_base (606)..(606): a, c, t, g, unknown or other
  misc_feature (606)..(606): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttattttaaaaggtgtccattgtgaggtgcagttgttggagtcgtgggggaggcttagtacagccgtggggggtccctgagactcctcctgtgcagcctctggacttcctactttgacaactatcgcatgagcgttcggggtcccgcgacggcctaccgagggggaagggcgtggaggttcgggtctcgtagttagttcggtggtaggttgggtggtcgcacgtaactacgtacgcagaccgtaccggtaaagggtcccggttcgccacgtcctccgagagactaacttccaaagtacgtaacggttttcacgtcagtaaggtatacgaacgcggtccaggagacgaccggaagaccgtcggttaccgtttagtacctggtacacgtaacncctacgtggttggtcgggttggttacacgtacgttggtaccgtacggtcgggngggtacccaacgggg

SEQ ID NO: 76228 - DNA, 670 bp, Homo sapiens
  misc_feature: GYAE6OF02I72EI.5.73.G07.1.454.CMB.1.raw
  modified_base (176)..(176): a, c, t, g, unknown or other
  misc_feature (176)..(176): n is a, c, g, or t
  modified_base (189)..(190): a, c, t, g, unknown or other
  misc_feature (189)..(190): n is a, c, g, or t
  modified_base (254)..(254): a, c, t, g, unknown or other
  misc_feature (254)..(254): n is a, c, g, or t
  modified_base (300)..(300): a, c, t, g, unknown or other
  misc_feature (300)..(300): n is a, c, g, or t
tcagatcagacacgcacgaccggtgctcgatttagctctacgctcagggggtctgagagaggagcccagccctgggattttcaggtgttttcatttggtgatcaggactgaacagagagaactcaccatggagtttgggctgagcgtggtcgttttctagtggctatttaaaggtntcatgtgaggtgnngttgtggagtctgggggaggcttagtacagccgtgggggtccctgagactctctgtgcagcctntggattcacctttgactaactatcgccatgagcgtcgggtccgacnggcctccgaggggaagggtctggagtgggtctacgtagttagttcgtggttagtggtggtcgccgtacatacgtacgcacgaccgttaccggtaaacgggtcccggtttaccgccctaagtcccgtacccgaaggaacgtaactaactttacccgaaaagtaaccgtagggttactaacttccgtagcgaaggtactagaaacgtcgacctaggaacggtcctacccggtaagggaacccgtcggggtttacctttaaaggttcccgtagttaccggacgaaacggtaacctcccggttcgttagggtggggttttaacggtacgtaacgtacggtttcggttccgaacgtttccgggtagggaccccgg

SEQ ID NO: 76229 - DNA, 551 bp, Homo sapiens
  misc_feature: GYAE6OF02HGZIJ.5.73.G07.1.454.CMB.1.raw
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
  modified_base (483)..(483): a, c, t, g, unknown or other
  misc_feature (483)..(483): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctgggggtccctgagactctcctgtgcagcctctggattcacctttgacaactatgccatgagctgggtccgccaggctccgaggggagggcgtgggaggtgggtctcgtagttagttcggtggtagtggttgggtcgccgactatacgtacgcagactacccggtaaagggccgttcgccatcctccagacacaattccaagaacgacggtnatctgacagatagacngctagagagccgagaccgacggtcctttaanactgtgacgaagcctactctgggtcggtaggttctaaccgtagttcggtacgacgttggcggggaccg

SEQ ID NO: 76230 - DNA, 726 bp, Homo sapiens
  misc_feature: GYAE6OF02I0RV3.5.73.G07.1.454.CMB.1.raw
  modified_base (288)..(288): a, c, t, g, unknown or other
  misc_feature (288)..(288): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcgttttctaggtggcttaattttaaaaggtgtcctattgtgaggtgcagttgttggagtcgtgggggagcttagtacagccgtgggggtccctgagactctccgtgtgcacgcctctggattctacctttgaccaactntcgccatgagcgtgggtccgaccgaggcgtaccgaggggaagggcgtaggaggtcgggtctacgtagttacgtttcggtggttaggtgggtgtcgggggaccagtactactacgacacgtaccgtaacccggtaaacggggtccggttccgaccgtacgtaccgtccaacggtaacgaacctaaactaccgtaaaacgaaccggtacggttacggtaacttccgtaacggtcgaacgtacgtaagtaaaccgaacgtaccgtaggacggaacgggaccggaacggaaccgggtaacccgtttaccgggtttaacttaacggttacggtacggaacggtaaacgtacccgtaccgttacgttacggggttggggttacgggttacggttaacgtaacggttcgggttacgtaccgggttacggtcggggtaaccccggg

SEQ ID NO: 76231 - DNA, 620 bp, Homo sapiens
  misc_feature: GYAE6OF02FKUE9.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagccgtggggggtccctgagactctcctgtgcagcctctggattcacctttgacaactatgccatgagctgggtccgccaggctccgagggaagggctgggagtgggtctcgagttattcgtggttagtggtgggtcgccactatacctacgcaacgacttacccggtaaagggcccggttccgcatccgtccagacgacaattaccgaaagaaccgtacggtgtactcgtgccaagactagaaccagcctaggagaccgccgaagggaccaccggggtaccttttaacgttagtcggtacgtacggaaacgaccgtaacccgttcgtacgggttcggggttagggtttgtaaccgttacggttgggttaccgaccgttcgggtacggggtaaccccgg

SEQ ID NO: 76232 - DNA, 642 bp, Homo sapiens
  misc_feature: GYAE6OF02F0MSD.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttaattttaaaaggtgtccattgtgaggtgcagttgttggagtcgtgggggaggcttagtacagccgtggggggtccctgagactctcctgtgcagcctctggtacttccactttgactaactatcgccatgagcgtcgggtcccgccgacggctaccgaggggaaggggcgtggaggtgggtctcgtagtttagttcgtggtagttggtggtgccatactacgtacgcagtaccgtccggtaaacgggtccggttcgcctactcctccgacgacgaactaactacccgaaacgaacgtacggttgtacttcgtgacagatagaacacgctaggacgacgaccgaacggaccgtacggttaccgtttacgttacgttcggtacgacgtaacgacccgtaccttacggtgggttcgggttggtttaccggtaacgttacggttacggttacggtaccggttcgggtccggggtaacccggg

SEQ ID NO: 76233 - DNA, 758 bp, Homo sapiens
  misc_feature: GYAE6OF02JHBU5.5.73.G07.1.454.CMB.1.raw
  modified_base (268)..(268): a, c, t, g, unknown or other
  misc_feature (268)..(268): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgtttctaggtcggctaattttaaaggtgtccattgtgagtgcagttgtggagtcgtggggaggcttagtacagccgtgggggtccctgacgtactctccgtgtgcagcctctggattcnctttgactactatcgcctagtgacgtcgtcgggtccgcccgtaggccgttaccgacggggtaacgggtcctgggtaggtcggggttctaaccgtgtttaacgttcggttagggtacggtggtcgggttcggccgacgtactaccgtacgtccgaggtaaccgttaccggtaaacgggtcccggtttaccgccttaacggtcctacccgaggactaacaccgttccaaagtaaccgtcggtacgtattcgctaggagtagtcgaaacgtcgcgttagaacggtaccggcggtaagaccgggtaccgtttacgtttaccgtttaacgtagtacccgggttacgtaaaacgtcccccggttaaccgtttaccgggttaggggtttacgggggtttaccgggtttaaaccggtaaccggtttaaaccggggttttccgggtttaaccccgggtaacgtttacccgggggggtttaccccggggaaaccccgggg

SEQ ID NO: 76234 - DNA, 838 bp, Homo sapiens
  misc_feature: GYAE6OF02IH97O.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggaggtttgggctgagctggtctttttcttgtggctaattttaaaaggtgtctattgtgaggtgcagttgttggagtcggtggggaggcttagtacagtccggtcgggggtccctgacgacttcctccgtgtcgcagcctcgtggtacttcctaccgtttacgaacctaactactcgcctatgacgtccgttacgggtcccgacccggtacgggtccgtaccggaaagggggacgggggtccgttaggggtacgggttcggggttactacggttaaggttttacgtttcgggttttagggtacgggttgggttgggttacgacccgtacgtactaacgtaccggactacggtaacccgtacccgggttaaaacggggtcccggttaccgaccctaacgttcccgtacccgaaacggacgtaaccgtaaaacgttaccgaaaaacggtaaccgttacgggttattacgttccgtaagtacctaaggtaataacgaacgtacgggacctgggaacggaccggaaccgggtaacgggtaaccgttacccggggttaaccgtttttaacgttaaccgttagggtacggtaaccggtaaacgtacccgtaccggttacggttcgggggttacgggtttacggggtttaaccgttaacgtaccgggtttccggggttaccggtacgggttcccgggggtaccggggtaaccccggg

SEQ ID NO: 76235 - DNA, 813 bp, Homo sapiens
  misc_feature: GYAE6OF02H1S4A.5.73.G07.1.454.CMB.1.raw
  modified_base (176)..(176): a, c, t, g, unknown or other
  misc_feature (176)..(176): n is a, c, g, or t
  modified_base (190)..(190): a, c, t, g, unknown or other
  misc_feature (190)..(190): n is a, c, g, or t
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggtagtttgggctgagcgtgtcttttctagtggctaattttaaaggtntcatgtgaggtcgnagttgttgagtcgtggggagtcttagtacagccgtcgggggtccctgagtactctccngtcgcgacnccgtcgtggtacttacgtaccttacgaactaactacttcgaccctaagtcgacggtacgttcggccccgtaccgtacggtacccgtaccggaaggggtagggacgtgggtaaggttcgggtcctacgtagtttacttcggtgtacggtggtgtacgtccacgtactacgtacgacgacggtaccgtaaccgggtaacgggtacccgttccgtacctaacggttccctaacggaacgtaacgaactttaaaccgttaaccgaaaagtaacccgttaacgggacgtttaaccgtaccgttagggacttaaggtaaacccgttacggaaaaccgtaccgtacgggttacgtaaacgggacccggtacgggtaaaccggaccggtttaacccgtttaccgttttaacggttaaccgtaggttaccgaaacgtaaaacccgtccgttaccggttaccgttaggggttccgggtttaaggggtttaactaaacccggttaaacgggtttccggtttaacccgggtaacccgggttttacggggacccggggtaaacccccgg

SEQ ID NO: 76236 - DNA, 807 bp, Homo sapiens
  misc_feature: GYAE6OF02HS5NP.5.73.G07.1.454.CMB.1.raw
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
tcagatcagacacgcacgaccggtgctcgatttagctctacgctcaggggtctgagagaggagcccagcccctgggattttcaggtgttttcatttggtgatcaggactgaacagagagaactcaccatggagtttgggctgagctggtctttttctgtggctattttaaaaggtgtccattgtgaggtgctagttgttggagtcgtgggggaggcttagtacagccgtgggggtccctgagactctcctgtgcngcctctggacttcacctttgactaactatnccatcgagcgtcgggtcccgaccgaggccgtaccggagggggaacggggtccgtgggaggttcggggtacctacgttaggttttaacgttcgggttgggtaagggttgggtgggttcgacccgtaacgtaagttaaccgttaaccggaccgtaacggtaacccgttaacccgggttaaaaaccgggggtccccgggtttaccggaccccgtaacgtttcccgtaacccaacggtaaacgggtaaccttaaaccgtttaacccgaaaacggtaaaccgaaaccggggttaacgttaacgtttcgttaacggtactaaaggtaccgttaagaaaccgacggtacccgttagggaaacgtacgggacccggaaggtaacccggtaaccggttaacccgtttaacgttaacgttcgtacgggacgtaaacggaccctaacccggtcgttacgggtcgggtttaggggttaccgttaacgtaccggttcgggttaaccggtcggttccggggtagggtaaccccggg

SEQ ID NO: 76237 - DNA, 910 bp, Homo sapiens
  misc_feature: GYAE6OF02JLBX1.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggtcttaattttaaaaggtgtcctattgtgtaggtgctagttgttggagtcgtgggggaggtcttagtacaggccggttcggggggttccctggtacgtaccgttccttccgtggttcgccacgtcccgttcgtagggtactttaccgtacccttttagaaccgttaaaacttacgttcgtacccctaagtcggaacggtccggttccggggttaccccgcccgtaacgggtccccgtacccggaacggggggaacggggtaccggtggggtaacgggttccggggttaccttaccggttaaggttttacgtttaccgggttgggttaagggttcgggttcgggttaccgtaccccgtaacgtaacgtttaacccgtaccggtaccgtaacggtaacccggtttaacccgggtaaacgggggttccccggtttcccggacccttacgtacccgtaacccggtaagtaaccggtaaacccgtaaacgttaacccgaaaaggtaaacccgtacgggttagttaccttcggttacgaacgtaacggtacttaacgaaaccgtacggtcacggaacggaccggacccggtaaaggaacccggttccgggtttaaacctttttacgtaacgttcgtaaccggaccgaaaacctcggttaacccggtttggttcggggttacgggttacgggttaacgaaccggtttacggttccgggttaccggtaaccgttcgggggtaacccgggtaacccggg

SEQ ID NO: 76238 - DNA, 837 bp, Homo sapiens
  misc_feature: GYAE6OF02H9HA6.5.73.G07.1.454.CMB.1.raw
  modified_base (186)..(186): a, c, t, g, unknown or other
  misc_feature (186)..(186): n is a, c, g, or t
  modified_base (264)..(264): a, c, t, g, unknown or other
  misc_feature (264)..(264): n is a, c, g, or t
tcagatcagacacgcacgaccggtgctcgatttagctctacgctcaggggtctgagagaggagcccagccctgggattttcaggttgttttcatttggtgatcaggactgaacagagagaactcaccatggagtttgggctgagcgtggtctttttcgtgtggcttaagttttaaaaggtgtcctnttgtgaggtgcagttgttggagtcgtggggagtcttagtacaggtccgtcgggggtccctgagactctcctgtgcacnccttcgtggtacttctaccgtttgaactaactatacgcctagtcgacggtccgtcggtcccgaccgacggtacccgtaccggaaggggaacgggtcgtagggtacgggttcggggtcctacggttaagtttacgtttccgggtagggttaaggtttcgggtcgggttcgacccgtaaacgttaacgttaacccgtaaccgaccgttacgggtaacccttaaacccggggttaaaacggggtcccccggtttacgaccccgttaagtacccgtaccgtaacggtaaccgtaaaccgtaaaccgttaaacccaaagggtaaaacccgttacgggtaagttaccgtcgttaacggtaccgtaaggaacttaaacggaaccgtaacggtcgttaaacgggaacggtaacccgaccggggtaacgaacccgggttaccggtttaaccgtttaaagtaccgttaagtacgtacgaaaaccgtaccgtaccgttacggttcgggttacgggtttaggttaccgtaacgtaccgggtttacggtttaccggtaccggtttaccgggtcgggtaaccccggg

SEQ ID NO: 76239 - DNA, 789 bp, Homo sapiens
  misc_feature: GYAE6OF02HAULJ.5.73.G07.1.454.CMB.1.raw
  modified_base (260)..(260): a, c, t, g, unknown or other
  misc_feature (260)..(260): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcttttctgtggctattttaaaggtgtccattgtgaggtgctagttgttggagtcgtgggggaggcttagtacaggccgtggggggtccctgagactctcctgtgcagcctntggtattctaccgtttgaactaactatcgcctatagagcgtcgggtccgccaggtctccgaggggaagggcgtgggaggtgggtctactagtttacgttcggttagggttgttgggttcggtcggtaccacgtaacgttaccgtaaccggactaaggtaacccgtttaacccggggtaaaccggggtcccggtttaccggcccgtacgttcccgtacccgtaagggaacctaaccgtaaacgtttacccgaaaaaggtaaaccgtaacggggttaacgtttaacgtacccgttgaaccgtaagtaacgttaccgaaaaccgtcggcccttaaggaacggaccggaccgggaaacggttaacccgtaccggggtttaacccgttttataaacccgggttgttaccggaacggtaaacggtaccgtaaccccgtttggtacggggttacggggtttacggttaacgttaaccggtaacggtttccggggttaccggtacccggtttaccgggggtcgggtaacccccgggg

SEQ ID NO: 76240 - DNA, 828 bp, Homo sapiens
  misc_feature: GYAE6OF02IF6X8.5.73.G07.1.454.CMB.1.raw
  modified_base (564)..(564): a, c, t, g, unknown or other
  misc_feature (564)..(564): n is a, c, g, or t
tcagatcagacacgcacgaccggtgctcgatttagctctacgctcaggggtctgagagaggagcccagcccctgggattttcaggtgttttcatttggtgatcaggactgaacagagagaactcaccatggagtttgggctgagctggtctttttctgtggtctaattttaaaaggtgtccattgtgaggtgcagttgttggagtctgggggaggtcttagtacagcccgtgggggtccctgagactctcctgtgcagcctcgtggtacttctacctttaggaacctaactactgaccctagtgagtccgtgggtaccccgaccgtacggcccgtacccggaaggggggtaacggggtccgtaggggtacgggttcggggtaccgtcgttaacgtttagtttccgggtagggttaggtgggttaggtcgtacctaaccggtaataacccgttacgacgacgtaacccggttaccgggttaaaacggggtcccggttccgacccgtacgttccgtacccgtaggaccgaaaccttaattaacccgaaagtaacccgtaagggttntacctacgttgacctaagggttactaacgaaccgacgtccgtaaggtaaccggaccggacccggtacgggaaccgttaacccggggttaccctttttaaggtaaccggttggtaccgggtaaacccggtaaacgtacccggaacccgttttcggttacggggtttccggggggtttacgggtttaaacccggtttacgttaaccgggtttgggttaaccccccggggtgttaacccggggggttccggggtaaaccccccgggg

SEQ ID NO: 76241 - DNA, 713 bp, Homo sapiens
  misc_feature: GYAE6OF02FI48B.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggcttattttaaaaggtgtccattgtgaggtgcagtttgttggagtcgtgggggaggcgttagtacagccgtggggggtccctgagactctctgtgcagcctctggacttctacctttgacaacgttatcgccatgacgtcgtgggtcccgccgaggcctaccggaggggaacggggtcgtagggtacggtgggtctcgtaggtttacttcgggtggttaggtggtggtcggcacgtatacgtacgcaacggtactacggtaaacgggtcccggttcgaccctagttccaccgagacgaacctaacgttacccgaaagtaaaccgtacggttacgtaacttcgtaggactaaggagttaacgaaccgacggtacccgttaagggaaccggacggacccgggtaagggtaacccgtaccggggttacccgtttttaaagttaccggtacggttacgaaccggtaaaacgcccttaaacggtccgttaaggggttcggttagggtttaccgtaacgtacggttcggttaccgaccgttacggggacgggtaacccgg

SEQ ID NO: 76242 - DNA, 764 bp, Homo sapiens
  misc_feature: GYAE6OF02GAYKK.5.73.G07.1.454.CMB.1.raw
tcagatcagacacgcacgaccggtgctcgatttagctctacgctcaggggtctgagagaggagcccagccctgggatttcaggtgtttcatttggtgatcaggactgaacagagagaactcaccatggagtttgggctgagctggtcttttcttgtggtctattttaaaaggtgtccattgtgaggtgcagttgttggagttcgtgggggagcttaggtacaggcctgggggtccctggagacgtctccgtgtgcagcctgtgtagtctaccgttcgaacgtaacttacgtgacctatcgagtcgtcgggtccgccgtaggccgtaccgaggggaacggggcgtagggacgtgggtcgtacgtagttacgttcgtggttacgtggtgtcgcacgaagttacgtcgacgacgtaaccgtccggtaaacgggtcccggttaccgaccgacttaccgtccgtagacgactaagttccaaaggtaaaccacgggtagtacgtacgtacgacgtaagtacgtaacgtaaccgaaggtccctagggaaaccgcggaacccgggaacggaaccgtaccggggttaaccccgttttaacggtttaaccgtacgggttaaccggtaaccggtaaaaccggtaccgtaaaccccggttaaccgggttaccgggttacgggggtttacggggtttaacggttaacccggttaaccgggtttaaccgggttacccggtttaccgggttacccggggttaccggggtaaccccgggg

SEQ ID NO: 76243 - DNA, 671 bp, Homo sapiens
  misc_feature: GYAE6OF02F6HCI.5.73.G07.1.454.CMB.1.raw
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (456)..(456): a, c, t, g, unknown or other
  misc_feature (456)..(456): n is a, c, g, or t
  modified_base (508)..(508): a, c, t, g, unknown or other
  misc_feature (508)..(508): n is a, c, g, or t
tcagatcagacacgcacgaccggtgctcgatttagctctacgctcagggtctgagagaggagccagccctgggatttcaggtgtttcatttggtgagtcaggactgaacagagagaactcaccatgagttggctgagctggtcttttcgtgtggctaagtttaaaggtgtaccattgtgaggtgcagttgtggtatcgtaggggaggctttaggtacagggccgttcggggggtccctaggacggtaccgttctccgttggtacgtcgtacggcccttcgtgggtactttaccgaccgttttcgacctaaagttcgtcgacctaagttagacgtcgtacgggtcccgtccgaggcctacgagggaacggggctgggacgtgggtctacgtgttacgtcggtacggtaggtcgtgggtacnctagactgtacgncgtactcggtaacggccggtacnctacgtcgcctaggcgtaacgtacgtaacctaacgacgacgtacgtagtacncggtacgacgtaagtaacgacgtaccgacttacggacgtacgacggacgtaacgaccgtacgttaaacggttctacgtcgtacggaacacgtaaccggtatacggttacgggttagtacggttaacgtccgttagggttcgtcgttaccgggtcggtaaccgg

SEQ ID NO: 76244 - DNA, 664 bp, Homo sapiens
  misc_feature: GYAE6OF02GLDAN.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggcttttcttgtggctatttaaaggtgtccattgtgaggtgcagttgttggagtcgtgggggaggcttagtacagccgtggggggtccctgagacctctcctgtgcagcctctggattccacctttgaccaactatgccatgagtctcgggtcccgccgaggcctccggaggggaaggggcgtgggaggtgggtcctcgtagttattcggtggttaggtggtggtcgccactatactacgcacgacgtaccggtaaacgggtcccggttccgccgtatccgtacccgaggaacgactaaacttaccgaaagaaaccgtcggttacgtatccgtaggccaagacttacggaacacggccctaggaacgacggacccggaaggacccgtaccgggttaccgttttaagtaccgttagggtacgaacggaaacgaccctaccgttgttcgggggtagggttacggtttacgaacgttacggtttggggttcccaaccgggttcgggacccggggtaacccgg

SEQ ID NO: 76245 - DNA, 683 bp, Homo sapiens
  misc_feature: GYAE6OF02FXDZA.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtctttttcttgtggctaattttaaaaggtgtccattgtgaggtgcagttgtggagtcgtgggggagcttagacaggccgtggggggtccctgacgactctcctgtgcagcctcgtggattcctaccgttttcgaactaactatcgcccatgagtcgtcgggtcccgccgaggcctaccggaggggaacgggcgtagggaggtgggtctcgtagttgttcggtgggttagtggtggtcgccacgataccgtacgcacgtaaccgtacccgggtaaagggtcccggttacgacctagtcctacagacgaactaacgttaccaaagtaacgaacggttacgtaactcgtacgacgtaacgagtaacgaacgaccgccgtaggtaacggacggacccggaaggtacccgtaaccggtccgttttaacttacgtacggttagacccgaagtaccctaaccggttacggtcgggttacggggttcgggttactacggtaaccgttcgggttacgtccggttacgggtccggggtaacccgg

SEQ ID NO: 76246 - DNA, 792 bp, Homo sapiens
  misc_feature: GYAE6OF02F94HR.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttattttaaaaggtgtccattgtgaggtgcagttgttggagtcgtgggggaggcttagtacagccgtggggggtccctgagactctcctgtgcagcctctggacttctaccttttgacaacttatcgccatgagtcgtcgggtcccgccgacgggcctaccggaaggggaacggggtcgtgggtagggttcggggttcctcgtaaggtttacgttcgggttagggttaggttgggttgggttcgcccgtaacgtacgttaaacccttacggacgtaacgtaacccgttacccgggttaaaacgggggtcccgggtttacccgacccgtacttccgtaccgaaggacgtaacctaagttacccgaaaagtaaccgacggtagtactcgtcgacacgatacggaaactcggtcccgtaggaacggtaccgggacccggaagggtaacccgtaccggggtttccgttttaaacgtttacgtgggtacgtaaccggaaaacgttcccgtaacccggttcggttacgggggtttcggggggttacggggtttttaacgtaaaccccgggttaaggttttcccggggtttaccggtaaccgggttcccggggggttacccgggggtaaaccccggg

SEQ ID NO: 76247 - DNA, 685 bp, Homo sapiens
  misc_feature: GYAE6OF02FNOHJ.5.73.G07.1.454.CMB.1.raw
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (258)..(258): a, c, t, g, unknown or other
  misc_feature (258)..(258): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgttttctaggtggctattttaaaaggtgtccattgtgaggtgcgtgttggtgngtgggngggngtacgtagtacgcgtcggggtccggtcgtagacgtctcctcgtgcncgctcctgtagtctccttacgtacaactactagtccactagtaggccgttcggtccgggtcccgacggacgtccgacgggaacggggacggtcggtaggtcggtcgtcgtagttagttcgttggtaggtggtggtgtcgaccatactacgtcgacgacgtaccgtaacgggtaccggtccggtccactctcctacgacgacaactacacgaacgacgtacgtactactacgacgacgagagacgacgacgcgaggacgacgacggacgaccggtaccgttacgtttacgttacgtagtaccggaagaaccccccccgtagttccggttacggttacggggttcgggttttcgggttaacgttaccggtttacgggtttaccgggttacccggtttacgggttccggggtacccgggtaacccggggg

SEQ ID NO: 76248 - DNA, 615 bp, Homo sapiens
  misc_feature: GYAE6OF02GH1CY.5.73.G07.1.454.CMB.1.raw
  modified_base (268)..(268): a, c, t, g, unknown or other
  misc_feature (268)..(268): n is a, c, g, or t
  modified_base (451)..(451): a, c, t, g, unknown or other
  misc_feature (451)..(451): n is a, c, g, or t
  modified_base (458)..(458): a, c, t, g, unknown or other
  misc_feature (458)..(458): n is a, c, g, or t
  modified_base (528)..(528): a, c, t, g, unknown or other
  misc_feature (528)..(528): n is a, c, g, or t
tcagatcagacacgcacgaccggtgctcgatttagctctacgctcgagggggtctgagagaggagcccagccctgggattttcaggtgttttcatttggtgatcaggactgaacagagagaactcaccatggagtttgggctgagctggctttttcttgtggctaattttaaaaggtgtccattgtggagtgctagttgttggagtcgtgggggaggtcttagtacaggccgtggggggtccctggacgactctcctgtgcagcctgngattcctactttgactaactatcgccatgagtcctcgggtcccgccgcggcctccggaggggaacgggcgtgggaggtggtctcgagttagttcggtggtaggtggtggtcgcactagtactacgcagtaccgtcggtaacgggccgtacgccatccacagacgactactacaagacgaggtnactcgtnacgtagactacgaaccgaggtcctaaggacgacggaccgaaggacccgtacgggttacctttagtaccgnggtacgtacgaacgtccgtacgttcgtgggttcgggtaggttctaacgtacggtttcgggaccgtcggttccgggcggtaacccggg

SEQ ID NO: 76249 - DNA, 740 bp, Homo sapiens
  misc_feature: GYAE6OF02H9ZJW.5.73.G07.1.454.CMB.1.raw
  modified_base (178)..(178): a, c, t, g, unknown or other
  misc_feature (178)..(178): n is a, c, g, or t
  modified_base (707)..(707): a, c, t, g, unknown or other
  misc_feature (707)..(707): n is a, c, g, or t
tcagatcagacacgcacgaccggtgctcgatttagctctacgctcagggtctgagagaggagcccagccctgggattttcaggtgtttcatttggtgatcaggactgaacagagagaactcaccatggagtttggctgagcgtggtcttttcgttaggtggtctaagttttaaaggtntcctattgtgaggtgctaggttgtggtagtcggtggggacgtcttagtacgaggtccggtgggggtccctaggacgtaccttcgtccgttggtcgtcgtacgtccttacgtcggtaccttaccgtaccgtttagaaccgtaacttcgtcgtaccgtaagtcggtaacgtccggttaccgggtcccgtaccggtaacggtccggttaccggaaggggtacgggtcgttacgggtaccgggttcggttacttacggttaacggtttacgttcgggtacggttacgggtcggtcggtactacccgtaagtacgttaacgtaccgtagtaccggtaaccgttaaccgggtaacggtcccggttcgccgtagtttccaccggaagtacgtaacgttacctacggaaacgtacggtccgtagtacctgtacgtccgaaagttcgacgatccggtactaggacgtaccgcggttaagccgtcggttctttagactcggtaacgactaacgtcgacgttggtggtagggttctaacncgtacggttccgtacgcgtagggtcgaacccgg

SEQ ID NO: 76250 - DNA, 753 bp, Homo sapiens
  misc_feature: GYAE6OF02I8UL6.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccagtggagtttgggctgagctggtctttttcttgtggtcttaagttttaaaaggtgtccattgtgaggtgcgtagttgttggagttcgtgggggaggtcgttagtacaggtccgtcgggggtcctggacgtctcgtcgtcgtgcacgtcctctggtattcctaccgtttacgactaactatcgaccatgacgtcgttcgggcccgccgacggtcgtccggaaggggaacgggtcgtgggaggttcgggtcctacgtaggtttacgttcgggttagggttacggttgggttcgggtcgtaccgaacgtaacgttaaccgtaacggtcctaaacgggtaacccgttaccggggttaaaaccggggttcccggttacccgaccctacggttccctaacccggtaagaacggtaaacctaacgttaacccgaaaggtaaaccgtacggttaacgttacttcgtcggacgtagtaccgtaacgtaacgacgtaccgtaggtacgacgtacggaacggtaccgtaacggttacctttaagttaaccgtggtgtaaaccgaacgtacctacgttcgttacgggtgggttacggttaggtaactcggttcgtacggtcgttcgggtacgggtaccg

SEQ ID NO: 76251 - DNA, 708 bp, Homo sapiens
  misc_feature: GYAE6OF02G0A5B.5.73.G07.1.454.CMB.1.raw
  modified_base (174)..(174): a, c, t, g, unknown or other
  misc_feature (174)..(174): n is a, c, g, or t
  modified_base (530)..(530): a, c, t, g, unknown or other
  misc_feature (530)..(530): n is a, c, g, or t
  modified_base (547)..(547): a, c, t, g, unknown or other
  misc_feature (547)..(547): n is a, c, g, or t
  modified_base (658)..(658): a, c, t, g, unknown or other
  misc_feature (658)..(658): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcttttctgtggctaattttaaaaggngtccatgtgagtgcagttgttggagtcgtgggggagcttagtacagtccgtgggggtccctgacgcttctctgtgcacgctcgtgtattactaccgtttgaactaactatcgaccaagtcgcgtcgtcgggtcccgccgtacggccgtacggaggggtaacgggcgtggacgggtgggtacctgttaggtttcgtttcgggtagggttggttcggtggtacgccgaacgtacttaacgtacggaacgtacgtaaccggttaccggtaaaccggggtcccggtaccgaccctattccccggactaaacgaacgtacgttaaacttaaccgaaacgaaccggtcggttacttactcgngtacaacgtagacgtanaaccgtcgtaggaacggaccggtaggaacggtaccgtacggttttaccgttagttaacctgggtacggtacctaacgaaccctcggtacgtttaggggtggggttaacgtntttaaccggcgtttacgggttccgtcggtacggggttggtaaccccgggg

SEQ ID NO: 76252 - DNA, 952 bp, Homo sapiens
  misc_feature: GYAE6OF02JN4B1.5.73.G07.1.454.CMB.1.raw
tcagatcagacacgcacgaccggtgctcgatttagctctacgctcaggggtctgagagaggagcccagccctgggattttcaggttgttttcatttggtgatcaggactgaacagagagaactcaccagtggagttgggctgagctggtcttttcgttgtggtcttaattttaaaggtgtcctattgtggtaggtgtcgtaggtttggttgggacggttcggtggggggaggtcgttaggtacgaggtccggttcggggggtccctggacgtacctcctccgtggtcgcgacgtcctcgtggtacttccgtaccgtttagaacctaaccttaagtccgacctagttcgacggtccgttccgggtccccgacggtacggccgtaccggaagggggaacggggtccggtaggggtacgggttcggggttccgttacggttaaggtttacggtttcgggttagggttacgggttgggttcgggtaccggtaccgtaacgtaacttacgtaccgtacgaacggtacccgttaacccggggtaaacggggttcccggttaccgtacctacgttacccgtaccgtaaacggtaacggtaaacctaaacgtttaacccggaaaacgtaaaccgggttagggtaaaccgtttacgttaaccggtcggtaacgtaaccgggaattaaacccgggtaaacccacggggtttaacccgaagggtaaccggtaaccggggacccgggtaaaccgggtaacccggtaacccgggttttaaccccggttttaaggtttaacccgggtaccggttaacggttaacccgggaaaacgttaccccgtaacccgggtttaggtttacccggggggttaggggttaccggggttttaacctaaaccgggttaacgggttttccgggtaaccggttaaccgggttcccgggggtaacggggtaaccccgggg

SEQ ID NO: 76253 - DNA, 698 bp, Homo sapiens
  misc_feature: GYAE6OF02FSSGH.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttggtggtctaattttaaaaggtgtcctatttgtggaggtgctaggttggttggagtcgtggggggaggtcttagtacaggccgtggggggtccctgacgtactctcctgtcgcacgtcctgtggattccaccgttttgaactaaacttatcgaccctagtcggagtcgttcggggtcccgtcgacggcctaccggaagggggaacggggcgtagggtacgggttcgggtactcgtaggtttagttcggtggttaggttgggtgggtcgaccctagtaactaccgtaccggacacggtacccgtaccgggtaaacgggtcccggttccgaccactccacgagacaacgtacttaccaagaaccgtacggtatactcgtagctagatacgaacacggtcgtagaagccggaccggaggacgaccgggttaccgtttaattacgtgacggtaccgaacgaccgtaccggtgtttcggggtacggggttggttacgtaaccttaacgttgggttaacctccgggttacggaccggggtaaccccgg

SEQ ID NO: 76254 - DNA, 636 bp, Homo sapiens
  misc_feature: GYAE6OF02FMHP1.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagccgtggggggtccctgagactctcctgtgcagcctctggattcactttgacaactatgccatgagctgggtccgccaggctccgaggggaaggggctgggagtgggtctacgtagttagttcgtggtagtggtggtgccacatactacgcagaccgtaccggtaaagggtcccggttacgccatcctaccagagaactaaattacccaaagaaaccgacggtacgtaatccgtgacagactacgaaacaggcctaggaagacggaccggaggaaccgaaccgggttccgttttaaactacgtggtacgacggaaaacgacccgtaacccgttcgtcggggttacggggttgggtttacggtaacgtaaccggtttcgggttaccgtaccggttcggggtacggggtaccccgg

SEQ ID NO: 76255 - DNA, 883 bp, Homo sapiens
  misc_feature: GYAE6OF02H8Q8M.5.73.G07.1.454.CMB.1.raw
tcagatcagacacgcacgaccggtgctcgatttagctctacgctcaggggtctgagagaggagcccagcccctgggattttcaggtgttttcatttggtgatcaggactgaacagagagaactcaccatggagtttgggctgagctggtctttttcttgtggtcttagttttaaaaggtgtcctattgtgaggtgctagttgtggagtcgtgggggaggtcttagtacgaggtccggtcggggggtccctggacgtacgttccgttccgtgtcgacgtcgtccttcgtggtactttacctaccgttttcgaacctaacttacgtcgaccctagtcggtacgtccggttcggggtccccgtaccggacgggtcccgtaccgggaacgggggaacggggtcgtacgggtacggggttcgggttccttacggttaggtttacggtttcgggttaggggttaggttgggttacggtaccgtaccgtaacgttaacgttaaccgtaccggaccgtaacggtaacccgttaacccggggttaaaacgggggttccccgttaccggacccgttaaccgttcccgtaccgtaacgggtaaccgtaaaccgttaaacccgttaccgtaaaaaccggtaacggttaacccgggtttaggttaccttaccggtacgtaacccgaggtaaacgttaaccggaaccgtaccggtaccgttaacggaacgggtaccggaacccgggtaagggaacccgttaccggtttaaccggttttagtacgttacgtacgaccgaacgtaccgtccgttacggttgggttaccggggttacggttacgttaaccgttcgggttacggttaccggtaccgttcggggttacccgggtaacccggg

SEQ ID NO: 76256 - DNA, 700 bp, Homo sapiens
  misc_feature: GYAE6OF02JE6X3.5.73.G07.1.454.CMB.1.raw
  modified_base (305)..(305): a, c, t, g, unknown or other
  misc_feature (305)..(305): n is a, c, g, or t
  modified_base (487)..(487): a, c, t, g, unknown or other
  misc_feature (487)..(487): n is a, c, g, or t
  modified_base (681)..(681): a, c, t, g, unknown or other
  misc_feature (681)..(681): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtgtcgttttctgtggctaattttaaaggtcgtccattgtgaggtgcagtttgttggagtcgtgggggagcgttagtacaggccgtggggggttcccaggacgactctcctgtgcacgcctcgtggacttccacctttagacctaactactcgccattcgngtcgtcgggtcccgaccgcgggtctccggaaggggaacggggtctggggaggttcgggtctacgtagtttagttcggtgggtacggttgggtcggtcgtaccacgtagttaaccgaccgtacaacggtaccgttaaccggggtaaaccgggttccggttccgaccctacgttcccacggaanaacggtaacctaacgttaccaaaggaccctaagggttagtacgtcgttacgacgaaggtataaccgacgacgttcgaggaacggaccggtaccggaccggtacgaccgggtttctttaacgttacgtcgtacgagaaacctccgtaacggtcggttaggtcgggttagttacgtaccgttagtcgggttaaccnggtacgggtcggaaccggg

SEQ ID NO: 76257 - DNA, 536 bp, Homo sapiens
  misc_feature: GYAE6OF02FOWO4.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctggggggaggcttagtacagcctggggggtccctgagactctcctgtgcagcctctggattcacctttgacaactatgccatgagctgggtccgccaggctccagggaaggggctggagtgggtctcagttattcgtggtagtggtggtgccacatactacgcagactccgtaaagggccggttcgccatctccagagacaattccaagaacacggtgtaatctagcagatgaacagcctgagagccgaggacacggcctttatacgtgtgacgaaagactacctactggtgggtacggttgtacaacgttggttcgactcggtgggacccgg

SEQ ID NO: 76258 - DNA, 862 bp, Homo sapiens
  misc_feature: GYAE6OF02JNRVP.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggtacttaagttttaaaaggtgttcctattgtgtaggtgctaggtttgttggagttcggtgggggaggtcgtttacgtacgtaggtccggttgggggggttcccctaggtacggtaccttccgttcccgttaggttcgacacggtcccttcgtggtacttcctacctttagacctaaactagtcgtccgtatgacggtcgtcgggtcccgccgacggcctaccggaggggaacgggtcgtgggacggtacgggtcttacgtaggtttacgttcggtaggttaggtgggtagttcgaccacgtagttaccgacggtaccgacgtaaccgttaccgggtaaacggggttcccggttaccgtcccgtaacgtttccgaacccgtaagggacctaaaaccgtaacgttaacccggaaaacgaaccggttaacgggtacgttacgttacggttcgaacggtaacgtaagttaacccgaaacgtccgtaacggtacggtaacggtaccggtaaccggggaaaccgggtacccgttaaccgggttaccgttttaaacggttcgggtaggtaacccggtaaccgaaaacggttacccgtaaccggttggttacgggggttacggggtttaccgggttaacgttaacccggttaacggggttaccggttaccggtttaacggggttccccggggtagggttaaccccggggg

SEQ ID NO: 76259 - DNA, 647 bp, Homo sapiens
  misc_feature: GYAE6OF02JIWTS.5.73.G07.1.454.CMB.1.raw
  modified_base (491)..(491): a, c, t, g, unknown or other
  misc_feature (491)..(491): n is a, c, g, or t
  modified_base (576)..(576): a, c, t, g, unknown or other
  misc_feature (576)..(576): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggccttggagctggctttttcttgtggcttattttaaaggtgttccattgtcgaggtgcagttcgttggagtcgtgggggaggcttagtactacgccgttggggggtccctgacgacttctccgtgtcgtcgagccttcgtggattccgtactttgacaactatcgaccatcgagcgtcggtccgcgtagcgtaccggagggacggtctgggtaggtcggtactcgtaggtttactggttcggtaggttggtggtacgtccacgtacgttaacgtccgtaccgtagtacccgtacgggtaaacggggtccgttcgaccgtatcctaccgagacgactatacgaagaaccgtggtntactacgtctacgtacgtctaagaccgacgtacggtagtacgggaaccgcgggtaaacgtaccgggccgttacgttacgttacgngttacgacgtaaaccgctccgtagttggtagggtcggtacgtagtacgtgttaccgcgttcggtaggaccg

SEQ ID NO: 76260 - DNA, 718 bp, Homo sapiens
  misc_feature: GYAE6OF02IDOE7.5.73.G07.1.454.CMB.1.raw
  modified_base (159)..(159): a, c, t, g, unknown or other
  misc_feature (159)..(159): n is a, c, g, or t
  modified_base (215)..(215): a, c, t, g, unknown or other
  misc_feature (215)..(215): n is a, c, g, or t
  modified_base (323)..(323): a, c, t, g, unknown or other
  misc_feature (323)..(323): n is a, c, g, or t
  modified_base (352)..(352): a, c, t, g, unknown or other
  misc_feature (352)..(352): n is a, c, g, or t
  modified_base (548)..(548): a, c, t, g, unknown or other
  misc_feature (548)..(548): n is a, c, g, or t
tcagatcagacacgcacgaccggtgctcgatttagctctacgctcaggggtctgagagaggagcccagccctgggatttcaggtgtttcatttggtgatcaggactgaacagagagaactcaccatggagtttgggctgagcgtggtcgttttcgtagnggtctaagtttaaaggtgtcattgtgaggtgcgtaggttgttggagtcgtaggggnggtcttagtacgagtccgtcgggggtcctgaggactcctccgtgtacgcgcgtccgtgtggcttcctaccttagactaactactgaccagtgacgtcgtacggtcccnccgtaggccttaccggaagggtccgggtntaggacggttcgggtctacgtaacgtttacgtggtggtaggtcggttgggcttaacccagtacgttaactcgacgtacggtacctaacgggttaacgggccccgttagccccgtatcccgtacgaacgtgtaaaccgtaacttccgaaacgaacgttcggaggtattcgaaacgcgtagtaagtacgaaacccggngtaccgtaggaacgtacggaccgtaagggtacccgtacgttaccgttagtaccgcgtacggaaccgtaacggttcctaaccgggtcgttacgggttaggggttaaccgttacggttaaccggtaaccggtccggtttaacggtaccgggttccgggtacccgggtaacgg

SEQ ID NO: 76261 - DNA, 669 bp, Homo sapiens
  misc_feature: GYAE6OF02I8LLG.5.73.G07.1.454.CMB.1.raw
  modified_base (306)..(306): a, c, t, g, unknown or other
  misc_feature (306)..(306): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttctgtggcttattttaaaaggtgtccattgtgagtgcagttgttggagtcgtgggggaggcttagtacagccgtggggggtccctgacgactctcctgtgcagcctctggattcacctttgactaactatcgcctatgagcgttagggtcccnccgacggcctaccgaggggaagggctgggtagtgggtctgtagttagttcggtggtaggtggtggtcgaccactactactacgcaacgaccgtaccggtaacgggcccgttcgacctacgtacctacccgtaagaacgtacctaaacgttacccgaaagtaaaccgttacgtttaactcgttggactaagtactacgaaacgtacggtccgtagaacggacgccggtaacggaccgacgggtttcctttaagttcgtggtacgaacgaaacgccttaacgtcgttacgggttcggggttacggtttacgtaaccgtagtttcggtaccgtacgttacggggtccggggtacccgtaacccggg

SEQ ID NO: 76262 - DNA, 658 bp, Homo sapiens
  misc_feature: GYAE6OF02G24NA.5.73.G07.1.454.CMB.1.raw
  modified_base (168)..(168): a, c, t, g, unknown or other
  misc_feature (168)..(168): n is a, c, g, or t
  modified_base (172)..(172): a, c, t, g, unknown or other
  misc_feature (172)..(172): n is a, c, g, or t
  modified_base (176)..(176): a, c, t, g, unknown or other
  misc_feature (176)..(176): n is a, c, g, or t
  modified_base (180)..(182): a, c, t, g, unknown or other
  misc_feature (180)..(182): n is a, c, g, or t
  modified_base (188)..(188): a, c, t, g, unknown or other
  misc_feature (188)..(188): n is a, c, g, or t
  modified_base (196)..(196): a, c, t, g, unknown or other
  misc_feature (196)..(196): n is a, c, g, or t
  modified_base (342)..(342): a, c, t, g, unknown or other
  misc_feature (342)..(342): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcggtgtgttctagtcgctattaagngtcntgtnagtnnnttgtgngtctgggngctagtacagccgtggggtccctgagtcctctccgtgtgcgacgcctcgtggattccgtacctttgactaactatcgccagtgagcgttcggcccgacgtcggcctccggagggtacgggctgggaggttcggtctcgaaggtttntttaggttgggtaggttggtcggtcgaccctagtactacgtaccgacacggtaccgtaccgggtaacgggtcccggttcgaccctagtccctacgtaaggacgaacacgtttaaccaaacgtaacgtacggttacgttacgtgtacggtccaagtactaggaccacgtcgagacggacggaccggacgacggtaccgttacgttttaacttaggtacgtaggacgtaacggacctcggttacgttgggttggggttacggtttacggtaacttaacggttcgttttaccggaccggttaccggggacggtccgggg

SEQ ID NO: 76263 - DNA, 769 bp, Homo sapiens
  misc_feature: GYAE6OF02I8MEF.5.73.G07.1.454.CMB.1.raw
  modified_base (176)..(176): a, c, t, g, unknown or other
  misc_feature (176)..(176): n is a, c, g, or t
  modified_base (272)..(272): a, c, t, g, unknown or other
  misc_feature (272)..(272): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttctgtggtcttaatttaaaggtntccattgtaggacggtgctaggttgttggagttcggtgggggaggtactttagtacacggccggttcggggggtcctgacgacctcctccgtgtcncgacgccttcgtggacttcgtaccttcggactacttatcgccatgagtcgtcggtcccgctaggtccgtacggaagggggacggtcgtaggggtagttcgggtacctcgtaagtttcgtggttgggtaggttggtggtaccgactacgtacgtacgtacgacgacgtaccgtaccggggtaaaccgggttccgtaccgactacgtccgtacgcggtaactacgtaaccttacggaagtaaccggacggttactacgttctaggacctagtaatcgaaaccgtcggtcgaaaggtagaccggtgtaaaccggaaccgttccgggtttaaccgttaaaggttccggtaacggttaacggaacccgttaaacggtaccccgtaacggttttaccgggtacggggttttacggggaccgggttttaaccgttacggtaacccggtttacgggttttccccgggaacgggttttcccggggggccggttaaacccccggggg

SEQ ID NO: 76264 - DNA, 610 bp, Homo sapiens
  misc_feature: GYAE6OF02GWY6D.5.73.G07.1.454.CMB.1.raw
  modified_base (305)..(305): a, c, t, g, unknown or other
  misc_feature (305)..(305): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
  modified_base (484)..(484): a, c, t, g, unknown or other
  misc_feature (484)..(484): n is a, c, g, or t
  modified_base (523)..(523): a, c, t, g, unknown or other
  misc_feature (523)..(523): n is a, c, g, or t
  modified_base (534)..(534): a, c, t, g, unknown or other
  misc_feature (534)..(534): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctattttaaaaggtgtcattgtgaggtgcagttgttggagtctgggggagcttagtacagccgtggggggtccctgacgactctcctgtgcagcctctggattcacctttgaccaactatcgcctatgagtcgtcgggtacccnccgaggccgtacccggaaggggaaggggctgggtaggtcgggtactcgtagtttagttcgtggtagtggtggtcgccacatacacgcaaggctaccggtaaaggggcccgttacgcctatccctcagacaactaaattacccaaagtaaccncgggtatactcgtgacanaatcgaacnggcctagacggtacgcgaggacaccgggtctttaatcgngtcgacgtaanaccgccttagtgggtcgggtttaggttacgtacgtaacggtttcgggttaccggacgttccgggcgggtacccggg

SEQ ID NO: 76265 - DNA, 653 bp, Homo sapiens
  misc_feature: GYAE6OF02GOF08.5.73.G07.1.454.CMB.1.raw
  modified_base (497)..(497): a, c, t, g, unknown or other
  misc_feature (497)..(497): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctaattttaaaaggtgtccattgtgaggtgcagttgttggagtcgtgggggaggcttagtacaggccgtcggggggtccctgagactctcctgtgcagcctctggtattcctacctttgaaccaactatgcccatgacgtcgtcgggtccgccgaggcctccggaaggggacggggcgtagggaggtcgggtctcgtaggtttattcggtgggtaggtggttgggtcgccactacgttacgacgacgaacgtacgtaccggtaaacggggtcccgggttcccgcctacgttcctacccgaggaacgacctaacttacccgaaagaaccgtacgggtntactcgtagacgagagtacgaacacgccgtgaacggacgacccggaaggacccgtacgggttcctttagtaccgtgagacgtaacgccgtaccgttcggtaggtgggttggttacgtaacgtacgttcggtacgtcggtccggtacgggtacccgg

SEQ ID NO: 76266 - DNA, 708 bp, Homo sapiens
  misc_feature: GYAE6OF02IK62F.5.73.G07.1.454.CMB.1.raw
  modified_base (191)..(191): a, c, t, g, unknown or other
  misc_feature (191)..(191): n is a, c, g, or t
  modified_base (539)..(539): a, c, t, g, unknown or other
  misc_feature (539)..(539): n is a, c, g, or t
tcagatcagacacgcacgaccggtgctcgatttagctctacgctcagggtctgagagaggagcccagccctgggattttcaggtgttttcatttggtgatcaggactgaacagagagaactcaccatggagtttgggctgagcgtggtcgtttttctgtggctaagttttaaaaggtgtcattgtgagtgnagttgtgagtcgtggggaggcttagtacagccgtggggggtccctgacgacctctacctgtagcacgccgtctggtagtcctacctttagaacgtaacctagtgccagtcgacgcgtaccgggtaccgacgtacggcctaccggaggggaacggggctgggaggtcgggtctcgtaagttacgttggttaggtggttaggttgggtcaccacgatacgacgacgacgaaccgtaccgttaacggggcccggttccgaccgtatcccgtaccaaggtaacgtaaactaaaccgttaacaaacggtaacgtaaacggttgtaactcgtaaggacgtaagaactagaaacncgtaccgagaacggtcggaaccggtaaggaacacccgggttacgttttaaactaccgttcgaacgacgtaaaccgtaacggtccttagggtggggtttacgggtacggttttaaggtaacctaaccggttgggttaaccgaacccgttcggggttaacgggaaccccgg

SEQ ID NO: 76267 - DNA, 557 bp, Homo sapiens
  misc_feature: GYAE6OF02GVNR3.5.73.G07.1.454.CMB.1.raw
  modified_base (287)..(287): a, c, t, g, unknown or other
  misc_feature (287)..(287): n is a, c, g, or t
  modified_base (439)..(439): a, c, t, g, unknown or other
  misc_feature (439)..(439): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtctgggggaggcttagtacagcctggggggtccctgagactctcctgtgcagcctctggattcacctttgacaactatgccatganctgggtcccgccaggctccgaggggaaggggcgtgggagtgggtctcagttattcgtggtagtggtgggtgccacatacacgcagactccgtaaagggccggttcgccatctccagacgacaacttaccaagaacacggtgtatctgcaganagaacagcctagacgacgcgaggacacggtccgtttacttactgtagacgaagaccgacctcgttggtgggtggtttacgtacgaacgttgggttacctacgtcgggtgggtacccgg

SEQ ID NO: 76268 - DNA, 170 bp, Homo sapiens
  misc_feature: GYAE6OF02G3PGX.5.73.G07.1.454.CMB.1.raw
  modified_base (163)..(170): a, c, t, g, unknown or other
  misc_feature (163)..(170): n is a, c, g, or t
tcagatcagacacgcacgaccggtgctcgatttagctctacgctcagggcacgaccggtgctcgatttagtcacgcgagaaagggaaagggggctggccctgacgtgtttctgttcccgccctcctccgtgtctgatctgagcgggctggcaaggcgcatagnnnnnnnn

SEQ ID NO: 76269 - DNA, 772 bp, Homo sapiens
  misc_feature: GYAE6OF02JDCGW.5.73.G07.1.454.CMB.1.raw
  modified_base (273)..(273): a, c, t, g, unknown or other
  misc_feature (273)..(273): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtccttttcttgtggcttaattttaaaaggtgttcctatttgtgaggtgcgtagtttgttggagtcggtgggggagcgttagtacgagtccgtgggggtccctgacgactctcctgtgcacgcctcnggtattcctactttacgacctaaacgtatcgacctagtaggacgtcggtaccgggtcccgaccggaccggtccgtaccgggaagggggacggggtcggtacggggtacggttcgggtccgttacgtttacggtttaggtttaccgggtttgggttaaggtttcgggttacggttccgaccgtaacgtacttaccggtaaccggacgtacgtaaacccgttacgggtaaaccggggtcccggttccgaaccgtcgtaccctaccggtacgaacgtaactaaacctaaccggaaacgtaaccggtaggttaagtacgttacgtcgtacgaagtacgtacgaaacgtacgaccgtaggacgaccgacggaacggaccggtacgtttacgttacgttacgtacgtacggaaccgtacgtacctaacgttcggtacggggttggtacggtttacgacgttaccgggttaccggttacggtacggttacggggccgggtaaccgg

SEQ ID NO: 76270 - DNA, 695 bp, Homo sapiens
  misc_feature: GYAE6OF02JKKYD.5.73.G07.1.454.CMB.1.raw
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
tcagatcagacacgcacgaccggtgctcgatttagctctacgctcagggtctgagagaggagcccagccctgggattttcaggttgttttcatttggtgatcaggactgaacagagagaactcaccatggagtttgggctgagctggtctttttcttgtggctaattttaaacggtgtccattgtgaggtgcagttggttggagtcgtggggagcttagtacagcgtgggggtccctgacgactctcctgtcncgagtctcgtggtnttcctacctttgacaactgtgccaatgagcgtacggtccgcgacgccgtccgaggggacggcgtagggagtgggtctcgtagttacgttcggtggtaggtggtggtcgaccgtanaactacgaccgganacggtaccgtaaccggggtaaacgggcccggttccgacctacgtccgtaaccgaggtaaacggtacctaacgtaccgaaagtaaccgtacgggttactaagttcagtaccgagtataacgaaacgcgtacgtcgggaacgtaccggaccgtaacgggtaccggtaacccggttaccgttttaacgttaccgttagggtaccacggaaaccgttacccgtacggtagttcggggttcggttaacggggtacttaacgtacggttccgggttacggtccggtcgggttaccgggtacccgg

SEQ ID NO: 76271 - DNA, 746 bp, Homo sapiens
  misc_feature: GYAE6OF02IU052.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggcgtttttctagtggctaattttaaaaggtgtccattgtgaggtgcagttgttggagtcgtgggggaggcttagtacagccgtgggggtccctgagactctcctgtgcagcctctggattcacctttgactaactatgccatgagcgtcgggtcccgcgaggctccgaggggaagggcgtggaggtggtctgtagttagtcgttggtagtggtggtcgacacgatactacgcacgtacgtaccggtaaacgggtcccggtttccgaccgtacgttcccgtaccgaacggtaacgaaaccgtaaactttaacccgaaaagggtaaaccgtaaccggggtttacgttaacgttaccgtcggaaccgtaaaggtactaaacgggtaaacctaaccgggtcccgttaaaggaaccgggaccggtaccggaacggggtaaccgtacccgggttttacccggttttaaatttaacccgtaggttaccggaaccgtaaacggtaccccgtaccgtttaccggttcggggttacggggtttcgggtttaacgtaaccgtaaccggttttcgggtaccgtaacggttccgggggtacgggtaccccgg

SEQ ID NO: 76272 - DNA, 874 bp, Homo sapiens
  misc_feature: GYAE6OF02JJSF4.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaggtgtccattgtgaggtgctagttgttggagtcgtgggggaggcttagtacagccgtgggggtccctgagactctccgtgtgcagcctcgtggtacttccgtacctttgacctaaactatcgcctaagtgacgtccgttcggggtcccgaccgtggtccgttaaccggaacgggggtaaacggggtccgtaggggtacgggttcggggtccttacggttaaggttttaacgtttcgggttaggggttaacggttcgggttacggggttcggtacccgtaaccgtaggtttaaacccgttacccggaccgtaacggtaaccggttaacccggggtaaaaccgggggtcccggggtttacccggaacccgttaccgtacccgttaccccggtaaaggaacggtaaccccgttaaacgttaaccccggaaaagggtaaaccccttacgggggttacttaccgggtttaacgttccggaacaacggttaacgtaaccgaaaccggtaaccggtccgtaaacgggaacggaccggtacccgggaacgggtaacccgttaaccgggttaccggttttaaccgttaaccgttgggttaccggaaccgtaacggtaaccctacccggttaggttgggttaccggggttagggttacctaacggttaaccggtttcggtaaccgggttccgtacggggtccgggtaacccggg

SEQ ID NO: 76273 - DNA, 726 bp, Homo sapiens
  misc_feature: GYAE6OF02HQ2JT.5.73.G07.1.454.CMB.1.raw
tcagatcagacacgcacgaccggtgctcgatttagctctacgctcaggggtctgagagaggagcccagccctgggtattttcaggttgttttcatttggtgatcaggactgaacagagagaactcaccatggtaggtttgggctgagctggtcttttttcttggtggtcttaattttaaaaggtgtcctattgtgaggtgctagttgttggagtcggtggggaggtcttagtacagccgtcgggggtccctgagactctcctgtcgcagtcctcgtggtacttcctacctttagactaactatcgccataggacggcgttcgggtcccgccgacggtccgtacggagggggaacgggcgtgggaggtcggtctcgtaggtttagttcggttggtaggttggttggtcgcccgtaacgtacttaaccgtacgtcgtaacgtaaccgttacggggtaaacgggttccggttaccgcctacgtcctaccgagaacgtactaacgtaccaaacggacgtacggttagtctcgtacggactagactacgaactacggtcgaggacgtaccgaccgggtaacggaccgttaccgggtttaaccgttttatacccggttagtacgtacggtaacgtaaccgttccggttaccggtttgggggtgggtttacgggttcgttaaccggttacggttcgggttacccgtacgggtccggggtaccggggtaaccgg

SEQ ID NO: 76274 - DNA, 709 bp, Homo sapiens
  misc_feature: GYAE6OF02JU05O.5.73.G07.1.454.CMB.1.raw
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (294)..(294): a, c, t, g, unknown or other
  misc_feature (294)..(294): n is a, c, g, or t
  modified_base (491)..(491): a, c, t, g, unknown or other
  misc_feature (491)..(491): n is a, c, g, or t
  modified_base (521)..(521): a, c, t, g, unknown or other
  misc_feature (521)..(521): n is a, c, g, or t
tcagatcagacacgcacgaccggtgctcgatttagctctacgctcagggtctgagagaggagcccagccctgggatttcaggtgttttcatttggtgatcaggactgaacagagagaactcaccatggagtttgggctgagcgtggtcttttctgtggctatttaaaggtgtcctattgtgaggtgcagttgtggagtcgtgggggagcttagtacagccgtgggggtcctgagctcnctggtncngctctggtatctacttgactactagtcgcagtgacgcgtagggtcccncgaacggtcctaccgaggggtagggacctgggagttcgggtactcgagtttacgtggtacggtggtggttcgggcgcctacgaattcccggtaagcgtaacgtaaccgttaccgggtaacggggcccgttcgacccgtattaccgcccgaaggtaccgacgtaaacttccgaaagtaaacgtcggtttacacgttanaccgagtacgtaactaacgcgttaacccgngttaaacgaccggtaccggaacggtaccgggtaccggtttaccgtttaaacgttacgaccggttaagacccgaaacgttccgaacccggtttcgtagggttacgggttacggtttccgtaaacttaaccgggttcggttaaccggaacggtttccccggggtacggggtaaccgttaaccccgggggg

SEQ ID NO: 76275 - DNA, 831 bp, Homo sapiens
  misc_feature: GYAE6OF02I0IVE.5.73.G07.1.454.CMB.1.raw
  modified_base (628)..(628): a, c, t, g, unknown or other
  misc_feature (628)..(628): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccagtggtagtttgggctgagcgtggtctttttcgtgtggtcttaagttttaaaggtgtcctattgtgaggtgctagttgttggagtcgtggggagtacgttagtacgagtccggtcgggggtccctgacgtacctcctccgtgtcgcacgtcctcgtgtacttctaccgtttagacctaactgtacgcctagtcggacgtccgtacgggtcccaccgtacggtccgtaccgggaaggggaacgggtcgtagggtacggttacgggtaccttacgtaacggtttaggttacgggttacggttaagggtcgggtttacgggtaccgtacccgtaacgtacgttaaccgtaaccggtaccgtaacgtaccgttaaccgggtaacggggtcccggttacccgaccgtaacgtccccgtaacgaaggtaaccgtaaccttaaacgttacccgaaaagtacccgtacgggttactacgttaccgcggtactaggtaacctaggaaccgngttaccggtacggacggtaccggtaaccgggtaggtaacccggtaaccggtttacgtttacgttacgtacggtaaccggaacgtaacgttacccgttcccgttaggggttacggttaccggggtttaccgggtaacttacccgggttacggttcccgggtaacccggttacgggtttacccggggtaccgggttaaccccggg

SEQ ID NO: 76276 - DNA, 574 bp, Homo sapiens
  misc_feature: GYAE6OF02GMCVS.5.73.G07.1.454.CMB.1.raw
  modified_base (292)..(292): a, c, t, g, unknown or other
  misc_feature (292)..(292): n is a, c, g, or t
  modified_base (438)..(438): a, c, t, g, unknown or other
  misc_feature (438)..(438): n is a, c, g, or t
tcagatcagacacgcacgaccggtgctcgatttagctctacgctcaggggtctgagagaggagcccagccctgggattttcaggtgtttcattggtgatcaggactgaacagagagaactcaccatggagtttgggctgagctggctttttcttgtggctatttaaaaggtgtccattgtgaggtgcagttgttggagtctgggggagcttagtacagcctggggggtccctgagactctcctgtgcagcctctggattcacctttgacaactatgccatgagctgggtccncgaggctccgagggaagggctgggagtgggtctcgagttactcggtggtagtggtggtgcctacgatacgtacgcaagacctaccggtaaagggcccggtttacgcctagtcctaccaggacgacaattccaaagtaaccacggtntatcgagacagatgaacacgcctagacgagccgaaggcaacggtccgtttatacgtgtgacgtaagaccgaccttgtaggtgggttacgggttataccgtagttcgggttacgaccgttcggacggggtaacccgg

SEQ ID NO: 76277 - DNA, 724 bp, Homo sapiens
  misc_feature: GYAE6OF02G1KDB.5.73.G07.1.454.CMB.1.raw
  modified_base (199)..(199): a, c, t, g, unknown or other
  misc_feature (199)..(199): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggtcttaagttttaaaaaggtgttaccatttgtgaggtgntagttgttggagtcgtggggagtctagtacagccgtgggggtccctgagacgtctcgtgtgcagcctctggtacttctacctttgaactaactatcgacctagtacgacgtacgtcgggtaccccgacgtaacggtcctaccggaacggggtaacgggccgtagggaacgggttcgggttacgtaccgttaaggtttacgttcggttaggttaggttggtaggtccgaccgtaacgtagtaacgtacgacgtaacgtaaccgttaaccggtaaacgggtcccgttacgacctacgttaccaccgagaacgtaacgtaacttaaccgaaacgtaacgtaccggtagttactccgttagaccaagtacgtaagaaccgacgaccgtaggacgacggaccgaaggaaccgtacggttacgttaacgttacgtgtacgacgtaaacgtccgtaacccgttagtcgggtgggttacggttacgtaacgttacgtacggttacgtaccgttccggggtcggtaaacccggg

SEQ ID NO: 76278 - DNA, 791 bp, Homo sapiens
  misc_feature: GYAE6OF02I7QI1.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggtcttagtacagccgtgggggtccctgagactctcctgtcgcacgcctctggattcctacctttagacaactatcgccatgacgtcgtcgggtcccgaccgacggtccgtaccggaagggggacggggtcgtagggtagggttcggggttcctacgttacggttttacgtttcgggttagggttagggttgggttaggggttcggtaccgaacgtaacttaaccgtaccggacgtaacgtaaccgttaacccgggttaaaacgggggtcccgggtttacccggaccgtacgtccctaaccgaacggaacgtaaaccgtaaaccttaacccgaaaacgtaaaccgtaccgggttaacgttacttacgtacgacgtaacgtataaccggaaactaccggccgtaaggacgggtaacggaccgggtaacgggaccgtaccgggttttaaccgtttaactttaccggtacggttacggacggaaacgtacccgtaaccggttcggttcgggttaggggtttcggtttacgttaaccggttaccggttgggttaccggaccggtttcgggaccggggtacccgg

SEQ ID NO: 76279 - DNA, 820 bp, Homo sapiens
  misc_feature: GYAE6OF02IIR2I.5.73.G07.1.454.CMB.1.raw
  modified_base (215)..(215): a, c, t, g, unknown or other
  misc_feature (215)..(215): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttaattttaaaaggtgtcctattgtgaggtgcagttgttggagtcgtgggggnggcttagtacagccgtcgggggtcctgagactctccgtgtgcagcctgtggattctacccttagactaactatcgaccatgagctcggggtcccgcccaggcccgtacggaacggggaacggggtcgtaggggaggttcgggtcgtaccgtaggtttaacgtttcgggttacgggttagggttgggttacgggttcgacccgtaacgtacttaaccgtaaccgcgaacgtaccgtacccgggttaaaacgggggtccccggtttaccggaccccgtacttaccgttacccgtaggaaccggaacttaaacttacccgtaaaaacgtaaaccgtaacggggtacgttaacttccggttacgaccgtagaacgttaaggaaccacggtacctacggaaggtaccggaccccgggaagggaacccgtaaccgggttcccggttttaaacttaacccggtaggttcggtaaaccgtaaaccggtacccgtaaccggttacccgttacgggtttacggggggttacgggttttaccggtaacccgtttaacgggttaccggtttacccgggttaaccggttccggggttacggggtaacccccccggggg

SEQ ID NO: 76280 - DNA, 691 bp, Homo sapiens
  misc_feature: GYAE6OF02IA8X7.5.73.G07.1.454.CMB.1.raw
  modified_base (507)..(507): a, c, t, g, unknown or other
  misc_feature (507)..(507): n is a, c, g, or t
tcagatcagacacgcacgaccggtgctcgatttagctctacgctcaggggtctgagagaggagcccagccctgggtattttcaggtgttttcatttggtgatcaggactgaacagagagaactcaccatggtagtttgggctgagtcgtggtcttttcttgtggctaagttttaaaaggtgtcctattgtgaggtgctagttgttggtagtcggtgggggaggcttagtacgaggccggtcggggggtccctgagtactcgtccgtgtgcacgcctcgtggtacttctaacctttgaactaactagtcgactagtagagtccgtcggtcccgccgacggtccgtaccggaggggagggcgtgggcggtggtctgtagtttagttcggtggtaggtggtggtcgacctataactacgtacgacagtaacctacgggtaacgggtccggttacgctacgtcctacgacggtaacaacgtaaacttaaccgaaagtaaccgtacgggttntaacgttcgtcgaacgtaagtacgtacgaacgtacggtccgtaggaacgcgaccggacggtaaccggttaccgttccgtttaatacgttgtagacgaaacgtccgtccgtacggttagggtcgggtttacggtgttaaccggtacggtttcggttaccgtcgggttacgggtcggtaacccggg

SEQ ID NO: 76281 - DNA, 740 bp, Homo sapiens
  misc_feature: GYAE6OF02G3I9K.5.73.G07.1.454.CMB.1.raw
tcagatcagacacgcacgaccggtgctcgatttagctctacgctcagggggtctgagagaggagcccagccctgggattttcaggtgttttcatttggtgatcaggactgaacagagagaactcaccatggagtttgggctgagctggtctttttcttgtggtcttaattttaaaggtgtcctattgtgaggtgctagttgttggagtcgtgggggaggcttagtacagccgtgggggtccctgacgactctcctgtgcacgcctcgtggtacttcctacctttgaacaactagtcgccatgacgcgtcgggtcccgcgcgtccgtccggaggggagggcgtgggaggtggtactcgtagttcgttggtaggtaggtggtcggtcgaccatactacgtacgacgtacgaccgtaccgggtaacgggtccggtccgcctacgtcctacgagtacgaactactaccgtaaagacgtcggttaacgtactgttaccgatacgtaagtccgtaaaacgacggttcccagggaacggtaaccggacccgggtaaaggtaccgtaacccggtttacccggttttaaattaacccgggttagggtaccggtaaccgaaaccggtaccccgttcgtttaccgggttacgggggttacggggttttaagggttccccgttaaaacggtttaccgggttaccgggttcccggtaaccgggttcccggggggtaccgggtaaacccccggg

SEQ ID NO: 76282 - DNA, 780 bp, Homo sapiens
  misc_feature: GYAE6OF02HREAE.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggctttttctgtggctaattttaaaaggtgtaccattgtgaggtgcagttgttggagtcgtggggaggcttagtacgagccgtgggggtccctgagactctctgtgcagtcctcgtggacttctacctttgaactaaactatcgcctaatgacgtcgtaggggttcccgccgacggcctaccggaagggggaaggggcgtagggaggtcgggttcgtacgtaggtttacgttcggtagggtaaggtggttcggtgtaccacgtaacgtacgtacgaccgtaagtaaccgttaccggtaaaaaggggttccccggttacggaccctacgtaccgtaccgtaacggaacgtaactaaacgtttaaccgaaaaaccgtaaccgtaaacggttaacggttaactacgtttacgacgtaacgtaacgttaacgaaaccgaacggtaccgaacgggtaacgacggaacccggaaggtaaccgttaaccgggttaaccgttttaacgttaacgtcgttaagggaccgtaaaacggtaccgtaaacccgtttccgtaggggttcggggttacgggtttaaggttaaccgttaacggttaccgggtttaaccgaaccggtttccggtacggggtaaccccggg

SEQ ID NO: 76283 - DNA, 814 bp, Homo sapiens
  misc_feature: GYAE6OF02FLO1J.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttggtggcttaattttaaaaggtgtcctattgtgaggtgcagttgttggagtcgtgggggagtcttagtacagccgtgggggtccctgacgactctcctgtcgcagcctcgtggattccaccttttgaccaacttatcgccatgacgtcgtacgggtcccgccgacggcctaccggaagggggaacggggtcgtagggagggttcgggttacgttacgtaaggttttacggttcgggttagggtttagggttgggttcggggtcgaccccgtaaaccgtaacgttaaccggttaaccggacgtaaacggttaacccggttaaaccccggggttaaaaaccggggggttcccccgggttttacccggacccgttaacgttaccccttaacccgggaaaggtaaacggtaaacccttaaacgttaaacccgtaaaacggaaacccgtaacggggttacgtacgttcgttacgaccgaagtacgtacgaaactcggacctaggaagcggaccgaaggtaccgtaccggttactttaacgttacgtcgtacggtacgaaacgtaccctaccgtcggttacggggtagggtttcgggttaacgttaaccggttaggtttaccgggttaccggtacggtttcccgggggtaggtaacccccgggg

SEQ ID NO: 76284 - DNA, 780 bp, Homo sapiens
  misc_feature: GYAE6OF02G5S9A.5.73.G07.1.454.CMB.1.raw
  modified_base (658)..(658): a, c, t, g, unknown or other
  misc_feature (658)..(658): n is a, c, g, or t
tcagatcagacacgcacgaccggtgctcgatttagctctacgctcaggggtcctgagagaggagcccagccctgggatttcgaggtgttttcatttggtgatcaggactgaacagagagaactcaccatggagttggctgagctggtctttttcttgtcggtcttaagttttaaaaggtcgtacctattgtgtaaggtgcgtagttggttggtagtcggtgggggagtacgttaggtacacggtccggtacggggggtccctagtacgtaccgttccgtaccgtgtcgaccacggtacccttcgtaggtacttaccgtaccgtttacgaacctaacgtagttaccggacctaagttcggtacgtcgttccgggtacccggaccgtacggtcccgtaccgggaaggggtaacggggtccgtagggtacggttcgggtacttacgtagtttacgttacgggttagggttacggttgggtcggtaccggtaccgtaacgtaacgttacgtaacggactaacggtaaccgttaccgggtaaacgggttcccggtacgtcctacgtaccgtacgaacgtacggaacctaacgttaccgaaaacggtacgtacggttaccgtagtaccgttacgacgtagtacgacgaccgaccgactggaacncggacgaacggaccgtaccgttcgttaactccggtagtacgacgtaccgtaccgtcgtcggtagggtcggttacggttacgtaacgtacgttaggtaccgtcggttcgggtccggtaaccgg

SEQ ID NO: 76285 - DNA, 756 bp, Homo sapiens
  misc_feature: GYAE6OF02HJMYD.5.73.G07.1.454.CMB.1.raw
  modified_base (688)..(688): a, c, t, g, unknown or other
  misc_feature (688)..(688): n is a, c, g, or t
tcagatcagacacgcacgaccggtgctcgatttagctctacgctcgaggggtctgagagaggagcccagccctgggattttcaggtgttttcatttggtgatcaggactgaacagagagaactcaccatggagtttgggctgagctggtcgttttctgtggctatttaaaggtgtcctattggtgaggtgcgagttgttggagtacgtggggagcgttagtacagccgtcgggggtccctggacgactcgttaccgtgtagcagccttcgtggacttcaccgtttgaccgaactattcgacctagtagacgtacggtggggtacccgccgtaaggccttacccggagggggtaacggggtccgtagggtaaggttcgggtcgtacgtaaggtttacgttacgggttacggtaggttagggtacggttggacccttacgaacggtttaccttaccggaccaaggtaccgtacccgggtaaaggggtccccggttacgacccgtactcgtaccgtaagaccgaactaaccgttacgtaaaacggaaacccgtaggttaacgtaattccggtaacgtcgtaaaggattagaaaccgtacgaaccttgggaaccgtcggacccgtaacggacgtaaccgggttaccttttaagttaccgtaggtaccggtagaaaccggtacaacccggttntagggtacggggttaggttccgtaacgtacggttaggttcccgtaacggtcgggttaccggggaccgg

SEQ ID NO: 76286 - DNA, 829 bp, Homo sapiens
  misc_feature: GYAE6OF02JG9QN.5.73.G07.1.454.CMB.1.raw
tcagatcagacacgcacgaccggtgctcgatttagctctacgctcaggggtctgagagaggagcccagccctgggattttcaggttgttttcatttggtgatcaggactagaacagagagaactcaccagtggtagtttgggctgagctggtcttttctgtggtcttaagtttaaaggtgtactattgtgaggtgactaggttgttcggtagtcggtgggggagtcttagtacgaggtccggtcgggggtccctggacgtaccttcgtccgtgtcgacgacgtcctcgtggtacttccgtacctttgaactaactatcgacctagtgacgtcggtcgggtacccgccgtaacggtccgtaccggaaggggtaacgggtcgtagggtacggtcgggtctacgtagtttacgtcggtggttaggtcggtaggtctacgaactacgtacgacgacgtacgtacgtaaccgggtaacggtccgttcgacgtaactccgtaaccgaagtaacgtaccctaaacgttaccgaaacgtaacgtacggttctaaaccgttgacgtaactaacggtaacttaaccgaaccggtaccgccgtaagggaacccggtacccgggaaaccggtaaccgggtaccggttaacccggtttacgttttaaaactaccgggttaacgggaaccggttaaccgtaaaacccgttacccgttaccggttaccgggttttagggggggttacgggtttaacccggggttttataaaaccccgggggttggtttacccgggttaaccccggtacggggttttacccgggggccgggtaaaacccccgggg

SEQ ID NO: 76287 - DNA, 801 bp, Homo sapiens
  misc_feature: GYAE6OF02IAVJT.5.73.G07.1.454.CMB.1.raw
  modified_base (195)..(195): a, c, t, g, unknown or other
  misc_feature (195)..(195): n is a, c, g, or t
  modified_base (293)..(293): a, c, t, g, unknown or other
  misc_feature (293)..(293): n is a, c, g, or t
  modified_base (721)..(721): a, c, t, g, unknown or other
  misc_feature (721)..(721): n is a, c, g, or t
tcagatcagacacgcacgaccggtgctcgatttagctctacgctcaggggtctgagagaggagcccagccctgggattttcaggtgttttcatttggtgatcaggactgaacagagagaactcacatggagtttgggctgagcgtggtcttttcgtggtggcttaattttaaaaggtgtcctattgtgtaggtgntgttgttggagtcgtggggaggcttagtacgagccggtcgggggtccctgagtactctcctgtgcacgcctcgtggtacttctactttgaactaactntcgacctagtggaggccgtggggtccccaccggtaggtcccggtaccgggaaggggggtaacgggccggttaggggtacggttcgggttacctacggttagtttaggttacgggttgggtttaaggttcggggttcgttcggtacccctaagtacctttaaaccgtccgtacggtaacggtaaaccccggtttacccggggttaaaaccgggggtacccggtttccggacccgttaacgttccgtaacccgtacgggaaaaccttaacccggtaaaacttaacccggtaaaacggaacggtaaacccgggtttgttacgttaccggtacgtactagggtaaacttacgaaaccgtacggaacccgtagaaccggacgggtacccggaaaggtacccggtttaaccgggttacctttagtcgttacggnggaacctaacggcctacgttcgtaggggttcggttagtacggtaacgtcggttccggttaggccgttagggccggtacgg

SEQ ID NO: 76288 - DNA, 868 bp, Homo sapiens
  misc_feature: GYAE6OF02G8S7S.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttctgtggcttaattttaaaggtgtcctattgtgaggtgctaggttgttggagtcggtagggggaggtacgttagtacgaggtccggttcggggggtccctgacgtacctccgttccgtaggtcgccgacgtcccttcgtcggtactttccgtacctttagaacctaaacgttagtacgcccaagttacggacggtccggttccggggtacccgcccggacggtacccggtacccgggaagggggggtaacgggggtaccggttagggggtaacggggtttcgggttacccgttaggttaacggttttacggtttccggggtttaggggttaaggggtttggggtcgggttacgcccgtaaacgtaaaccgtttaccgttaaccgaccggtaaacggtaacccgtaaacccggggttaaacggggtcccggttaccgcccgttaactccgtaacccgaaggaccgtaactaaaccgtaccgaaaacgtaaccggtacgggttataacgttcgacggaaccgaagtacgaaagaccacggtctagggaaccgaacggtccggaaacggtaaccgttaccggttaaccgttttagtacgtgtaaccgtaaccgaacgtacccgtaccgttggttacggggttacggggttttaggtaaccgtaccggttacgggtttacggttaccgtaacccgggttcggggaaccggtacccgggg

SEQ ID NO: 76289 - DNA, 761 bp, Homo sapiens
  misc_feature: GYAE6OF02HSF9N.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttattttaaaaggtgtccattgtgaggtgctagttgttggagtcgtgggggaggtcttagtacagccgtcgggggtccctgagactctcctgtgcacgcctcgtggtacttctacctttgaactaactatcgcctatgagtcgtcgggtcccgccgaggccgtccggaaggggaacggggctagggaggttcgggtctacgtagtttacgttcggttaggtagttgggtggtcgcctaacgtactaaccgtacgacaacgtaaccgtacccggtaaaacggggtcccggttaccggacccgtactaccgtacccgaaaggtaacgaaaccgtaacgttaacccgaaaacgtaaccgaaccgggttagttaacctaccgttaggtaaccgaggtaacgtaagaaaccgtacgtaccgacggaacggacggaccgggaacggaaccgtaccggtttaccggtttaaacgttacgttaggtaccggaacgtaaaccggaacccgtacccgttcggtacgggttcggggtttacgggttaacgtaaccggttaaccgggttacggttaccgggtacggttccggggtacgggtaaccccgggg

SEQ ID NO: 76290 - DNA, 973 bp, Homo sapiens
  misc_feature: GYAE6OF02GVBCM.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttgtggctattttaaaaggtgtccattgtgaggtgcagttgttggagtcgtgggggaggcttagtacagccgtgggggtccctgagactctcgtgtgcagcctctggattccaccttttgactaacgttatcgacctagtggacgccgttcggggtacccgccggaacggtcctcccgggaagggggtaacggggggaccgttagggggacggtttcgggggttaccttaccggtaaggttttacgtttccgggggttagggtttacgggtttggggttacggggttccggaccccgaacgtaacctttaacggttacccgaccgtaacgggttaaccctaccccgggggtttaaaacgggggtccccgggtttacccggccctaacgttacccgttaacccgaggaaacggtaaccctaaaacgtttaaccccgaaaaaggaaacccgttaacgggggttacgttaaacccgtttcggtcgtaaccgtaaagggtaaacctaacggtaaaacccgtaccggtaacccggttagggaaccgggaacccgggaaccccgggaacggggtaaacccggttaaccccgggggtttaacccggtttttttaaaaccggttaaaccgggtttggggttaacccgggtaaccggtaaaacccgggtacccgttaaaccccggtttaccgggtttaccggggggttttacgggggggtttacggggttttaacgggtttaaaacccgttacccgggggttttttacccgggtacccggggtttaaccccgggtttaccgggggtacccggggggtaacccccgggg

SEQ ID NO: 76291 - DNA, 802 bp, Homo sapiens
  misc_feature: GYAE6OF02GJ344.5.73.G07.1.454.CMB.1.raw
  modified_base (597)..(597): a, c, t, g, unknown or other
  misc_feature (597)..(597): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttaattttaaaaggtgtccattgtgaggtgcagttgttggagtcgtgggggaggcttagtacagccgtgggggtccctgagactctcctgtgcacgcctctggtattcctacctttgacaactatcgcctatgagtcgtacgggtcccgaccgacggtcctaccggaaggggaacgggggtccgtaggggacgggttgggttcgtacgttaggtttaacgtttcggttgggttaaggttgggttgggtcggtacccaacgtaacgttacgtaaccggtcgaaacgtacccggttaaacccggggtaaacgggggtccccggttttccgacccttacgtacccgtacccgtaaggaacgtaacccgtaaaacttacccgtaaaaagggtaaacccgttaacggttttacgtaccgtcgggtaaccaggtaacgtanaaaccgacggtacccgtagggaacgaacgggacccggaacgggtaaccggtaacccggttccgtttttaaattaccggtgttaacgaaccggtaaacgacccggttacccgtacggttgggttacgggggttagggtttacgtaacgttacgggtccggtttaccggacccggtttcggggacggggtacccgttaacccggggg

SEQ ID NO: 76292 - DNA, 917 bp, Homo sapiens
  misc_feature: GYAE6OF02JN17F.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcttttcttgtggtctattttaaaggtgtcctatgtgaggtgtctagttgttgggtagtcgtggggaggtgttagtacagccgtggggggtcctgagaccttcgtccgtgtcgtcgacgtccgtcgtcggtactttaccgtaccgttttacgaaccgtaaacgttacgttcggacccctatacggacgtaccggtttccggggtaccccgggtaccgtaaccgggtcccggttaccccggtaaagggggggtaaaccgggggaccggtttacggggtaacgggttagggggttcccgttacgggttaacggtttttaacggttaccggggttggggtttaaccgggttggggtttcggggtaccggtacccgtaaccgttaacgttaaaccggttaccggtaccgttaaaccgggtaaccgttaacccggggtaaaacgggggttaccccgggtttaccgaacccggttactccggtaacccggtaggtaaaacccgtaaccgtaactacccgtaaaaacggaaccgtaccggggtacttactaccgtaccgagtaacggtaatacgtaaaccacggtcaacgggtacgaaccggaaccgtacgggaccggttaccgttaccggtttaacttaccggtggttaaccggaaggaaaccgttacccgtaaacccgggttggtttacggggttacgggttaacgggtttacgaacccgttaagggttccggttacccgggttaacggttcccggggtaacggggtaccccgg

SEQ ID NO: 76293 - DNA, 751 bp, Homo sapiens
  misc_feature: GYAE6OF02IKBPK.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtcttttctgtggctaagtttaaaggtgtccattgtgaggtgcagttgttggagtcgtggggagcttagtacgagccgtcgggggtccctgagacgtctcgtgtgcacgtcctcgtggtacttcctaccgtttcgaactaacctagtcgccgtagtaggagtcggtagggtccccgcggacggtccgtaccgggaagggggaacggggtcgtaggggtacggttcgggttcctaacgttacggttttacgttccgggttaagggttagggttacgggttacgggtaccgtaccgtaccgtaacgtttaaccgtacggacgtaacggtaacccgtaacccgggtaaacggggtacccgtttccggaacccgttacgttacccgtaaccgtaacggaaccgtaaccgtaacgttaaccgaaaagtacccggtaacgggtctaacgtcttagaacgtagactagaaccagtctagaacgtacgaccggacgacggaccgtttcgttaatacggtacgacggacaacggacccgtgttacggtggggttaggtagggttaacctaggtacggtttcggtaacgtcgggtaccggtacgggtaacccgg

SEQ ID NO: 76294 - DNA, 657 bp, Homo sapiens
  misc_feature: GYAE6OF02F6Q8J.5.73.G07.1.454.CMB.1.raw
tcagatcagacacgcacgaccggtgctcgatttagctctacgctcgaggggtctgagagaggagcccagccctgggattttcaggtgttttcatttggtgatcaggactgaacagagagaactcaccagtggtagtttgggctgagcgtggtctttttcgttgtggcttaattttaaaaggtgtcctattgtgaggtgtactagtttggttggtagtcggtgggggtagtcttagtacacgtccggttgggggtccctgagctctccgtgtgcagctctgtcttcctacttgaactaactagcgccagtgacggtcgtcgggtccgccgtaggccgtacggagggacgggtcgtgggcgtggtctgtagttagttcggtaggtggtggtggcgactactactactacggcacgtaccgtaccgggtaacgggtcccggttcaccgtactcctacgagacgtaataacgtaccgaaacgaacgtagtgtaactcgtagactagactacgaactgacaggatcggaccggagtaccggtcgtttacgtgttaacgtcggtacacgtaacgtacgtaccgtggttacggggtgggtttggtaacgtaccggtttaacggttccgggttaccgtacgggtccggggtaccggtacccgggg

SEQ ID NO: 76295 - DNA, 643 bp, Homo sapiens
  misc_feature: GYAE6OF02FU3JT.5.73.G07.1.454.CMB.1.raw
  modified_base (214)..(214): a, c, t, g, unknown or other
  misc_feature (214)..(214): n is a, c, g, or t
  modified_base (260)..(260): a, c, t, g, unknown or other
  misc_feature (260)..(260): n is a, c, g, or t
  modified_base (478)..(478): a, c, t, g, unknown or other
  misc_feature (478)..(478): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttatttaaaaggtgtccattgtgagtgctagttgttggagtcgtggggaggnttagtacagccgtgggggtccctgagacctctacctgtgcagcctntggtattcctacctttgacaactatacgccagttgagtcgtcgggtcccgcgtaggctaccggagggacgggcgtaggagtgggtctcgtacgttagttcggtggtaggttggtggtcgcgtacactacgtacgcgtaacgtacgtaccggtaaacgggccggttccgacctactccgtaccgagacgaactaacgtacccgaaacgacgtacggtanacttcgctacgagttacagaacacggcctagaccgaggacccggagaccgtaccggtttactttactaggttacgtcggaacgtaagacccttccgtacgggttggttacgggttcgttaacgtacgttacggttacgtacggtcgtacgggtccgggaacccgg

SEQ ID NO: 76296 - DNA, 834 bp, Homo sapiens
  misc_feature: GYAE6OF02IYXJZ.5.73.G07.1.454.CMB.1.raw
  modified_base (610)..(610): a, c, t, g, unknown or other
  misc_feature (610)..(610): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttggctgagctggtctttttcttgtggtcttaattttaaaaggtgtcctattgtgaggtgctagttgttggagtcggtgggggagtcgttagtacgaggtccgtcggggggtccctaggacgacttccgtccgtgtgcgcgtcctgtcggtacttcctacctttagaacctaacgttatcgacctagtggacggtccggttcgggtccccgaccggaggtcccgtaaccgggagggggaacgggggtcgtagggtacggtttcgggtctcgttaaggtttcgtttcgggtagggttaggtagggttcgggtctacccgtaagtaacgttaccgtacggcctaacggtaccgttaaccgggtaaccggggtcccggttccgaccgtactacccgtaccgaaggaacgtaacctaacgtaaccgtaaacggtaaacgtttaccggtttaatccgtacgtagaacgtaactacggaaccncggtacgtagaacgggtaccggacccgggtaaggtaacccggttcgggttttaaccccgttttaagtttaccgggtaacggtacccgtaaacgggtaacccgtaacccgttccggttaaggggttccgggttttagggggttaacggttaccgtaacccggttacgttttccggggaccggtttacggtccggggttaccggggttaacccccggtaaccgggg

SEQ ID NO: 76297 - DNA, 655 bp, Homo sapiens
  misc_feature: GYAE6OF02F0CVM.5.73.G07.1.454.CMB.1.raw
  modified_base (222)..(222): a, c, t, g, unknown or other
  misc_feature (222)..(222): n is a, c, g, or t
  modified_base (252)..(252): a, c, t, g, unknown or other
  misc_feature (252)..(252): n is a, c, g, or t
  modified_base (300)..(300): a, c, t, g, unknown or other
  misc_feature (300)..(300): n is a, c, g, or t
  modified_base (558)..(558): a, c, t, g, unknown or other
  misc_feature (558)..(558): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttattttaaaggtgtccattgtgaggtgcagttgttggagtctgggggaggcttagtacngccgtgggggtcctgagactctcctgtgcngcctctgattcacctttgacaactatgccatgagctcgggtccgccgnggccgtccgaggggaaggggcgtgggaggttcggggtctcgtagttagtttcggtgggttaggtggtgggtgccctacgacgtaccgtacgcgtacgtaccttacccggtaaacgggtcccggtccgtaccgacgttaccctaccgtagaaccgtaactacgttaacccaacggtaactacggtcgtaacttctagactacgatacgaactacgtcctaggacggtcgaccgtaggacctacggtcctttacttacgngtacggagaacgtaccgtaaccgtcgttaagggtcgggttagggtttcgtaacgtacgggttacggttacgtccggtaccgggtcgggtaaccccgg

SEQ ID NO: 76298 - DNA, 827 bp, Homo sapiens
  misc_feature: GYAE6OF02IH1CP.5.73.G07.1.454.CMB.1.raw
  modified_base (291)..(291): a, c, t, g, unknown or other
  misc_feature (291)..(291): n is a, c, g, or t
  modified_base (730)..(730): a, c, t, g, unknown or other
  misc_feature (730)..(730): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggtaggtttgggctgagcgtggtcttttttcgttggtggtacttaagtttttaaaaaggtgttacctagttgtggaggtgacgtaggtttaggttggtagttcggtgggggaggtcgttagacgagccggtgggggtccctggtagactccttccgtgtcgcncgcctcgttcggtacttcctactttagaactaactacgtcgacctagtaggtacggtacggttcgggtacccgaccgtacgggtccgtaccggggaacgggggtaagggggtcgttaggggtagggttacgggttcgtacggttaacggttttggtttacgggtagggttacgggttgggttacgggtaccgtaaccgaacgtaaccgttaaccggacggacgtaaccggtaaccgggtttaaacccgggttaaaccggggttcccgggtttaccgacccgttacgttaccctaacccggaaggtaaccgtaaaccgtaacctaaccggtaaaacggaacccggttaacgggtacgttacgtacggttacgacgtaaaggtacgaataccacggtacgtaggacgacggaccgtaaggacgtaccgtttacgttacgtntacgggtagaccgtaagtccgtacggtcggttaggttacggggtgttaacgtaccgttcggttacggtaccggtacggttcgggtaccggaacccgg

SEQ ID NO: 76299 - DNA, 679 bp, Homo sapiens
  misc_feature: GYAE6OF02FVHB9.5.73.G07.1.454.CMB.1.raw
  modified_base (262)..(262): a, c, t, g, unknown or other
  misc_feature (262)..(262): n is a, c, g, or t
  modified_base (551)..(551): a, c, t, g, unknown or other
  misc_feature (551)..(551): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtctttttcttgtggcttattttaaaggtgtccattgtgaggtgctagttgttggagtcgtggggagtcttagtacagccgtgggggtccctgacgactctcctgtgcacgcctntggacttcgtacctttgaaccaactatcgacctagtgagtcgtcgggtacccgccgacggccgtaccggaggggaacgggcgtagggtaggtcgggttcgtcgtagttttacgttcggtggttaggttggttgggtcgaccgtaacgacgttaccgtacgacgtaacgtaacccgttaccgggttaaacggggtcccggttaccgacccgtagtccctaccgaggactaactaacttacccgaaaagaccgtacggttatacttcgttcgacgtaagtacgtagaaccncggtcgtaggacgacgggccgtaaggaccgtacgttacttttagacgttgacgacgaagccgttacgtgttcgggtggtttggtacttacgtacggttacgtcggacgttacgggtcgggtaacccgg

SEQ ID NO: 76300 - DNA, 779 bp, Homo sapiens
  misc_feature: GYAE6OF02H1SW4.5.73.G07.1.454.CMB.1.raw
  modified_base (552)..(552): a, c, t, g, unknown or other
  misc_feature (552)..(552): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggtagttggctgagctgtcttttcgttgtggtctaattttaaaaggtgtcctattgtgtaggtgctagttgttggagtcgtgggggtagtacgttagtacacggtccgttacggggggtccctaggaggtactcctccgtagtgctacgtccgttacgtggtacttccgtacctttagtaacctaacctatcgtactacgtcggcgtcggtacgggtcccgaccgtacggtccgacggtagggggacggggtcgtaggtggttcggtctacgttaggttcgttaggtggttaggtgggtcggtcggaccgtactactaacgtaccgtaacgacgtaaccggttacccggtaacgggttcccggtacggtaccctacgtttccgaacccgaaggtacccgtaaacgtaaacccgtaacggtaaanaacccggttgggttacgtttaacttcgtaccgtcggtaagtaacgtacgggaacccttacgtcccggtagaccgggtaaccggccgggaaagtaacccggttaccgtttacgtttaacgttacgtggttacgaaccgtaaccgtacgtcccggttaaggtttcgggtaggttttggtacggtacttacgggttcggtaccggtaaccggttcggtcgggtaacccgg

SEQ ID NO: 76301 - DNA, 778 bp, Homo sapiens
  misc_feature: GYAE6OF02GNTHD.5.73.G07.1.454.CMB.1.raw
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (617)..(617): a, c, t, g, unknown or other
  misc_feature (617)..(617): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttctgtgcttaattttaaaggtgtccattgtgaggtgctagttgttggagtcgtgggggagtcttagtacagccggtggggggtccctaggacgactcctccgtggtcncgtacncctcgtggtacttaccgtacctttacgaacctaactactcgtccgagtggacgtccgtcggggtccccgacccgacggccgtaccggaggggtaacggggtcgtgggtaggttcggtcctacgtaggtttacgttcggttcgggttaaggttcggtacggttaccggtaccgtaaccgtacttaaccgtaacggtccgaacggtaacccgggttaaccgggttaaaccggggtccccgggtttacccgacccgttacgttcccgacccgtaaggaacgtaaaccctaaacttaacccgaaacggaaccgtacgggttaccgtaacttccgtacgaactagagtacgaacncgtaccgagacggacgacgacggtacgtaccgttacgttacgtacgtacgacgtacgaacggtacctccggttacggttacgggttcgggttaacgggttacgttaaccgttacgggttccggttaacccggtcggttacccgggtaccggggtaacccgg

SEQ ID NO: 76302 - DNA, 760 bp, Homo sapiens
  misc_feature: GYAE6OF02JD7VM.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctggagctggtctttttctgtggtctattttaaaaggtgtccattgtgaggtgctagttgtgagtcgtggggagcttagtacagccgtgggggtccctgacgtctctcctgtgcagtcctcgtaggtacttccgtaccgtttgaacctaacgtactcgtaccagttcgacggtcggttccgggtcccggccgtaacgggtcccggttaccgggaacggggggtaaacggggcggttcggggtaacgggtttcggggttccttacggtacggttttaacggtttcggttcgggttaggttgggttacggtccgttaccgacgtaacttaccggtacgacgtacgtaaccgtaccggttaaaacggggtcccgtttaccgacctacgtccgtaccgaagtaccgaactaacgttaaccgaaagtaaccgtacggtacgtattcgtacaggtacacgtacgactacggaccgtagaacgacggtacgaaccgtacgtacggtttaacccgtttagttacgtcgtacgtacggaactacggtaccgttggttacgggtcggttagggtttacgtaaccgttagggtttaccggtacggtaccggttaccggggtcggtaacccggg

SEQ ID NO: 76303 - DNA, 768 bp, Homo sapiens
  misc_feature: GYAE6OF02G1U3T.5.73.G07.1.454.CMB.1.raw
  modified_base (389)..(389): a, c, t, g, unknown or other
  misc_feature (389)..(389): n is a, c, g, or t
  modified_base (449)..(449): a, c, t, g, unknown or other
  misc_feature (449)..(449): n is a, c, g, or t
  modified_base (486)..(486): a, c, t, g, unknown or other
  misc_feature (486)..(486): n is a, c, g, or t
tcagatcagacacgcacgaccggtgctcgatttagctctacgctcaggggtctgagagaggagcccagccctgggattttcgaggttgttttcatttggtgatcaggactgaacagagagaactcaccagtggtaggtttggcgtgaggcgtcgttcgttttctggtacgtcttaaagttttaaaaggtcgtactagttgtaggagtgctagttggtggagtcggtgggggagtacgttagtacgaggtccggttcgggggtcctagacgtactctccgtagtgacgcgtcctcggagttacttcctacgttcgaacctaatacgcgactagtcgacgtggtcccgggtcgacctggtccgtaccgggaaggggtacgggcgttagggngtagggtccacgttagtttaggtcgtaggtggtggtggtacacgaatacgtactacgganaccgtaacggtaacggtaaacggtcggtaccgtaccncgtacgtaccgaggtaactaacgtaacgttaacgaaacgaacgttaccggtaagtacgacgtacgtacgaacggtacgtaaacgtacgtaccgaacgtaacggtacgggaacggaaccggtaaccgtaaccggtaaccggttttaacggtttaaagtccggtaacgttaacgaaccggtaaacgcccggttaaacgtcggttaacggggttgggttaccggtttaacggttaaccgttacgggttaccggtttacggcgttaccggggacggtaacccgggg

SEQ ID NO: 76304 - DNA, 643 bp, Homo sapiens
  misc_feature: GYAE6OF02GPRKV.5.73.G07.1.454.CMB.1.raw
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
  modified_base (334)..(334): a, c, t, g, unknown or other
  misc_feature (334)..(334): n is a, c, g, or t
  modified_base (633)..(633): a, c, t, g, unknown or other
  misc_feature (633)..(633): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggctttttcttagtggctattttaaaaggtgtccattgtgaggtgcagttgttggagtcgtggggagcgttagtacagccgtgggggtccctggagactctcctgngcagcctctggnttcactttgacgaactatgccagtgagtcgtggtccgccgtacggcgtccgaggggaacggggcgtagggngtagggtctgtagttattcgtggtagttggtggtcgcctagattacgtacgtcgaacgtaccgtaccggtaaacgggcccggtttaccgccgtactccgtaccgagaacgtactaacgttaccgaaagtaacgacggttacgtacttacgttgacgtaacgacgtaagtaacaagtcccgttagaacggtacggccggaacggaccgttaccggtacctttaacggttacgtagttcggacgtaacgacgtaccgtcgtcggtgggttcgttagtacgacgttggtcggacgttacggnggtaacccgg

SEQ ID NO: 76305 - DNA, 952 bp, Homo sapiens
  misc_feature: GYAE6OF02I8X5O.5.73.G07.1.454.CMB.1.raw
  modified_base (813)..(813): a, c, t, g, unknown or other
  misc_feature (813)..(813): n is a, c, g, or t
tcagatcagacacgcacgaccggtgctcgatttagctctacgctcaggggtctgagagaggagcccagccctgggattttcaggtgttttcatttggtgatcaggactgaaacagagagaactcaccatggagtttgggctgagcgtgtcttttctggtggtacttaattttaaaggtgtcctattgtgaggtgtcgtagttggttggagtcggtgggggtagtcgttaggtacaggtccggtcggggggtccctggaacgtacctcctccgttgtgcgacgtcccgttacgttcggttacgttacctaccgtttacgaaacctaaaccgttacgtccggaccctaagtaccggtaacggttccggttccggggtaccccggcccggtaacggggtccccgtaaccgggggtaacgggggggtaaacgggggtcggttaggggggtaacgggttcggggtttacccgttaggtttaacgggttttaacggtttccgggttaggggtttacggggttaggggtttcggggtacgtaaccccgtaaggtaaccgttaacccggtaaccggaccggtaaacgttaacccgggttaaacccggggttaaaccggggttcccggttacccgacctacgtttacccgaacccggtaaagtaacgtaaaccctaaacgttaacccgaaaaggtaaacccgttcgggtttaactacgttacggtacacggaaagttaacaacggtaaaccgtcggtacgtaggggtaaccgacccggtaccggtaaaccgggtacccgttaccgggttttaacttttaaanaccgggttgggaaaccgtaaccggaaaaccgtcccggttccggtttaggtaccgggggtttaaggggttacgttacctaaccgggttacggttcccgggtaccgaccggggtttacccggggtaccgggaacccggggg

SEQ ID NO: 76306 - DNA, 810 bp, Homo sapiens
  misc_feature: GYAE6OF02FZQ8Z.5.73.G07.1.454.CMB.1.raw
  modified_base (251)..(251): a, c, t, g, unknown or other
  misc_feature (251)..(251): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggctatttaaaaggtgtccattgtgaggtgctagttgttggagtcgtgggggagtcttagtacagccgtgggggtccctgagactctctgtncagcctctggtatctacctttgactaactatcgcctatgacgcgtacggggtcccgaccgagggtcctaccgggaagggggtaaacggggggtcgtaggggtacgggtcggggttacccttacgtaagggttttacgttttccgggtagggtttagggttgggttcggggtcgtaccccgtaataacgtaaccgttaacggcctaaacggtaacccgttaacccggggtaaaccgggggtccggttttcccgaccgtaactttcccgtaacccgaaggtaacgtaaccgtaaactttaacccggaaaagtaaacccgtacgggttataacttccgtcgacgaacgtagaaacgaacaccggtcgttaaggacggtacggacccggtaagggtaacccgtaccgggtttaccgtttaacgtacgttacgggtagaccggtaaacgtacccgtaaccggttcggttacggggttacggggggtttaaggtttaccgttaaacggtaccggttttcgggtaaccggtaccgggttcccggggttacgggggtaacccccggg

SEQ ID NO: 76307 - DNA, 909 bp, Homo sapiens
  misc_feature: GYAE6OF02IT55O.5.73.G07.1.454.CMB.1.raw
  modified_base (119)..(119): a, c, t, g, unknown or other
  misc_feature (119)..(119): n is a, c, g, or t
  modified_base (150)..(150): a, c, t, g, unknown or other
  misc_feature (150)..(150): n is a, c, g, or t
tcagatcagacacgcacgaccggtgctcgatttagctctacgctcgagggtctgagagaggagcccagcccgtgggtattttcgaggttgttttctagtttggtgatcgaggactgaanagagagaactcacagtggtagttggctaggngcgtcggttcgtttttcgtgtggtacctttaaagttttaaaacggtcgttcctagttggtgtagggtcgtcgttaaggttgggttgggtacggttacgggtggggggtacggttacgttaacgtacgtaccgggtccgggttcgggggttcccgtaggtacgtccgttaccgtccgtggtcgaccgtcgtccgttcgtacggttactccgtaccgtttagaacctactaccgtcgtacgtagtacggtacgtccgggtccggttcccgaccggtccggttaccggaaccgggtaaggggtaccggtacgggtagggttaacggttcgggttacgttaccggttaaggtttaccggttggggttaggttaagggttcgggttccgtaccgggcctaaacggtacggttaaccccgtaacgggtaccgtaaccggtaacccgggtttaaacccggggtaacggggttaccccggttcgaaacccgtttacgttaccgaaacccgtaacggtacgtaaaccgtaaaccgtaacgtaaaccggacgtccgtagtacgtagtcgaagtaacgtacgaacgaagccgtacggacgtacggacggacggtaacgtacccggttacgtttaaccggttacgttagggtaccgtaaggaaccgtaaacgtacccggttacgttacggttaccgggttggttaaccgggttaacggtaccttagggtcccggttaccggttagggaccccggttacgggtaaaccccgg

SEQ ID NO: 76308 - DNA, 875 bp, Homo sapiens
  misc_feature: GYAE6OF02GXY9Z.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccagtggagtttgggctgagcgtggtctttttcgttggtggtcttaagttttaaaaggtcgtacctagttgtggtaggtgactagttggttggaggtcggtgggggagtcgttagtacgacggccggtcgggggtccctggacgtccgttccgtccgtggttcgccgtacgtccgttcgtacggtactttccgtaccgtttacgaacctaacgttatccgacgtagtacggtacggtccgggtccggtaccccggccggtaaccgggtcccgtaccgggggtaacgggggtacggggtacggttacgggggtacgggtacgggttcttaccggttagggttttacgtttacggggttggggttacgggttggggttcggtcgtaacccgtaacgtaaccgttaccgtaacggtaccgtaaccggttaaccgggtaacccgggtaaccgggggttccccggttaccgtaacccggttcgtacccgttaaaccggaacggtaaccgtaaaccgttaaaccggttaacccgaaaacggtaaccggttacggttacgttacttccgtagacctaagggaactaacgaccgtacgcgtaggaccgcggaacgggacgtaaccgttccggttaacttcgtacgttagaacggacgtaaaccgtaccgtccggttaggttaggggtcgggtttaacgggttacctaacggtaccggtttcgggtaccggttccgggttacggggcccggtaccggggg

SEQ ID NO: 76309 - DNA, 855 bp, Homo sapiens
  misc_feature: GYAE6OF02HL33O.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagcgtggtctttttcttgtggtcttaatttttaaaaggtgttccattgtgaggtgcgagttgttggagttcgtgggggaggtcttagtacagccgtgggggtccctgagactctctgtcgcacgcctctggacttctacctttgaacaactatcgcctagtgagcgttcgggtcccgccgaggccgtccggaagggggaacggggtcgtaggggacggttgggtctacgttaggtttacgtttcgggttagggttaggttgggttcgggttacgacccgtaactacgttaaccgtacgacgtacggtaaccgttacccggggttaaaacggggtccccgggtttccgccccgtaacgtttcccgacccggtaaacggtaaacggtaaaccctaaaaccgtttaacccgaaaaacggggaaacccgttacggggtttaaacgttacttaccgttcgggtaaaccaagggttaacctaacgggaaaccacggttcccggtaacgggaacgaaccgggtacccggaaaacgggtaacccggttaaccgggtttaccccggtttttaaattaaccgggtcggttacgggaacccgttaaaacgaccccggttaactttccgggttaggggttcggggggtttacggtttaccggtaacgtttaaccgggttcgggtttaaccggggaccggtttaccgggggtcgggtaaccccgggg

SEQ ID NO: 76310 - DNA, 803 bp, Homo sapiens
  misc_feature: GYAE6OF02F52H7.5.73.G07.1.454.CMB.1.raw
tcagatcagacacgcacgaccggtgctcgatttagctctacgctcaggggtctgagagaggagccccagcccctgggattttcaggtgttttcatttggtgatcaggactgaacagagagaactcaccatggaggtttgggctgagctggtctttttcttgtggtcttaattttaaaggtgtcctagttgtgaggtgctagttgttggagtcgtggggagtcttagtacagccgtgggggtccctgacgactctctgtgcagcctctggtattcctactttacgactaacgtatcgtccaagtggacgtaccgttcgggtcccgccgtacggccgtaccggaagggggaacggggcgtagggtacggtcgggttaccgtcgttaacggttttagttcggttagggttaggttcgggttacgggtccgtaccccgtaacgaactttaaccgtaccggtaaccgaacggtaacccgttaacccgggggttaaaccggggtcccggggttttaacccaccgttaacgtcccgttaccgaaaggtaaccgtaaaccttaaccgtttaaccccgaaaaggtaaacccgtaaccgggttagttaaccgttagttaccgtacgaaccgtaagttaaccgaaacgtcggtaccctaggaacggtaccggaccggtaaacggtacccgtacggttaaccgtttaacgttcgtaacggtcgtaccgaaacgtccctacggttacgttcggggtcgggttacggtttacgaacgttaccggttcggttacgccggttacggtccggggtaaccg

SEQ ID NO: 76311 - DNA, 838 bp, Homo sapiens
  misc_feature: GYAE6OF02HV38R.5.73.G07.1.454.CMB.1.raw
tcagatcagacacgcacgaccggtgctcgatttagctctacgctcaggggtctgagagaggagcccagccctgggattttcaggtgtttcatttggtgatcaggactagaacagagagaactcaccagtggtaggttggctgagcgtggtctttttcgttgtggtacttaagttttaaaaggtcgtacctattggtggaggtgacgtagttggttgggtaggttcggtagggggtacggtacgtttaggtaacgtacggtccgggttcggggggtccccttaggacggtaccttccgtccgttcggttacgacgtccgtccgttcgtacggtactttaccgttaccgtttaagaacctaattaacgtcgtaccgtaggtcggtaacggccggttcggggtccccaccggtacggtaccgtaccgggaaggggtaaccgggtcgtacggggtagggttccgggttccttaggttacggttacgttcgggtacgggttagggtggtacgggttcgacgtaacgtacgttacgtaccggtacgtaacgtaaccgtacggtaaaccggggtccggttacgacccgtacttaccgaccgaacggaccgtaaacctaacgtaccgaaaacgtaaccgtacggttctaacgttcgtaacgtaccgaaggtactaacggaaccacgtacgtacgaagacccggttaccgaacggtaccgtaccggtttacgtttaaacgtaacgtcggaaccgtacgtaacgtacccgtaacgtcggtgggttacgggttacgttaccgtaacgtcccgggttcggttaccgcgggttaccgggtcgggaaccggg

SEQ ID NO: 76312 - DNA, 883 bp, Homo sapiens
  misc_feature: GYAE6OF02F7M01.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggcttaattttaaaaggtgtcctattgtgaggtgctagttgttggagtcgtgggggagcttagtacacggccgtggggggtccctggacgaccgtcctccgtgtcgcgacgcctcgtggactttcctacctttgaactaaaccttatcggaccctaagtcgacggtccgttcgggggtccccgaccgacgggtccgtaccggggaaggggggtaaaccgggggtcggttaaggggacggtttacgggggttccttcggttaacggttttcggttaccgggttgggttaaggggtttggggtacgggttccgacccgtaaccgtacggtttaaccccgtaacgaccggtaaaccgggtaacccgttaaccccggggggttaaaaccggggtccccggggttttacccgtacccttaacgttcccgttaacccggaaaggaaccgtaaaccgtaaactttaacccgaaaacgaaacggttaccgggttacgtagttaccgtgtaccgtaagtaaccgtacgaaacgtacgtaccgtaggaacggtaaccgggacccgacgggttaacccgtaccgggtttacttttaaaccggttcgtacggtacggtaaacgaaacgttacccggtaaacccgttcggttcggggttacggggtttggttaccggttaacgttaccggtttccgggttacccggtacgggtttcccgggacggggtaaccccggg

SEQ ID NO: 76313 - DNA, 955 bp, Homo sapiens
  misc_feature: GYAE6OF02IPTBI.5.73.G07.1.454.CMB.1.raw
tcagatcagacacgcacgaccggtgctcgatttagctctacgctcaggggtctgagagaggagcccagccctgggattttcaggtgttttcatttggtgatcaggactgaacagagagaactcaccatggagtttgggctgagctggtctttttcttgtggtctaattttaaaaggtgtcctattgtgaggtgctagttgttggagtcggtgggggacgtcttagtacaggtccgtggggggtccctgacgactctccgtgtcgcacgtcctgtggtacttcctacctttagaacctaactagtcgcctaagtgtacgtcgttcggggtcccgaccgtacggtccgtaccggaagggggaacgggcgttaggggtacggttcgggttaccttacgttaacggtttacgtttacggggttaggggtttaagggtttcggggtttacgggtacggtaaccccgtaacgtaacgttaacccggttaacccggtaccgtaaacgggtaaccccgtttaaaccccgggggttaaaaacgggggttccccccggggttttaccggaccccgttaaccgtttacccgttacccgtaaacggtaaaccggtaaaacccttaaacccgtttaaaccggaaaaccggtaaaccggttaaccgggtttaagttacttaccggtcggtaaaccgtaggtaaacgttaaccggaaaacgtaccggttaaccgtaagggaaccgggtaacgggtaacccgggaacgggtaacccgggttacccgggtttaaacccggtttttaagttaaccggttacggttaaccggaaccggttaaaaccggtaccccgtaaccggtttcgggttacgggggtttacggggttacgggttttaaccgtaacggttaaccgggttttcgggttaacccggttaccggttccggggggttaccggggtaaacccccgggg

SEQ ID NO: 76314 - DNA, 789 bp, Homo sapiens
  misc_feature: GYAE6OF02JNZ2U.5.73.G07.1.454.CMB.1.raw
  modified_base (185)..(185): a, c, t, g, unknown or other
  misc_feature (185)..(185): n is a, c, g, or t
tcagatcagacacgcacgaccggtgctcgatttagctctacgctcaggggtctgagagaggagcccagccctgggattttcaggtgttttcatttggtgatcaggactgaacagagagaactcaccatggagtttcggctgagctggtcctttttctgtggtctaatttaaaggtcgtccattgngaggtgcagttgtgagtgtggggagcttagtacagtccgtgggggtccctgacgctacgtccgtgtacgcacgtcctcgtggacttcctaccgtttgacctaaactactcgccctagtacggacgtaccgtcggggtaccccgtaccgacggttcccgttaccggaaacgggggaacggggtccgttggggaacgggtttcggggtacttcggtaagtttacggtttaccggttagggtaacggtttgggtcgggttacgtaccgaacgtaacgtttaccgtaacgtccgtaaacgtacccggtaccggtaaacgggggtcccgtttacggtaccctacgttccgcccaaaggtacgtaaccgtaaacgttacccgaaacgaaccggtacggtcgttaaacctccgtagtaccccgtagtaactaaggaaactccggtagtacgaaccggtaccgacccgggaagaacccggttacggtttaaccgtttaaagtccgttagggtaacccgaggtaaacgtcccgtaacggtcgtaggggttccggtaggtttaacgacgtttaacgtcgggttacccgtaacggtcggggttaccggaacccgg

SEQ ID NO: 76315 - DNA, 796 bp, Homo sapiens
  misc_feature: GYAE6OF02FTVH0.5.73.G07.1.454.CMB.1.raw
  modified_base (155)..(155): a, c, t, g, unknown or other
  misc_feature (155)..(155): n is a, c, g, or t
  modified_base (167)..(167): a, c, t, g, unknown or other
  misc_feature (167)..(167): n is a, c, g, or t
  modified_base (176)..(176): a, c, t, g, unknown or other
  misc_feature (176)..(176): n is a, c, g, or t
  modified_base (181)..(181): a, c, t, g, unknown or other
  misc_feature (181)..(181): n is a, c, g, or t
  modified_base (188)..(188): a, c, t, g, unknown or other
  misc_feature (188)..(188): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (235)..(235): a, c, t, g, unknown or other
  misc_feature (235)..(235): n is a, c, g, or t
  modified_base (421)..(421): a, c, t, g, unknown or other
  misc_feature (421)..(421): n is a, c, g, or t
tcagatcagacacgcacgaccggtgctcgatttagctctacgctcaggggtctgagagaggagcccagccctgggattttcaggtgttttcatttggtgatcaggactgaacagagagaactcacatggagtttgggctgagcgtgtctttgtgngctatttaaagntcgatgtgngtgcngttgtgngtcgtgggngnttagtacagtccgnggggtcctgagacttctcgtgngtcacgtcgtactggtacttacctaccgtttagactaaccgttacgtcgcttagaggtccgtcggttcggtcccggaaacgtccggttccaccggtaaggggtaacgggtcgtcgggtgggtcggttattccgttaagtttggttcggtaggtggttcggtagtcgacgtacctagtacgtaacgngtaacgaacgttaaccgggtacggtacccgttcccgcgtaccgtaccgtctaacggaacgtaaccgtaacgttaccgaaacgtaccgacggttacgtaaccggtacgttacggagtaacggttaacgtacggtaacgtaccggtaccgttaaccggaccggaaccggtaccgggaaccggtaaaccggtttacccgggtttacccgtttaaacgtttacgttccgggttaacggaaccgtaaacccgggttaccggtaacccggtttccggtttaccgggggtttaccgggttaacgggtttaaccccgggttaggttaaccgggtttacggttacccggtttacgggttacccgggtacgggttaaccccgggg

SEQ ID NO: 76316 - DNA, 609 bp, Homo sapiens
  misc_feature: GYAE6OF01ES8TI.15.33.C11.1.454.CMB.1.raw
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttcgcagtaacaccaagtacaggaatattaacctgtttcccatcgactacgcctttcggcctcgccttaggggtcactcaccctgccccgtattaacgtggacaggacccttggtcctccggcgagcggtctttcacccgtctttatcgttacttatgtcagctattcgctacttctgacttacctcagcatcgccctcacagcacctaccttcacaggtccttaacgacgaaccgtccctaccccgtaacccaaacaaccgactaacgtaacgccgtccgcctcgcccgacacgtcgttcggtgtcctagttcggtttaccgccccgtcttccacttcccttcccgcctatccgtcgacgtctaacgg

SEQ ID NO: 76317 - DNA, 595 bp, Homo sapiens
  misc_feature: GYAE6OF01A6LAR.15.33.C11.1.454.CMB.1.raw
  modified_base (343)..(343): a, c, t, g, unknown or other
  misc_feature (343)..(343): n is a, c, g, or t
  modified_base (378)..(378): a, c, t, g, unknown or other
  misc_feature (378)..(378): n is a, c, g, or t
  modified_base (406)..(406): a, c, t, g, unknown or other
  misc_feature (406)..(406): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgtgacngacctgtctcggcgagcggctttcacccgctttancgttactatgtcagcattcgcactttcngactacctccagcatcgcctcacagccacaccttcacaggcttacacgaaccgcctccccctaaccaacaaccgcaataacgcgtacgcctcgcccgcacgccttcggtgcctagttcgggtttacgtcccccgttttacacttcccgttaccccgcctactccgtacgacgtccgtaacgtaacccgg

SEQ ID NO: 76318 - DNA, 617 bp, Homo sapiens
  misc_feature: GYAE6OF01BZ30T.15.33.C11.1.454.CMB.1.raw
  modified_base (361)..(361): a, c, t, g, unknown or other
  misc_feature (361)..(361): n is a, c, g, or t
  modified_base (382)..(382): a, c, t, g, unknown or other
  misc_feature (382)..(382): n is a, c, g, or t
  modified_base (419)..(419): a, c, t, g, unknown or other
  misc_feature (419)..(419): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggcactcaccctgccccgattaacgtggacaggaacccttggtctccggngagcgggtcttttcacccgtntttatcgttacttatcgtcagcatttcgctactttcngacttaccctccagctatcgcctcacagcactaccttcaacaggacttacacgaaccgtcctaccccctaacccaacaaccgacaactaacgccgtacgctcgcccgcacgccgttcggtgcctagttcggtttaaccgtcccccgttttacacttcccgttccccgacctacttctaggacgtccgttacggtaacg

SEQ ID NO: 76319 - DNA, 577 bp, Homo sapiens
  misc_feature: GYAE6OF01B8ERZ.15.33.C11.1.454.CMB.1.raw
  modified_base (468)..(468): a, c, t, g, unknown or other
  misc_feature (468)..(468): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacaggaatattaacctgttcccatcgactacgcctttcggcctcgccttaggggtcactcaccctgccccgattaacgtgacaggacccttggtcttccggcgagcaggcttttcacccgtcttttatcgtttacttatgtcagcattcgctacttctgaactaccctccagcatcgcctcacagccacaccttcacaggcttacagaccncctacccctacccaacaacgcaatacgcgtcgctcgccgcacgccttcggtcgctacgttcggttaccgccccgttcttccacttcccttcccgcctatctgacgtccg

SEQ ID NO: 76320 - DNA, 587 bp, Homo sapiens
  misc_feature: GYAE6OF01BVVYO.15.33.C11.1.454.CMB.1.raw
  modified_base (358)..(358): a, c, t, g, unknown or other
  misc_feature (358)..(358): n is a, c, g, or t
  modified_base (435)..(435): a, c, t, g, unknown or other
  misc_feature (435)..(435): n is a, c, g, or t
  modified_base (523)..(523): a, c, t, g, unknown or other
  misc_feature (523)..(523): n is a, c, g, or t
tcagtctacgtagccacgaccggtgctcgatttagagtgagctcgttgggtttggggtacgatttgatgttacctgatgcttagaggcttttcctggaagcagggcattttgttgcttcagcaccgtagtgcctcgtcatcacgcctcagccttgatttttccggatttgcctggaaaaccagcctacacgcttaaaccgggacaaccgtcgcccggccaacatacgccttctccgtcccccttgcagtaacaccaagtacaggaatattaacctgtttccatcgactacgcctttcggcctcgcttaggggtcactcaccctgcccgattaacgtggacaggaccttggtctccggnagcaggcttttcaccgtctttatcgttacttatgtcagctagttcgctacttctagactacctcagcatcgctcacngcacaccttcacaggcttacacgaaccgcctacccctaaccaaaccaacgacaactaacgcgtccacctgacccgcacgccgttcggngtcctagttcggtttaccgccccgttcttcctacttcccgtttcccgcctattcgtgcgtaccg

SEQ ID NO: 76321 - DNA, 616 bp, Homo sapiens
  misc_feature: GYAE6OF01A151G.15.33.C11.1.454.CMB.1.raw
  modified_base (390)..(390): a, c, t, g, unknown or other
  misc_feature (390)..(390): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcaccctgcccccgattaacgttggacaggaacccttggtcttccggcgagcgggctttcgacccgcgtttanccgttacttagtgtcagcattcgcacttctgactacctccagcatgcctcacagcacaccttcacaggacttacacgaaccgcctacccctacccgaaccaaccgcaactaacgccgtacgctcgcccgcagtccgttcggtcgcacgttcgggtttaccgtccccgttttcgacttacccgttccccgtacctacgttccttaggacgtccgttaacggtaacgg

SEQ ID NO: 76322 - DNA, 606 bp, Homo sapiens
  misc_feature: GYAE6OF01BOGAI.15.33.C11.1.454.CMB.1.raw
  modified_base (381)..(381): a, c, t, g, unknown or other
  misc_feature (381)..(381): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctccgtcccccttcgcagtaacaccaagtacaggaatattaacctgtttccatcgactacgcctttcggcctcgccttaggggtcactcaccctgccccgattaacgtggacaggaacccttggtcttccggcgagcaggtcttttcacccgtntttatcgttacttatgtcagcattcgctacttctgactacctcagcatcgcctcacacgcaactaccttcacagtccttaacacgaaccgcctacccctaacccaacaaccgacaactaacgccgtacgctacgccgcacgtcgttcggtagcctagttcgggtttaccgcccccggtttcttacccattcccgttcccccgacacttccctaggtacgtacccg

SEQ ID NO: 76323 - DNA, 626 bp, Homo sapiens
  misc_feature: GYAE6OF01CU2RR.15.33.C11.1.454.CMB.1.raw
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgatttttccggatttgcctggaaaaccagcctacacgcttaaaccaggacaaccgtcgcccggccaacatagccttctccgtccccccttcgcagtaacaccaagtacaggaatattaacctgtttcccatcgactacgcctttcggcctcgccttaggggtcgactcaccctgccccgatttaaccgttggacacggacccttggtcttccggcgagcaggtcttttccacccgtctttattcgttacttatgtcagctattcgctactttctgtactaccctccagctatcgtcctcacacgcacctaccttcacgacggtccttacaacgaaccgtccctaccccctaacccaacaaccgacctaataacgtccgtcgccttcggcccgcacgtccgttcgggtcgtacctaggttcggtttacccgcccccgttcttcctacttcccttccccgcctacttccgtgacg

SEQ ID NO: 76324 - DNA, 572 bp, Homo sapiens
  misc_feature: GYAE6OF01B2VAC.15.33.C11.1.454.CMB.1.raw
  modified_base (540)..(540): a, c, t, g, unknown or other
  misc_feature (540)..(540): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcaggcttttcacccgctttatcgttacttatgtcagcattcgcacttctgataccctccagcatgcctcacagccacaccttcacaggcttacagaaccgcctcccctaccaacaacgcataagccgtcgctgcccgcagccttcggtgcagttcggtttacgcccccgttnttccattcccttccccgccatcctgcgtaccg

SEQ ID NO: 76325 - DNA, 651 bp, Homo sapiens
  misc_feature: GYAE6OF01DACYA.15.33.C11.1.454.CMB.1.raw
  modified_base (582)..(582): a, c, t, g, unknown or other
  misc_feature (582)..(582): n is a, c, g, or t
tcagtctacgtagccacgaccggtgctcgatttagagtgagctcgttgggtttggggtacgatttgatgttacctgatgcttagaggtcttttcctggaagcagggctatttgttgcttcagcaccgtagtgcctcgtcatcacgcctcagccttgattttccggatttgcctaggaaaaccagcctacacgcttaaaccgggacaaccgtcgcccggccaacatagccttcctcccgtccccccttgcagtaacacaagtacagaatattaactgttccatcgactacgcctttcgctcgcttagggcactcaccctgcccgtattaacgtgactacggacccttggtctccggcgagcaggtcttttccacccgtctttatccgtttaacttatcgtcagctacttcgctactttcagtactaccctcacgtcatcgcctacacacgaccactacctcacacggtacttaacgacgaaccgtaccctacccctaaccaaacctaaccgacaacgtacgccgtcgaccttcggacccgtacacggtccgttacggtcgtacgtacgtttcgggtttaaccnccccccggtttcttacccgtacctttcccgttacccccgtactaacgtttcctacggtacgttaacccg

SEQ ID NO: 76326 - DNA, 608 bp, Homo sapiens
  misc_feature: GYAE6OF01B7JFH.15.33.C11.1.454.CMB.1.raw
  modified_base (566)..(566): a, c, t, g, unknown or other
  misc_feature (566)..(566): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttccatcgactacgcctttcggcctcgccttaggggtcgactcaccctcgccccgattaacgttggacaggaacccttggtcttccggcgagcgggtcttttcacccgctttatcgttacttatgtcagcattcgcacttctgactacctcagcatcgcctcaccagcacaccttcacaggcttacacgaaccgtcctaccccctaacccaaccaaccgacaactaacgccgtcgcctcggcccgctacgcttccgggtgcctagttcggtttaccgtcccccgttttacncttccccttcccgccctactccttagacgtccgtacggtacg

SEQ ID NO: 76327 - DNA, 596 bp, Homo sapiens
  misc_feature: GYAE6OF01BRZ0E.15.33.C11.1.454.CMB.1.raw
  modified_base (531)..(531): a, c, t, g, unknown or other
  misc_feature (531)..(531): n is a, c, g, or t
  modified_base (547)..(547): a, c, t, g, unknown or other
  misc_feature (547)..(547): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtccccccttcgcagtaacaccaagtacaggaatattaacctgtttccatcgactacgcctttcggcctcgccttaggggtcactcaccctgccccgattaacgtggacaggaacccttggtcttccggcgagcaggtccttttcacccgtctttatccgtttacttatgtcagcattcgctacttctgactaccctccagcatcgcctcacagcacaccttcaccaggtccttaacacgaaccgcctaccccctaacccaacaacgcaatacgcgtcgctcgccgcaggtcttcggncgtagttcggtttacncccccgttcttcccacttcccgttccccgacctatccgtgtacgtaccg

SEQ ID NO: 76328 - DNA, 637 bp, Homo sapiens
  misc_feature: GYAE6OF01BAOOD.15.33.C11.1.454.CMB.1.raw
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggccaacatagccttctccgtccccccttcgcagtaacaccaagtacaggaatattaacctgtttccatcgactacgcctttcggcctcgccttaggggtcactcaccctgccccgattaacgtggacaggaccttggtctccggcgagcggtcttttcacccgtctttatcgttacttatgtcagctattccgctacttctgacttaccctccagcatcgccctcacagccaacctaccttcaacgtacggtccttaacacgaacccgcccttaccccctaacccaacaaccgacaataaacgccgtaccgctcgcccacgacgtccgttcggtcgcgttacgttacgggtttaccctcccccggtttacaccgttcccgttaccccgacctacttacggacgtccttaacggtagtaccgg

SEQ ID NO: 76329 - DNA, 593 bp, Homo sapiens
  misc_feature: GYAE6OF01D65ZC.15.33.C11.1.454.CMB.1.raw
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
  modified_base (499)..(499): a, c, t, g, unknown or other
  misc_feature (499)..(499): n is a, c, g, or t
  modified_base (526)..(526): a, c, t, g, unknown or other
  misc_feature (526)..(526): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttcctcccgtccccccttcgcagtaacaccaagtacaggaatattaacctgttccatcgactacgcctttcggcctcgccttagggtcgactccaccctgccccgattaacgtggacacggaacccttggtctccggcgagcgggtctttcgacccgtctttatcgttacttatgtcagcactttcgctacttctgactacctccagcatcgccctcacagccacctaccttcacacggtctanacgaaccncctcccccacaacacgctaanacgcgtcgctcgcgcacgtcgtcggtnctagttcggtttacctccccgtttcacttcccgttcccgcctactcgtagacgtccgtaacgtacgg

SEQ ID NO: 76330 - DNA, 584 bp, Homo sapiens
  misc_feature: GYAE6OF01CVLW0.15.33.C11.1.454.CMB.1.raw
  modified_base (361)..(361): a, c, t, g, unknown or other
  misc_feature (361)..(361): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
tcagtctacgtagccacgaccggtgctcgatttagagtgagctcgttgggtttggggtacgatttgatgttacctgatgcttagaggcttttcctggaagcagggcattttgttgcttcagcaccgtagtgcctcgtcatcacgcctcagccttgtattttccggatttgcctaggaaaaccagcctacacgacttaaaccgggacaaccgtcgcccggccaacatacgccttcctcccgtccccccttcgcagtaaaccaccaaagtacaggaatattaacctgttccatcgactacgcctttcggctcgcgttaggggcactcacctcgcccgattaacgtgacacgtacctgctcggngagcggtctttcaccgtctttatcgttacttatgtcagcattcgctactctgactacctccagcatcnctcacancacactacacagactacagacgcctaccctaccaacaacgacaataacgacgtcgctcgccgcgacgtcgttcggtcgcgtagtacggttacgcccgccttttttttttccacttccttcccgtccctactctacgtcgcgttaaccg

SEQ ID NO: 76331 - DNA, 603 bp, Homo sapiens
  misc_feature: GYAE6OF01DPRSB.15.33.C11.1.454.CMB.1.raw
  modified_base (181)..(181): a, c, t, g, unknown or other
  misc_feature (181)..(181): n is a, c, g, or t
  modified_base (378)..(378): a, c, t, g, unknown or other
  misc_feature (378)..(378): n is a, c, g, or t
  modified_base (413)..(413): a, c, t, g, unknown or other
  misc_feature (413)..(413): n is a, c, g, or t
  modified_base (466)..(466): a, c, t, g, unknown or other
  misc_feature (466)..(466): n is a, c, g, or t
  modified_base (529)..(529): a, c, t, g, unknown or other
  misc_feature (529)..(529): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccngcctacacgcttaaaccgggacaaccgtcgcccggcaacatagccttctcccgtccccccttgcagtaacacaagtacaggaatattaacctgtttcccatcgactacgcctttcggcctcgccttaggggcactccacctgccccgtattaacgtgacacggacctggtctcggcgagcgggtcttttcacccgtntttatcgttacttatgtcagctattcgctacttcngtactaccctcagcatcgcctcacagcacaccttcacagtactacacgaaccncctacccctaacccaacaaccgcaactaacgccgtaccgctacgcccgacaggtccttcggtnccgtagttcggttacctccccgtttctacgttcccttccccgcctacttccgtagtacggtcctacggtaacgg

SEQ ID NO: 76332 - DNA, 626 bp, Homo sapiens
  misc_feature: GYAE6OF01BBA5W.15.33.C11.1.454.CMB.1.raw
  modified_base (181)..(181): a, c, t, g, unknown or other
  misc_feature (181)..(181): n is a, c, g, or t
  modified_base (387)..(387): a, c, t, g, unknown or other
  misc_feature (387)..(387): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggattttgcctggaaaaccngcctacacgcttaaaccgggacaaccgtcgcccggccaacatacgccttcctcccgtcccccttcgcagtaacaccaagtacaggaatattaacctgtttcccatcgactacgcctttcggcctcgccgttagggtcactcaccctgccccgattacgttggacacggtaccttggtcttccggcgagcgggtctttcgacccgtntttactccgttacttatgtcagctattcgacactttctgactacctccagcatcgccctcacacgaccaaccctaccttacactacggaccttaacgacgaaccgccctacccctaacccaaccgaacgacaacgtaacgccgtccgcgtcgccgtccagtccttcggtgtccgtagttcggttaccgtccccgtttcaccttcccttccccgactacttctagactccgtacgtaacg

SEQ ID NO: 76333 - DNA, 638 bp, Homo sapiens
  misc_feature: GYAE6OF01CWC6L.15.33.C11.1.454.CMB.1.raw
  modified_base (184)..(184): a, c, t, g, unknown or other
  misc_feature (184)..(184): n is a, c, g, or t
  modified_base (281)..(281): a, c, t, g, unknown or other
  misc_feature (281)..(281): n is a, c, g, or t
  modified_base (420)..(420): a, c, t, g, unknown or other
  misc_feature (420)..(420): n is a, c, g, or t
  modified_base (436)..(436): a, c, t, g, unknown or other
  misc_feature (436)..(436): n is a, c, g, or t
  modified_base (450)..(450): a, c, t, g, unknown or other
  misc_feature (450)..(450): n is a, c, g, or t
  modified_base (602)..(602): a, c, t, g, unknown or other
  misc_feature (602)..(602): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgtatttttccggatttcgcctaggaaaaccngcctacacgacttaaaccgggacaaccgtccgcccggccaacatacgccttcctcccgtcccccttcgcagtaacaccaagtacagaatattacctnttccatcgactacgtcctttcgcctcgccgttagggtcactccaccctcgccccgtattaaccggttggacacggtaacccttggtccttccggcgacggtcggtcttttccaccgtctttactcgttacttatcgtcngctattcgctacttcngtactaccctcacnctatcgcctcaaccacgaccacctaccttacaccacggtaccttaacgacgaacccgccctaccccctaaccaaccaaccgctaactaacgcgtccgctcgccacgtcgtccgttcggtctacgtacgttcggtttaccgtccccgtttacncttcccttcccgacctactctagactcgtacgtacg

SEQ ID NO: 76334 - DNA, 641 bp, Homo sapiens
  misc_feature: GYAE6OF01C6E3V.15.33.C11.1.454.CMB.1.raw
  modified_base (380)..(380): a, c, t, g, unknown or other
  misc_feature (380)..(380): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgtattttccggatttgcctaggaaaaccagcctacacgacttaaaccgggacaaccgtcgccggccaacatacgccttctcccgtcccccttcgacagtaacaccaagtacagaatacttaacctcgttccatcgactacgccttcgcctcgtcgttagggtcactccaccctgcccgtattaacgtgactacggaccttggtctcggcagcggtctttcgaccgtntttactcgttacttagtcgtacagctattccgctacttctagtactaccctcacgtctactcgtcctacacacgtctacctacttacacgtagacttaacagaccgtccctacccctaaccaacaaccgacaacgtaacgccgtacgtctcgccgcgtacgtcgttacggtgtccgttaaggttccggtttaccgtaccccgtttacgccctttacccttaccccggactacgttacctagtacgtccgttaacgtaccgg

SEQ ID NO: 76335 - DNA, 605 bp, Homo sapiens
  misc_feature: GYAE6OF01BBOQS.15.33.C11.1.454.CMB.1.raw
  modified_base (181)..(181): a, c, t, g, unknown or other
  misc_feature (181)..(181): n is a, c, g, or t
  modified_base (341)..(341): a, c, t, g, unknown or other
  misc_feature (341)..(341): n is a, c, g, or t
  modified_base (352)..(353): a, c, t, g, unknown or other
  misc_feature (352)..(353): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (376)..(377): a, c, t, g, unknown or other
  misc_feature (376)..(377): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
  modified_base (463)..(463): a, c, t, g, unknown or other
  misc_feature (463)..(463): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccngcctacacgacttaaaccgggacaaccgtcgcccggacaacatacgccttcctcccgtcccccttcgcaacgtaacaccaagtacaggaatacttaacctgtttaccatcgactacgccttcgcctcgcttagggtcactcacctgccctatacgtgacngacctgctcgnncngtcttcacgtnttatctactnntcancnttcgctactctcgactacctcagctactcgcctacacgacnccaactacccttnaccgagtaccttaacgacggtaaccnccctaccccctaactaaaccaacgtccaaagttacgaccgttccgaccgtcgacccgacgtcgtccgtcggtcgtaacgtcgttacgggtttaccccccgttacttctacttcccttacccgctagttcgtacgcgttaccg

SEQ ID NO: 76336 - DNA, 716 bp, Homo sapiens
  misc_feature: GYAE6OF01DTQNI.15.33.C11.1.454.CMB.1.raw
  modified_base (190)..(190): a, c, t, g, unknown or other
  misc_feature (190)..(190): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
  modified_base (457)..(457): a, c, t, g, unknown or other
  misc_feature (457)..(457): n is a, c, g, or t
tcagtctacgtagccacgaccggtgctcgatttagagtgagctcgttgggtttggggtacgatttgatgttacctgatgcttagaggtcttttcctggaagcagggctattttgttgcttcagccaccgtagtcgcctcgtcatcacgcctcacgtccttgtacttttccggatttgcctaggaaaaccncgcctacacgacttaaaccgggacaaccgtccgcccggccaaacatacgcccttcctccccgtcccccttcgacagtaaccaccaagtacagtaactattaacctcgtttaccatcgactacgcctttcggcctcgccgttagggtcactccacctcgccccgtattacgtgacgtacgtaccttggtctccggngnggtcggtcttcnccgtctttntcgttatntntngctagtcnctacttcngtactacctcagtctacgtcncctacacgacactaccctaccttcgaccgacggttacctaacgtaacccgacccgtacccctaacccccccgtaaaccaaacccgaaaccgtacgtaaacgtacggtacccggtacccgtaccgccggtacccgtcggcgttacccggtttcgggtactcgtttaacgggtttcccgggttttaacccgtcccccgtttttactacccttccccgtttaccccgaccttcggttactcggtaactccgtaaggtaacgg

SEQ ID NO: 76337 - DNA, 857 bp, Homo sapiens
  misc_feature: GYAE6OF01AFSZH.15.33.C11.1.454.CMB.1.raw
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagtccttgtattttccggatttgcctaggaaaccacgcctacaacgacgttaaaccgggacaaccgtccgcccgaccaacactacgccttcctcccgtccccccttcgacacgtaaccaccgaagtacgaacggtaattaactttaacctcgttttaccccacttaccgtaccgttaccgtcccgttttaccggcccgttccggtccgtttacgggggtcctaccgtacctaaccccgtccggtaccccgtaacgtttaacggtttacggaaccgaacgggtaacccgttttcgggtacccgtttcccgggccggtacgggtcccggggttccttttaccgaccccgttacgttttacttccggtttaacttacgtagtcacgtctactttcgctaccttcgtataccgttaaccctacgacgtctacgttccgaccctacacgaacgtacccaccgtacccgttacaccgtaacggtaccttaaaccgaaccggaaaccctcccctaaaccccccgttaaacccaaaccgaaccgtaaccgtaaacgtaacccggtccgttaccgtccgaccggtacccgacgtaccggtccgttcgggtacgttaccgtacggtttacccggtttcccgttacccccggtttactacccgtttcccccgttacccccgactttcgtaccggttacggaccttaacgttcggtaaccgg

SEQ ID NO: 76338 - DNA, 883 bp, Homo sapiens
  misc_feature: GYAE6OF01DUQXR.15.33.C11.1.454.CMB.1.raw
  modified_base (184)..(184): a, c, t, g, unknown or other
  misc_feature (184)..(184): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagtccttgtacttttccggatttgcctaggaaaaccngcctacacgcttaaaccgggcaaccgtcgcccggaccaacatacgtccttcctcccgtcccccttgactacgtaaccaccaagtaccaggtaattaacgttaacctcgtttacccatccgtactaccgtcctttccggcctccggtccgttaggggtccacctccaccctcgaccccgtaattaacggttcggaacgtaccggtaaccccgtttggtcccgtttaccgggcgtacgtaccgtacgggttcctttttacccggaccccgtttacttttacgtaccgtttaacttcgttacgtcacggtcttacgttcgaccttacctttctacgtaccttaccctaccgagtcctacgtcgtaccctaccgaactaccgtacctaaccgtaccctttacgaacgtaacgtaccgtttaacgaaccgtaacccgtacccctaaccccccgttaaaccgaaacccgtaaccgtaccgtaaacgttaacccggtccgggttaccccggtaaccggttcccgggtacccccggtacgttaacccgggttcccgtttccgggtaaaccgtcccggtttaaaccgggtttacccgggttttaaccccggtcccccgttttacccgttccccgttaaccggttcccccccgtttaccccgttacccgttaaccgtttcccgttaaacggtacccggtttaaccccgg

SEQ ID NO: 76339 - DNA, 647 bp, Homo sapiens
  misc_feature: GYAE6OF01AEJUC.15.33.C11.1.454.CMB.1.raw
  modified_base (465)..(465): a, c, t, g, unknown or other
  misc_feature (465)..(465): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaccgggacaaccgtcgcccggccaacatacgccttcctcccgtcccccttcgcagtaacaccaagtacaggaatattaacctgtttccatcgactacgcctttcggcctcgccttaggggtcactcaccctgccccgattaacgtggacaggacccttggtcttccggcgagcaggtcttttcacccgtctttatcgtttacttatcgtcagctattcgctacttctgactacctcagcactcgcctcacacgccacctaccttacacncgtacttaacacgaaccgtccctacccccgaacccaaccaacgcctaacgtaacgccgtccgctcggcccgacgtacgtccgttcgggtcgtaccgtaacggtttcgggtttacccgccccggtttcttaccctacctttcccgttcccccgaccttaacttccgtagtacggttaacccgg

SEQ ID NO: 76340 - DNA, 677 bp, Homo sapiens
  misc_feature: GYAE6OF01BLTR7.15.33.C11.1.454.CMB.1.raw
  modified_base (423)..(423): a, c, t, g, unknown or other
  misc_feature (423)..(423): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttcctccgtccccccttcgcagtaacaccaagtacaggaatattaacctgtttcccatcgactacgcctttcggcctcgccttaggggcgactcaccctgccccgtataacgttggacacggaacccttggtcttccggcgacgcgggtctttcacccgtctttatccgttacttatgtcagcatttcgctacttcngataccctccagctatcgccctcacagcaccaccttcacgacgtaccttaacacgaaccgtccctacccctaaccccaaacctaaaccgcctaacgtaacggaccgtaccgtcgtaccgccgccacggtaccgtttccggtggaccttaaggttccgggtttaaccggttaccccccggttttctaaaccctttcccttcccccggtaccctaacgttacccgttaggtaacgtcccgttaaggttaaaaccgg

SEQ ID NO: 76341 - DNA, 646 bp, Homo sapiens
  misc_feature: GYAE6OF01DYDYH.15.33.C11.1.454.CMB.1.raw
  modified_base (185)..(185): a, c, t, g, unknown or other
  misc_feature (185)..(185): n is a, c, g, or t
  modified_base (373)..(373): a, c, t, g, unknown or other
  misc_feature (373)..(373): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
  modified_base (461)..(461): a, c, t, g, unknown or other
  misc_feature (461)..(461): n is a, c, g, or t
  modified_base (639)..(639): a, c, t, g, unknown or other
  misc_feature (639)..(639): n is a, c, g, or t
tcagtctacgtagccacgaccggtgctcgatttagagtgagctcgttgggtttggggtacgatttgatgttacctgatgcttagaggcttttcctggaagcagggcattttgttgcttcagcaccgtagtcgcctcgtcatcacgcctcagccttgtatttttccggatttgcctaggaaaaccncgctacacgacttaaaccggacaaccgtcgcccgcaacatacgccttcctcccgtcccccttcgcagtaaccaccaagtacaggtaactacttaacctgtttccatcgactacgccttcgcctcgtccgttaggggcactcacctcgaccccgtattaacggtcgactacggtaccttggtctccggngacgcgggtcttcgaccgtagttacgtcgttacttagngtacagctnttcgactcttcgctctacctccgagcctatcgacctcaacncgactaactcctacaagtcgtacgtacaacggacctccctaacccctaaccaacaccgtactaactacggtaccgtcgtaccgtcgaccgcgtcgtacggttccgagttccgtaagtttcggttaccgttacccgttccgtaccgttccctcccgactcgtacgttcggaactccgtntaacggg

SEQ ID NO: 76342 - DNA, 640 bp, Homo sapiens
  misc_feature: GYAE6OF01C56YY.15.33.C11.1.454.CMB.1.raw
  modified_base (277)..(277): a, c, t, g, unknown or other
  misc_feature (277)..(277): n is a, c, g, or t
  modified_base (364)..(364): a, c, t, g, unknown or other
  misc_feature (364)..(364): n is a, c, g, or t
  modified_base (542)..(542): a, c, t, g, unknown or other
  misc_feature (542)..(542): n is a, c, g, or t
tcagtctacgtagccacgaccggtgctcgatttagagtgagctcgttgggtttgggggtacgatttgatgttacctgatgcttagaggcttttcctggaagcagggcatttgttgcttcagcaccgttagtgcctcgtcatccacgcctcacgtccttgacttttccggatttgcctaggaaaaccagcctacacgcttaaaccgggacaaccgtcgcccggcaacatacgccttcctccgtccccctgcagtaacaccagtacagaatattacctnttccatcgactcgccgtttcgcctcgtccgttagggtcactccacctcgaccccgtattaacgtgacacggtaccttggtctccggngcgctacggtctttccaccgtcttttactcgtttattactcgtcacgtctacgttcgcctacgttctagactaccctccgagtcatcgcctacgacacgctacctacttaccacgtacgtcctaaccacgtaccgacccttaccccaaccaaccaacgaacacgtaacgtcggtaccncgtacgcccgagtccgtcgttcggcgtactacggttacggttacccgccctttcttcccgtacttcccgttccccgacttcgtacctcggtcgtaccg

SEQ ID NO: 76343 - DNA, 787 bp, Homo sapiens
  misc_feature: GYAE6OF01B1FY3.15.33.C11.1.454.CMB.1.raw
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggaccaacatacgtcccttcctccccgttccccccttcgacctaacgtaaccaaccctaaagtacaaggtaaattaacttaacctcgtttcccaatccgaacttaccgtcccttttcggccctccggtccgttagggggtcctacctccaacccctcggtcccccgtaatttaaccggtcggaaccgtacgggtaacccctttggggttcctttcccgggcggtacggtccgggttccttttaccgaccccgttacttttatccgtttaacttagtcgtcacgtctacgtttccgacctacttcctagtaacctaccctccacggtcctacgtccgtccctacctaacgacgtaccaaccctacccgttaccaacgtacgtaccttaaccgtaacccgaacccgtacccctaccccctaaaccctaaacccaaccgacaacgtaacgtacccgtccgcctcgccccgctaccggtcgttacggtcgtacgtacgttccggttttaaccgtccccgtttactaccttcccgtaccccgtccttaactcgttacggacctaccgtcggtaaccgg

SEQ ID NO: 76344 - DNA, 944 bp, Homo sapiens
  misc_feature: GYAE6OF01CG0QU.15.33.C11.1.454.CMB.1.raw
tcagtctacgtagccacgaccggtgctcgatttagagtgagctcgttgggtttggggtacgatttgatgttacctgatgcttagaggtcttttcctggaagcagggctatttgttgcttcagccaccgtagtcgcctcgtcatcacgcctcacgtccttgtactttttccggtattttcgaccgtaacggaaaacccacgaccctaacaaccgtaccgttaaaacccgggaccaacccggtccgccccggaccaaacacgtacgtcccttcccgtccccgttccccccttcgacaacgtaaaccaacctaaagtaacaaggtaaacttaacttaacccttcgtttcccaacgtccgtaaccttaccgtcccgtttccggccttaccggtccgtttacggggtcctaacctccgaaccccgttcggtaacccccgtaagtttaaccgggttcggaaccgtaaccggttaaccccgtttgggttcccgttcccggggacgtacggtccgggtttacccttttacccgaccccggtttattttaaccgttcgttttaaccttagtcgtacctacgtcttaacgtttccgaccttaccgtttcgtacgtaaccttaccccgtactacgtaccttaacgtccgtacccttaccaaccgtaccgtaccctaaaccccttacccttaacgaaccgtacggttaacccttaaccgaaaccgtaaccccgtacccccgtaaccccctaaaccccaaacgtaacccgaccttaaacgtaaccggtacccggtaccgtccgtaccggtcccgaccgtcggttccgttccggggtactaccggtttaaccggtttcccgggttttaccccgttaccccgtttacccttcccgttacccccttaccccggtacctaaccgtttccggtaacggtaaccgtccggttaaaccggtacg

SEQ ID NO: 76345 - DNA, 1061 bp, Homo sapiens
  misc_feature: GYAE6OF01CQWBA.15.33.C11.1.454.CMB.1.raw
  modified_base (199)..(199): a, c, t, g, unknown or other
  misc_feature (199)..(199): n is a, c, g, or t
tcagtctacgtagccacgaccggtgctcgatttagagtgagctcgttgggtttgggggtacgatttgatgttacctgatgcttagaggtcttttcctggaagcagggctatttgttgcttcagcctaccgtgtcgcctcgtcatcaccgcctcacgtcctttgtacgtttttccggattttcgccgtaacggaaaaccncgtacctacgaccgacttaaaccggggaccaacccggtccgcccggaccaacagtacgtcccttcctccccgtcccccttgacctaacgtaaacctaccaacgtaacaaggtaacttaacttaacccgtacgtttccccaacgtccgtaaccttaccgttccccgtttccggcccgttaccgggtacccggtttacgggggtacctacccgttacccctaccccccgtccggtaaccccccgttaaaggttttaaccccggggttacggtaaacccgtaaccgggttaacccccggttttcgggtaccccggtttacccgggggacgtaacggtacccggttaacccgggttttaccccgtttttacccccgaaacccccggtttttaccgtttttttaaacggtttaccccggttttttaaacccgttttaaggttaccggtttaacccgaacggtttacccttaaccgttttcccgggtaacctttacctttacccggttaacggttaaaccttccccgttacccgaaacgttacccgtaaccgtttacccgtaccccgtactaaaacccgccgaaaccccgttaaacccttaacccgttaaacccgtaaccgttaaccggttaaccgttacccgaaacccgggtacccctaccccctttaaaccccccctaaccaaaacccgggtaaccctaacgtaacggtaacccgtcccggttccgtaacccgtcgtacccgtaccgttacgtcccggttaccggtataccggttaccgttaccgggttttcccgtccccgtttaaccttccgtttacccgtcccccttacccggacccttattaacccggcgttcgttaaacccg

SEQ ID NO: 76346 - DNA, 780 bp, Homo sapiens
  misc_feature: GYAE6OF01CGZ7A.15.33.C11.1.454.CMB.1.raw
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
tcagtctacgtagccacgaccggtgctcgatttagagtgagctcgttgggtttggggtacgatttgatgttacctgatgcttagaggcttttcctggaagcagggctatttgttgcttcagcaccgtagtgcctcgtcatcaccgcctcacgtccttgtatttttccggattttcgcctaggaaaaccagcctacaccgtaccgttaaaccgggaccaacccggtccgccccggccaaacactacgtccctttcctcccgttccccccttcgcaacgtaaccaccaagtacaggtaatacttaaccttcgtttccatcgactaccgtcctttcggcctcgccgttacgggcactcaccctcgacccgtattacggtcgactacgtaccgttcggtcgttccggcgacgctacggttcctttaccgacccgttacttttagttccgttatttactcgtcagtctacttcgtactacttcctgtaacctcctacngtcgtacncgacccttacaactcgacccgtaactaccttacaaccgtacggtaaccttacgaaccgtaaccccgtacccttacccccctaaacaaacccgaactccgaaacttacgcccggttacgtcccgacgtccccgtacgtaccgggttacctccgggtacgtaccttacggttttaccgggtttacccttcccccgttttaacccgttccgttaaccccgttttaccccccgttacggttaacccctacgttttaccgtacgggttacccggttaaccccgg

SEQ ID NO: 76347 - DNA, 650 bp, Homo sapiens
  misc_feature: GYAE6OF01BYVUS.15.33.C11.1.454.CMB.1.raw
  modified_base (379)..(379): a, c, t, g, unknown or other
  misc_feature (379)..(379): n is a, c, g, or t
  modified_base (413)..(413): a, c, t, g, unknown or other
  misc_feature (413)..(413): n is a, c, g, or t
  modified_base (434)..(434): a, c, t, g, unknown or other
  misc_feature (434)..(434): n is a, c, g, or t
  modified_base (452)..(452): a, c, t, g, unknown or other
  misc_feature (452)..(452): n is a, c, g, or t
  modified_base (543)..(543): a, c, t, g, unknown or other
  misc_feature (543)..(543): n is a, c, g, or t
  modified_base (591)..(591): a, c, t, g, unknown or other
  misc_feature (591)..(591): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgaccttaaaccgggacaaccgtccgcccggccaacatacgccctttcctccccgttccccccttcgacacgtaaaccaccaaagtacaaggtaatattaacctgtttacccatcgactacgcctttcggcctcgccgttagggcactcaccctgcccgtattaacgtgacaggtaccttggtcttccggngagcgggtctttcacccgtctttacgtcttactntgtcagctattcgctacttcngactacctcaagcagtcncctacacacgcaccctactcactaggtcctaagcgaaacctccctacccctaacaaccgaacgctaagtaccgccgtagccctacggcccngacgtccgttacggactacctgtttaccgtttccggtaccccttttcncccgtttcccctacccggtacctacgttcgtacggtacgtacccgtttaccggtaacgg

SEQ ID NO: 76348 - DNA, 665 bp, Homo sapiens
  misc_feature: GYAE6OF01AX8KJ.15.33.C11.1.454.CMB.1.raw
  modified_base (401)..(401): a, c, t, g, unknown or other
  misc_feature (401)..(401): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgatttttccggattttgcctaggaaaaccagcctacacgacttaaaccgggacaaccgtcgcccgcaacatacgccttctcccgtcccccttcgcacgtaacaccaagtacagaatacttaacctcgttccatcgactacgtcctttcggcctcgtccgttagggtcactcaccctcgcccctattaacgtggacacggaccttggtcctcggcgaggcggtctttcgaccgtctttatcgttacttntgtcagctatcgctacttcagtactacctccagctacgtcgcctaccacacgctaccctaccttacgacgtacgtaccttaacgaacgaccctacccttacccccaaccctaaccaaccgactaacgtaaccggtccgtacgtccgtcgcccgacgtacgtaccgttcggtcgtaccgttacgttcggttacccgccccgttcttcccttaccgttcccgttccccgtacctaccgttcgtacggtaccgttaccgtaaaccgg

SEQ ID NO: 76349 - DNA, 956 bp, Homo sapiens
  misc_feature: GYAE6OF01BCE6C.15.33.C11.1.454.CMB.1.raw
tcagtctacgtagccacgaccggtgctcgatttagagtgagctcgttgggtttggggtacgatttgatgttacctgatgcttagaggtcttttcctggaagcagggctatttgttgcttcagccaccgtagtcgcctcgtcatccaccgcctcacgtccttgtactttttcccggtattttcgaccgttaacggaaaaacccacgtaccctaaccgaaccggtacccgtttaaaaacccggggacctaaacccggtcccgacccccggtaccctaaaccgtacttaccggtcccctttcccgttcccccgttacccccccgtttacgacctaaacgttaaacccaacccgtaaaaggtaaccaaggtaaactttaactttaaacccgttcgttttaccccaagttaccgtaaccttaacccggttcccgttttccggccccgttccggttacccggtttaacggggtcccaaccttaccccgtaccccgtcgtaaccccccggttaagtttaaccggttacggaaccgttaaccgggtaacccccgtttcggggttacccgttacccgggaccggtaacgcccggttaacgggttcccttttttacccgacccccgtttacgtttttaacgttccggttttaaactttacgttacggtacctaacgtccgttaacctttcccgtacgttaccgtttccgtaacgtaccttaaccccgtcgaagtccctaacgtccgtaccctacgtaccaacgtcccaaccttccgtacgaaccgtacgtaccttaaccgaccgtaacctaccccgtaccccctaacccaaccgtaacgactaacgtacgtccgtaccgtctacgccgtccgtacgttcgttaccgtcgtacgttacggttccggttaccctccccgttcttcctaccgttaccccttcccgtataccgtcttacggacgttaccg

SEQ ID NO: 76350 - DNA, 621 bp, Homo sapiens
  misc_feature: GYAE6OF01AWKTM.15.33.C11.1.454.CMB.1.raw
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
  modified_base (491)..(491): a, c, t, g, unknown or other
  misc_feature (491)..(491): n is a, c, g, or t
  modified_base (575)..(575): a, c, t, g, unknown or other
  misc_feature (575)..(575): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgctaaaccgggacaaccgtcgcccggccaacatagccttctcccgtcccccttgcagtaacaccaagtacaggaatacttaaacctgtttccccataccgactacgcctttcggcctcgccttaggggtccactcaccctgccccattaacgtggacagaacccttggtcttccggcgngtcgggctttcgacccgtnttttatccgtttacttactgtccagctactttacgcctacttctgtactaccctcacgctatcgccctcaccagcactaccttacactaggtcttacgaagaccncctacccctaccaacaacggctacaacgctcgctcgaccgcagtccgttcggtcgtacgagttcggtttacgaccccgttttcnctttcccttaccccggctcttccgtaggtctaccgtacggtaacgg

SEQ ID NO: 76351 - DNA, 914 bp, Homo sapiens
  misc_feature: GYAE6OF01CQ1CP.15.33.C11.1.454.CMB.1.raw
tcagtctacgtagccacgaccggtgctcgatttagagtgagctcgttgggtttggggtacgatttgatgttacctgatgcttagaggtcttttcctggaagcagggctatttgttgcttcagcaccgtagtcgcctcgtcatcaccgcctcacgtcctttgtactttttccggtattttcgaccctaacggaaaacccacgaccctaaccaccgtaccgttaaaacccggggacctaacccggtcccggccccggtaccaaactactaccgtcccctttcccgttacccccgttccccccccttcggacctaacgttaaacccaacccgtaaaggtaaccaaagggtaaactttaacttttaaacccttccggttttacccctaacttaccgtaacccgttacccggtcccttttcccgggcccgttccggtacccggtttaacgggggtcctacccgttacccgtaacccccgtcggtaaccccccgttaagtttaaccgggttacggaaccgtaccgggttaaccccgtttcgggttacccgttcccgggacggtaacggtcccgttaacgggtttcccctttttacccgacccccggtttacttttaacgttaccggttttaactttacgtcgtactacgtactacgttccgaccttaaccttcgtacgtaccttacccgtacgacgactacgtccgtccctaccaccgtaccgtactaaccctacctaccgtaaccgtacgtacctaacgaaccgaccctaccccgtaaccccctaacccaaacctactaccgtaattaccggccgtcgccgtcgaccgcgtacgtccgtcgtcgtacgttacgttaccggttcccgttcccgttcttaccgtaccgttccctacccgtctacgtcgtcgtacggtaccg

SEQ ID NO: 76352 - DNA, 910 bp, Homo sapiens
  misc_feature: GYAE6OF01CYUKD.15.33.C11.1.454.CMB.1.raw
  modified_base (204)..(204): a, c, t, g, unknown or other
  misc_feature (204)..(204): n is a, c, g, or t
  modified_base (628)..(628): a, c, t, g, unknown or other
  misc_feature (628)..(628): n is a, c, g, or t
tcagtctacgtagccacgaccggtgctcgatttagagtgagctcgttgggtttggggtacgatttgatgttacctgatgcttagaggtccttttccgtggaagcagggctatttgttgcttcagtccaccgttagtcgcctcgtacatccaccgccttcagtccctttgtacgttttccggtatttcgccgtaacggaaaaccncgtcctaccgaccgtaaccgttaaacccgggacctaacccggtcccggccccggaccaaacacgtaccgtccctttcccgtcccccgttccccccgttgacctaacgtaaaccaccgtaagtacgaaggtaaactttaacctttaaccgttccgttttaccccacgttaccgtaacccgttacccgttccccggttttcccggaccccgtttaccggtccccgggttttaacggggccctacccgtccccgtaaccccgtccggtaacccccccggtttaagtttaaaccgggttccggaaaccgtaccgggttaacccctttcgggttaccgttccggggacgtacggttccggttcctttccgacccgttgtttactcgtttacttatcgtaccagtcctacgttccgaccgttacgtttcncgtaaacttcccctcgacgtactactccgtccctacaacgtaccgacctacccgtaccttacgaacgtcgtactaaccgaccgtaccccgtacccctacccctaacccgaacgtacccgtaacgtaaccgtaccggtccgtccgtcgtaccgtcgcgttaccgttccggttaccggtcgtaccgtttccggttaccggttccccgtccccgtttaccgttacccttcccgtttccccgtacccgtccttacgtaccgttaaccgttcgtaaccgttaaccgg

SEQ ID NO: 76353 - DNA, 771 bp, Homo sapiens
  misc_feature: GYAE6OF01A791B.15.33.C11.1.454.CMB.1.raw
  modified_base (524)..(524): a, c, t, g, unknown or other
  misc_feature (524)..(524): n is a, c, g, or t
  modified_base (688)..(688): a, c, t, g, unknown or other
  misc_feature (688)..(688): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtcgcctcgtcatcacgcctcagtccttgtacgttttccgggtattttcgacctacgggaaaaccacgccctaacaccgtaccgttaaaacccgggacaacccggtccgcccggaccaacatacgtccctttccgtccccgttccccccttcgcaacgtaaaccacccaagttaaccaaggaattaacttaacccttcgtttacccctagtaccgtacctaccgtcccgttttccggcccttcgtccgtttacgggggtaccaccgtaccacccctcggtacccccgtaagtttaaccggttacggaacctaacggtaccccgttgggtccttcccggacggtacgggtccgggttcctttaccgacccgttctttatccgttaacttacgtcgtanacgcctagtcccgtcttacttacgtcgaaccttccgtaccaggtcctatccgccctacaccacgcctacctacctacgtaacgtcggtaacctaacgaccgtaccctacccctacccccaaaccgaaccaacctacaagtaccgcgtaccgtcgaccgccgacnccggtactcggagtccgtagttcccggtcctcccgttctcgtacccttcccaccgtacctacctagtcgaccggtctaaccgg

SEQ ID NO: 76354 - DNA, 568 bp, Homo sapiens
  misc_feature: GYAE6OF02H3CBL.15.33.C11.1.454.CMB.1.raw
  modified_base (439)..(439): a, c, t, g, unknown or other
  misc_feature (439)..(439): n is a, c, g, or t
  modified_base (512)..(512): a, c, t, g, unknown or other
  misc_feature (512)..(512): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcaggcttttcacccgtctttatcgttacttatgtcagcattcgcacttctgatacctccagcatgcctcacngcacaccttcacaggcttacagaacgcctcccctaccaacaacgcaataacgcgtcgctgccgcagcttcggngcagttcggtttacgccccgttcttccacttccttcccgcctactctcgagtaccg

SEQ ID NO: 76355 - DNA, 548 bp, Homo sapiens
  misc_feature: GYAE6OF02GRH5S.15.33.C11.1.454.CMB.1.raw
  modified_base (388)..(388): a, c, t, g, unknown or other
  misc_feature (388)..(388): n is a, c, g, or t
  modified_base (506)..(506): a, c, t, g, unknown or other
  misc_feature (506)..(506): n is a, c, g, or t
  modified_base (525)..(525): a, c, t, g, unknown or other
  misc_feature (525)..(525): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcaggcttttcacccgctttancgttacttatgtcagcattcgcacttctgatacctccagcatgcctcacagcacaccttcacagcttacagacgctccctaccaacaacgcataagcgtcgctgccgcagcttcggtncagtggtttacgccccgtnttcatcttcccgcctatctgatc

SEQ ID NO: 76356 - DNA, 555 bp, Homo sapiens
  misc_feature: GYAE6OF02IGIBG.15.33.C11.1.454.CMB.1.raw
  modified_base (511)..(511): a, c, t, g, unknown or other
  misc_feature (511)..(511): n is a, c, g, or t
  modified_base (524)..(524): a, c, t, g, unknown or other
  misc_feature (524)..(524): n is a, c, g, or t
  modified_base (531)..(531): a, c, t, g, unknown or other
  misc_feature (531)..(531): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcaggcttttcacccgctttatcgttacttatgtcagcattcgcacttctgatacctccagcatgcctcacagcacaccttcacaggcttacagaacgcctcccctacccaacaacgcataagcgtcgctgccgcagcttcggngcagtggtttacnccccgtnttcattcttcccgccatctgagtc

SEQ ID NO: 76357 - DNA, 562 bp, Homo sapiens
  misc_feature: GYAE6OF02F7S4G.15.33.C11.1.454.CMB.1.raw
  modified_base (509)..(509): a, c, t, g, unknown or other
  misc_feature (509)..(509): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagacgctcccctaccaacaacgcataagcgtacgctgccgcagccttcggncatggtttacgccccgtttcacttccttcccgctactctcgacgctacgtacg

SEQ ID NO: 76358 - DNA, 568 bp, Homo sapiens
  misc_feature: GYAE6OF02HLULU.15.33.C11.1.454.CMB.1.raw
  modified_base (513)..(513): a, c, t, g, unknown or other
  misc_feature (513)..(513): n is a, c, g, or t
  modified_base (525)..(525): a, c, t, g, unknown or other
  misc_feature (525)..(525): n is a, c, g, or t
  modified_base (535)..(535): a, c, t, g, unknown or other
  misc_feature (535)..(535): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcatttcgcacttctgatacctccagcatgcctcacagcacaccttcacaggcttacagaacgctcccctaccaacaacgcaataacgcgtcgctgccgcagcttacggncatcggtttacnccccgttttnacttccttcccgccatcctgagtcctacgtacg

SEQ ID NO: 76359 - DNA, 569 bp, Homo sapiens
  misc_feature: GYAE6OF02G63RB.15.33.C11.1.454.CMB.1.raw
  modified_base (516)..(516): a, c, t, g, unknown or other
  misc_feature (516)..(516): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgttggacaggaacccttggtcttccggcgagcaggcttttcacccgtctttatcgttacttatgtcagcattcgctacttctgactacctccagcatcgcctcacagcacaccttcacaggcttacagaaccgcctcccctacccaacaacgcaataacgctcgctgccgcacgcttcggncagttcggttacgccccgttcttccattcccttcccgcctatctcgagtaccg

SEQ ID NO: 76360 - DNA, 589 bp, Homo sapiens
  misc_feature: GYAE6OF02IDKT5.15.33.C11.1.454.CMB.1.raw
  modified_base (445)..(445): a, c, t, g, unknown or other
  misc_feature (445)..(445): n is a, c, g, or t
  modified_base (533)..(533): a, c, t, g, unknown or other
  misc_feature (533)..(533): n is a, c, g, or t
  modified_base (549)..(549): a, c, t, g, unknown or other
  misc_feature (549)..(549): n is a, c, g, or t
tcagtctacgtagccacgaccggtgctcgatttagagtgagctcgttgggtttggggtacggatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaaccgtcgcccggccaacatagccttctcccgtccccccttcgcagtaaacaccaaagtacaggaatattaacctgtttcccatcgactacgcctttcggcctcgccttaggggtcgactcaccctgccccgaattaacgttggacacggaacccttggtctccggcgagcaggcttttcacccgctttatcgttacttatgtcagcattcgcacttcgtgatacctccagcaatgccctnacagcaacaccttcgacaggcttaacagaacgcctacccctaccgaaacaacgcaataaagccgtcgcctgcccgactagctttcggnctaagtcgggtttacnccccgttcttccattcccttcccgctactccgtgagtccg

SEQ ID NO: 76361 - DNA, 574 bp, Homo sapiens
  misc_feature: GYAE6OF02HR1YY.15.33.C11.1.454.CMB.1.raw
  modified_base (516)..(516): a, c, t, g, unknown or other
  misc_feature (516)..(516): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcatttcgcacttctgatacctccagcatgcctcacagcacaccttcacaggcttacacgaacgcctcccctacccaacaaccgcataacgcgtcgctcgccgcagcttcggngcagttcggttactccccgtttcacttccttcccgcctactcctgacgtctacgtacg

SEQ ID NO: 76362 - DNA, 564 bp, Homo sapiens
  misc_feature: GYAE6OF02G8G61.15.33.C11.1.454.CMB.1.raw
  modified_base (512)..(512): a, c, t, g, unknown or other
  misc_feature (512)..(512): n is a, c, g, or t
  modified_base (532)..(532): a, c, t, g, unknown or other
  misc_feature (532)..(532): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcaggcttttcacccgctttatcgttacttatgtcagcattcgcacttctgatacctccagcatgcctcacagcacaccttcacacggcttacagaacgcctacccctaccaacaacgcataacgcgtcgctgccgcagcttcggncagtcggttacgccccgttnttccattcctttccgcctatcctgacgtaccg

SEQ ID NO: 76363 - DNA, 574 bp, Homo sapiens
  misc_feature: GYAE6OF02I8Y5R.15.33.C11.1.454.CMB.1.raw
  modified_base (513)..(513): a, c, t, g, unknown or other
  misc_feature (513)..(513): n is a, c, g, or t
  modified_base (527)..(527): a, c, t, g, unknown or other
  misc_feature (527)..(527): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcaggcttttcacccgtctttatcgttacttatgtcagcattcgcacttctgactacctccagcatgcctcacagcacaccttcacaggcttacagaacgcctcccctacccaacaacgcactaagcgtcgctgccgcagcttcggngcagtcggtttacncccccgttcttccacttccttccccgcctacgtcctcggacgtcccg

SEQ ID NO: 76364 - DNA, 583 bp, Homo sapiens
  misc_feature: GYAE6OF02HABOC.15.33.C11.1.454.CMB.1.raw
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgatttttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgtctttatcgttacttatgtcagcatttcgcacttctgactacctcagcatgcctcacagcacaccttcacaggcttacagaaccgcctacccctacccaacaaccgcaataaacgcgtcgctcgccgcacgcttcggtgcattcggtttaacgccccgtttcacttccttccccgcctattcctgacgtcctacgtacg

SEQ ID NO: 76365 - DNA, 576 bp, Homo sapiens
  misc_feature: GYAE6OF02GU8VZ.15.33.C11.1.454.CMB.1.raw
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcaggcttttcacccgtctttatcgttacttatgtcagcattcgcacttctgactacctccagcatcgcctcacagcacaccttcacagcttacagaacgcctccctacccaacaacgcataacgcgtcgctcgccgcacgcttcggtgctacgttcggtttaaccgccccgttcttccacttccttccccgcctactccgtgacgtccg

SEQ ID NO: 76366 - DNA, 571 bp, Homo sapiens
  misc_feature: GYAE6OF02GA4DS.15.33.C11.1.454.CMB.1.raw
  modified_base (440)..(440): a, c, t, g, unknown or other
  misc_feature (440)..(440): n is a, c, g, or t
  modified_base (464)..(464): a, c, t, g, unknown or other
  misc_feature (464)..(464): n is a, c, g, or t
  modified_base (537)..(537): a, c, t, g, unknown or other
  misc_feature (537)..(537): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttagggtcgactcaccctgccccgattaacgttggacaggaacccttggtcttccggcgagcgggcttttcacccgtctttatcgttacttatgtcagcattcgcacttctgataccctccagcatgcctcacngcacaccttcacagcttacagacnctcccctaccaacaacgcataagcgtcgctcgccgcacgccttcggtgctagtcggtttaacgccccgttttnacttccttcccgcctactctgacgtctacgtacg

SEQ ID NO: 76367 - DNA, 588 bp, Homo sapiens
  misc_feature: GYAE6OF02IT3UV.15.33.C11.1.454.CMB.1.raw
  modified_base (449)..(449): a, c, t, g, unknown or other
  misc_feature (449)..(449): n is a, c, g, or t
  modified_base (521)..(521): a, c, t, g, unknown or other
  misc_feature (521)..(521): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttagggtcgactcaccctgccccgattaacgtggacaggaaccttggtcttccggcgagcaggcttttcacccgtctttatcgttacttatgtcagcattcgcacttctgactacctccagcatcgcctcacagcacaccttnactaggcttaacacgaaccgtcctcccctacccaacaacgcaataacgcgtcgctcgccgcagccttcggtncgtagttcggtttaccgccccgttcttcctacttcccgtttcccgcctacgttcctcggacgtaccg

SEQ ID NO: 76368 - DNA, 619 bp, Homo sapiens
  misc_feature: GYAE6OF02F7Z17.15.33.C11.1.454.CMB.1.raw
  modified_base (380)..(380): a, c, t, g, unknown or other
  misc_feature (380)..(380): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggccaacatacgccttctcccgtcccccttcgcagtaacaccaagtacaggaatattaacctgttccatcgactacgcctttcggcctcgccttaggggtcactcaccctgccccgattaacgtggacaggacccttggtctccggcgagcaggctttcacccgtntttatcgttacttatcgtcagcattcgctacttctgtactacctccagcatcgcctcacagccactacccttcacaggtccttaacgacgaaccgccctaccccctaacccaaacaaccgctaactaacgccgtcgcctcgcccgcacgtccgttcggcgtctacggttcgggtttaaccgtcccccgttctttccgactttcccgttaccccgtacctacgtccgtaggacgtacccg

SEQ ID NO: 76369 - DNA, 568 bp, Homo sapiens
  misc_feature: GYAE6OF02J0961.15.33.C11.1.454.CMB.1.raw
  modified_base (384)..(384): a, c, t, g, unknown or other
  misc_feature (384)..(384): n is a, c, g, or t
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
  modified_base (531)..(531): a, c, t, g, unknown or other
  misc_feature (531)..(531): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgtggacaggaacccttggtcttccggcgagcgggcttttcaccgctttancgttactatgtcagcatttcgcacttctgatacctccagcatgcctcacagcacaccttcacagcttacagaaccgctcccctacccaacaccgcataacgcgtacgctgccncagcttacgtncagtcggtttacgccccgtttanacttccttcccgcctacgtctcgacgtcctacgtacg

SEQ ID NO: 76370 - DNA, 649 bp, Homo sapiens
  misc_feature: GYAE6OF02JAOHY.15.33.C11.1.454.CMB.1.raw
  modified_base (542)..(542): a, c, t, g, unknown or other
  misc_feature (542)..(542): n is a, c, g, or t
  modified_base (580)..(580): a, c, t, g, unknown or other
  misc_feature (580)..(580): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcacgtaacaccaagtacaggaatataacctgttccatcgactacgcctttcggcctcgccttagggtcactcaccctgccccgattaacgtggacaggtaacccttggtcttccggcgacgcggctttcaccgtcttatcgttatatgtcagctatttcgctacttctagtactacctccagcatcgcctcacacgcacaccttcaccaggtccttaacgagtaaccgccttaccccgacctaaacaccgtacaactaacgcccgtacgccttccggacccacgtcgaccttcgggtcncgtaacggttacggtttaacccgttcccccggttttanaacccgtttccccgttcccggtaacccctacgttcccgttacgtaccggtacccttaacgggttaaccg

SEQ ID NO: 76371 - DNA, 413 bp, Homo sapiens
  misc_feature: GYAE6OF02GJF5W.15.33.C11.1.454.CMB.1.raw
  modified_base (407)..(413): a, c, t, g, unknown or other
  misc_feature (407)..(413): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcaccctgccccgattaacgttggacaggaacccttggtcttcccgccatctgagctacgtagactgagcgggctggcaaggcgcatagnnnnnnn

SEQ ID NO: 76372 - DNA, 575 bp, Homo sapiens
  misc_feature: GYAE6OF02G7OSK.15.33.C11.1.454.CMB.1.raw
  modified_base (540)..(540): a, c, t, g, unknown or other
  misc_feature (540)..(540): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaaccccttggcttccggcgagcaggcttttcacccgctttatcgttacttatgtcagcattcgcacttctgatacctccagcatcgcctcacagcacaccttcaccaggcttacagaacgcctcccctacccaaccaacgcactaagccgtcgctcgccgcacgcttcggtgcacgttggttacgccccggtntttccattcctttccccggccactcctgagtaccg

SEQ ID NO: 76373 - DNA, 672 bp, Homo sapiens
  misc_feature: GYAE6OF02HOO7B.15.33.C11.1.454.CMB.1.raw
  modified_base (180)..(180): a, c, t, g, unknown or other
  misc_feature (180)..(180): n is a, c, g, or t
  modified_base (362)..(362): a, c, t, g, unknown or other
  misc_feature (362)..(362): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaacatagccttctccgtcccccttgcagtaacacaagtacaggatattaacctgttcccatcgactacgcctttcggcctcgccttaggggtccactcacctgccccgattaacggtggaccaggaaccccttggtcttaccggntagctaggcttttcacccgtntttancgttactatgtcagtcctattcgctacttctgacttacctccagtcagtcgtcctcacacgctaactccttacacgtaggcctttacgacgtaaccgcccttacccctacccaaaccgtaccgaccgtaattaaaccggccgtaccgcgttaccgggcccgtacgtaccggttccgttacgggtccgaccgttacgttacgggtttacccgtcccccgttaagtttccccgaagtttccccgttacccggaccgttaccgtaccgttacggtaacggttacccg

SEQ ID NO: 76374 - DNA, 667 bp, Homo sapiens
  misc_feature: GYAE6OF02I0K22.15.33.C11.1.454.CMB.1.raw
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacaggaatattaacctgttcccatcgactacgcttcggctcgcctagggtcactcacctgccccgattaacgttgacacggaacctggtctccgcgagcgggtcttttcgaccgtctttatcgttactatgtctagcattcgctacttctgactaccgtccagcctaatcgacctcgactagcacctaccttacaactacggaccttaacaacgtaaaccgcctacccccctaacctaaaccaaccgctaaacgtaaacgccgtccgaccttcgacccggacctaacgccgtttaccgggtcgcctaaggtttaccggttttaccggtaaccccctttttcgtaacctttccccgtttacccggaccctaaccgtttccctagggtaccgttaccgtaaccgttaaccgg

SEQ ID NO: 76375 - DNA, 582 bp, Homo sapiens
  misc_feature: GYAE6OF02HWEWC.15.33.C11.1.454.CMB.1.raw
  modified_base (477)..(477): a, c, t, g, unknown or other
  misc_feature (477)..(477): n is a, c, g, or t
  modified_base (493)..(493): a, c, t, g, unknown or other
  misc_feature (493)..(493): n is a, c, g, or t
  modified_base (523)..(523): a, c, t, g, unknown or other
  misc_feature (523)..(523): n is a, c, g, or t
tcagtctacgtagccacgaccggtgctcgattttagagtgagctcgttgggtttggggtacgatttgatgttacctgatgcttagaggcttttcctggaagcagggcatttgttgcttcagcaccgtagtgcctcgtcatcacgcctcagccttgattttccggattttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgacgcaggcttttcacccgtctttatcgtttacttaatcgtcagcattcgctactttctgactacctccagcatcgacctcacacgcacaccttcacagcttacagaccnctcccctaccaacacncatacgctcgctcgccgcacgtcttcggtnactagtcggtttacgccccgttcttccacttccttccccgcctattctacgacgtaccg

SEQ ID NO: 76376 - DNA, 611 bp, Homo sapiens
  misc_feature: GYAE6OF02G4EB7.15.33.C11.1.454.CMB.1.raw
  modified_base (553)..(553): a, c, t, g, unknown or other
  misc_feature (553)..(553): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttcgcagtaacaccaagtacaggaatattaacctgtttcccatcgactacgcctttcggcctcgccttaggggtcactcaccctgccccgattaacgtggacaggaacccttggtcttccggcgagcaggcttttcacccgtctttatcgttacttatgtcagctattcgctacttctgatacctccagcatcgcctcacacgcacctaccttcaaccgtacggtaccttaaccgacgaacccgtcccgttacccccctaaccaaaccaaccgctaactaacgccgtaccgactcgcccgacacgccttcggngctagttcggtttaccgcccgttcttccacttcccttccgcctactctacgactaccg

SEQ ID NO: 76377 - DNA, 595 bp, Homo sapiens
  misc_feature: GYAE6OF02FTBYN.15.33.C11.1.454.CMB.1.raw
  modified_base (384)..(384): a, c, t, g, unknown or other
  misc_feature (384)..(384): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggattttcctggaaaaccagcctacacgcttaaaccgggacaaccgtcgcccggccaacatagccttctcccgtcccccttgcagtaacaccaagtacaggaatattaacctgttcccatcgactacgcctttcggcctcgccttaggggtcactcaccctgccccgtattaacgttggacaggaacccttggtcttccggcgagcgggtcttttcacccgtntttatcgttacttatgtcagtcattcgctacttctgactacctccaagccaatcgcctacacagcacaccttcacacggtcttaacagaaccgcctaccccaaccaacacgcaataacgcgtacgctcgccgtcagtccttcggcgcgtagttcggttacgccccgtcttccacttccttccccgctacttccgtagacgtactacgtacg

SEQ ID NO: 76378 - DNA, 627 bp, Homo sapiens
  misc_feature: GYAE6OF02H61PL.15.33.C11.1.454.CMB.1.raw
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgacgcgggtcttttcacccgtctttactcgttacttatcgtcagcatttcgctacttctgactacctccagcatcgccctcacagcactaccttcacgagcttacacgaaccgcctacccctaacccaaccaacgactaactaacgccgtaccgcctacgccgtcacggtccgttcggtctaccgtagttcgggtttaccgcccccgtctttccgtacttcccgtttaccccgcctacttccgtacggacgtaccgttaaccgg

SEQ ID NO: 76379 - DNA, 658 bp, Homo sapiens
  misc_feature: GYAE6OF02JUO3W.15.33.C11.1.454.CMB.1.raw
  modified_base (310)..(310): a, c, t, g, unknown or other
  misc_feature (310)..(310): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgtacttttccggattttcgcctaggaaaaaccagcctaacacgacgttaaaccgggacaaccgtcgcccggcaaacatacgccttctcccgtcccccttcgcagtaacaccaagtacaggaatattaacctgttccatcgactacgccttcggctcnccgttagggtcactcacctgcccgtattaacgtggaccaggtaccttggtccttccggcgagtcggtcttttccgaccgttctttactcgttaactatcgtacagtctattcgctacgttctagactacctcagcatcgtcctacacacgcaccgtacctacactacggtactacgacgtaccgtaccctacccctaacccaaccgaccactaacgtaacgccgtacgccgtcgaccgacgtacgtccgttaggtcgtacgtacgttacggtttacccgtacccgtttacctaccgttcccgttacccgtccgtaacgttcccgtacggtaacgtaccgtacgttacg

SEQ ID NO: 76380 - DNA, 645 bp, Homo sapiens
  misc_feature: GYAE6OF02GW8GU.15.33.C11.1.454.CMB.1.raw
  modified_base (181)..(181): a, c, t, g, unknown or other
  misc_feature (181)..(181): n is a, c, g, or t
  modified_base (383)..(383): a, c, t, g, unknown or other
  misc_feature (383)..(383): n is a, c, g, or t
  modified_base (418)..(418): a, c, t, g, unknown or other
  misc_feature (418)..(418): n is a, c, g, or t
  modified_base (554)..(554): a, c, t, g, unknown or other
  misc_feature (554)..(554): n is a, c, g, or t
tcagtctacgtagccacgaccggtgctcgatttagagtgagctcgttgggtttgggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaacatagccttctcccgtccccccttgcagtaacaccaagtacaggaatattaacctgttcccatcgactacgcctttcggcctcgccttaggggtcactcaccctgccccgattaacgtggacacggaccttggtcttccggcgagcgggtcttttcacccgtntttactcgttacttatgtcagcattcgctacttcngtactaccctccagccatcgaccctcacagccacctacccttcacgtacggtaccttaacgacgtaacccgccctaccccctaacccaaaccaaccgccaagtaacgccggtccgcgtcgccgcacgtcgttcggnaccgtagttccggtttaccgtccccgtttactacccgttcccgtttaccccgacccttacgttccttaggtaccgtaccgtaccgtaacgg

SEQ ID NO: 76381 - DNA, 587 bp, Homo sapiens
  misc_feature: GYAE6OF02HF7RK.15.33.C11.1.454.CMB.1.raw
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacaggaatattaacctgtttcccatcgactacgcctttcggcctcgccttaggggtcactcaccctgccccgattaacgtggacaggaacccttggtcttccggcgagcgggtcttttcacccgtctttatcgttacttatcgtcagcatttcgctacttctgactacctccagcatcgcctcacagcacaccttcacacggcttacagaccgctcccctacccaacaacgcaactaacgccgtcgctcgccgacacgcttccggtgctacgttggtttcgccccgttttcacttcccgttcccgcctactcctagacgtctacgttacg

SEQ ID NO: 76382 - DNA, 684 bp, Homo sapiens
  misc_feature: GYAE6OF02FKUHV.15.33.C11.1.454.CMB.1.raw
  modified_base (391)..(391): a, c, t, g, unknown or other
  misc_feature (391)..(391): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgatttttccggattttgcctaggaaaaccagcctacacgcttaaaccgggacaaccgtcgcccggccaacatagccttcctccgtcccccttccgcagtaacaccaacgtacaggaatacttaacctgtttcccactcgactaccgtcctttccggtcctcgccgttaggggtcgactccaccctcgccccgattaacgttggacaggaacccttggtctccggcgagcggtctttcnccgtctttatcgttacttatgtcagctattcgctacttctacgtacttacctcctacgctataccgtccctacacagaccctaaccgtaccctttaccgacgtaacggtcctttaaaccgaccggtaacccgtccctttacccccgaacccctaaacgaaccgaactaactaaaccggtcgtccgacctcggacccgacgacgttaccgttacggtcgtactaggtttaccggtttaaccgtccccgtttactaccgttcccttcccgactactcctagacgtcttacgtacg

SEQ ID NO: 76383 - DNA, 582 bp, Homo sapiens
  misc_feature: GYAE6OF02IEY3O.15.33.C11.1.454.CMB.1.raw
  modified_base (364)..(364): a, c, t, g, unknown or other
  misc_feature (364)..(364): n is a, c, g, or t
  modified_base (470)..(470): a, c, t, g, unknown or other
  misc_feature (470)..(470): n is a, c, g, or t
  modified_base (506)..(506): a, c, t, g, unknown or other
  misc_feature (506)..(506): n is a, c, g, or t
  modified_base (515)..(515): a, c, t, g, unknown or other
  misc_feature (515)..(515): n is a, c, g, or t
  modified_base (525)..(525): a, c, t, g, unknown or other
  misc_feature (525)..(525): n is a, c, g, or t
  modified_base (549)..(549): a, c, t, g, unknown or other
  misc_feature (549)..(549): n is a, c, g, or t
tcagtctacgtagccacgaccggtgctcgatttagagtgagctcgttgggtttgggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgttccatcgactacgcctttcggcctcgccttaggggtcgactcaccctgccccgattaacgtggacaggaacccttggtcttccggcgngcgggtctttcgaccgtctttatcgttacttatgtcagcatttcgctacttctgactaccctccagcatcgcctcacagcacaccttcacaggcttacacgaaccnccctaccccaacccaacaaccgcaactaacgcgtcnctcgccgcngccgttcggngcagttcggtttcgtccccgtttnaccttccttcccgctactctggactctagtacg

SEQ ID NO: 76384 - DNA, 616 bp, Homo sapiens
  misc_feature: GYAE6OF02GO9YF.15.33.C11.1.454.CMB.1.raw
  modified_base (456)..(456): a, c, t, g, unknown or other
  misc_feature (456)..(456): n is a, c, g, or t
  modified_base (489)..(489): a, c, t, g, unknown or other
  misc_feature (489)..(489): n is a, c, g, or t
  modified_base (576)..(576): a, c, t, g, unknown or other
  misc_feature (576)..(576): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgacttaaaccgggacaaccgtcgcccggccaacatagccttctcccgtcccccttcgcacgtaacaccaagtacagaatattaacctgtttcccatcgactacgcctttcggcctcgtccttaggggtcactcaccctcgccccgtattaacgttggacaggaacccttggtccttccggcgaggcgggtcttttccgacccgtctttactcgttacttatcgtcagtctatttcgctacttctagactaccctcagcactcgccctnacagccactacctcacaggtcttacacgtaccnccctaccccaaccaacaaccgcacgtaacgccgtacgcctcgccgtcacgtccgttaccggtgactagttcggttaccgccccgttnttcctacttcccttcccgcttactccgtgactcgtaaccg

SEQ ID NO: 76385 - DNA, 755 bp, Homo sapiens
  misc_feature: GYAE6OF02FM0SV.15.33.C11.1.454.CMB.1.raw
  modified_base (642)..(642): a, c, t, g, unknown or other
  misc_feature (642)..(642): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcactcaccgcctcagccttgtattttccggtatttgcctacggaaaacctacgccctaaccaccgtaccgttaaaacccggggacaaacccggtccgccccggaccaaccatacgccctttcctccccgtccccccttcgaccacgtaaccaaccaagtacaggaattaacttaaccgttcgtttacccagtaccgaccttacgtcccgtttccggccctcgtccgttaggggtccacctccaccctccgcccgtaagttacgtcggacgacggtaccccgttggtccttccgggcacgcgacggttaccttttcccgacccgttcttttactccgtttaactttacgtcgtcacgtctacgttcgacctctttacgcgtaccttacccgacctagacctagttccgccctaccgactaccgacctacctaccttaccacgtacgtaaccttacgaaccgtaacccgtcccctaacccccgtacccaaaccgtacccgtaactaanaaccgtccgtacgtccgtacgcccgtacgtacgtccgtcggtacgtctacggtttcggttcccgtccccttcttccttacgttccttcccggtacctcgtactcggacgtccg

SEQ ID NO: 76386 - DNA, 646 bp, Homo sapiens
  misc_feature: GYAE6OF02IZSV3.15.33.C11.1.454.CMB.1.raw
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttcctcccgtccccccttcgcagtaacaccaagtacaggaatattaacctgtttacccatcgactacgcctttcggcctcgccttaggggtccgactccaccctcgccccgtattaacgtggacaggaacccttggtcttccggcgagcgggtctttccacccgtctttatcgttacttactgtcacgctaacttcgctaccttctgtactacctcctagcattgccctcacagtccacctacctcacgaggtccttaacgacgtaaccgcctaccccctaacccaacctaaaccgcctaacgtaacgccgtccgaccttcgcccactacggtccgttcggtcgactagtttcgggtaacggtcccccgtacttcctacctacccgtttcccgcctaacttcgtacgtccacgttaaccg

SEQ ID NO: 76387 - DNA, 638 bp, Homo sapiens
  misc_feature: GYAE6OF02IPLEF.15.33.C11.1.454.CMB.1.raw
  modified_base (428)..(428): a, c, t, g, unknown or other
  misc_feature (428)..(428): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaacccgtcgcccggccaacatagccttctcccgtccccccttcgcagtaaccaccaagtacaggaatattaacctgttccatcgactacgccttcggcctcgccttagggtcgacctcaccctcgccccgtattaaccgttggaccaggaacccgttcggtcttccggccgagcgaggtcttttcacccgtcttattcgttacttatgtctgcacttcgctacttntcgtactacctcagcatcncctcaacncgacacctcctcacacgtcttacacgaaccgccctacccctacccaacaaccgcaacgtaacgccgtacgctccgcccgaccacgtccgtttcggtcgtacgttacggttccgggttttaccggacccccgtttccttaccttaccgttcccttacccggcctaacctcgtacgtagtacccg

SEQ ID NO: 76388 - DNA, 579 bp, Homo sapiens
  misc_feature: GYAE6OF02GQTXN.15.33.C11.1.454.CMB.1.raw
  modified_base (382)..(382): a, c, t, g, unknown or other
  misc_feature (382)..(382): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (461)..(461): a, c, t, g, unknown or other
  misc_feature (461)..(461): n is a, c, g, or t
tcagtctacgtagccacgaccggtgctcgatttagagtgagctcgttgggtttggggtacgatttgatgttacctgatgcttagaggcttttcctggaagcagggcatttgttgcttcggcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttcccatcgactacgcctttcggcctcgccttaggggcactcaccctgccccgattaacgtggacaggaccctggcttcggcgagcaggcttttcacccgtctttancgttacttatgtcagcatttcgctacttctgactacctccagcatgcctcacngcacnccttcacagcttacacgaacncctacccctaacccaacaacgcaataacgcgtcgctcgccgcagtcttcggtgctagtcggtttacgccccgttcttcctacttccgttccccgcctacttcctcggacgtctaacgg

SEQ ID NO: 76389 - DNA, 627 bp, Homo sapiens
  misc_feature: GYAE6OF02H6LEJ.15.33.C11.1.454.CMB.1.raw
  modified_base (181)..(181): a, c, t, g, unknown or other
  misc_feature (181)..(181): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (401)..(402): a, c, t, g, unknown or other
  misc_feature (401)..(402): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggattttgcctggaaaaccngcctacacgcttaaaccgggacaaccgtcgcccggccaacatagccttcctcccgtccccccttgcagtaacaccaagacaggaattattaacctgtttcccatcgactacgcctttcggcctcgccttaggggtcactcaccctgccccgattacgttggacacggtacccttggtcttccggcgagcgggtcttcgccgccttnttctcttattntcnnctctctcgcttctntactcctccngcncntccncncacncactcctactacagtacgttactacgaacacccgtcccaacccctaacccaaccgaacacctaacgtccgtccgtctacgccgccgtactaccgttcgtcggtctacgttcggttcggttaccccgttccgtaccgtttcctaccccgttcccgtacgtccttacgtacgtaccggtacttaccgg

SEQ ID NO: 76390 - DNA, 629 bp, Homo sapiens
  misc_feature: GYAE6OF02G42WX.15.33.C11.1.454.CMB.1.raw
  modified_base (179)..(179): a, c, t, g, unknown or other
  misc_feature (179)..(179): n is a, c, g, or t
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
  modified_base (469)..(469): a, c, t, g, unknown or other
  misc_feature (469)..(469): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaccngcctacacgcttaaaccgggacaaccgtcgcccggccaacatagccttctcccgtcccccttcgcagtaaccaccaagtacaggaatacttaacctgtttcccatcgactacgtcctttcggcctcgcgttaggggcactcaccctgccccgtataacgtgacacgacctgtctcgngagcggctttcacctnttatcgtacttangtcagtcattcgctacttcgtatactaccctcacgctatcgcctacacacgacacctacttcacacgtacttacacggtaaccncctaccccctaaaccaacaaccgctaaacgtaacgcctccgcgtaccggccctaacgcgttccgttcggaacgcgttaacgtttcggttaacccgttccccgtttacgaacttcccgttccccgtacgtactttccgaccggtatacccggtactaacgg

SEQ ID NO: 76391 - DNA, 700 bp, Homo sapiens
  misc_feature: GYAE6OF02HMBD8.15.33.C11.1.454.CMB.1.raw
  modified_base (387)..(387): a, c, t, g, unknown or other
  misc_feature (387)..(387): n is a, c, g, or t
  modified_base (478)..(478): a, c, t, g, unknown or other
  misc_feature (478)..(478): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgatttttccggatttgcctggaaaaccagcctacacgcttaaaccgggacaaccgtcgcccggcaacatacgccttcctccgtcccccttcgcagtaacacaagtacaggaatattaacctgttccatcactacgcctttcggcctcgccgttaggggtcactcaccctcgccccgatttaacgtggacacggtaacccttggtcttccggcgagcaggtccttttcacccgtntttactcgtttactttatgtacagctacttcgctactttctagacttacctccagctactcgccctacacacgaccctaactaccccttanaaccgtacggacctttaaccgacgaacccgtccctaccccctaaacccaaacaacccgtacctaacgtaaccgtccgtccgtaccgtacgcccggactaacgggtccgtttccggtagcccgttaacgtttcggggttaaccctcccccggtttactttacccgtaccgtttacccgtttcccccggtaaccttaccgttacgtccggaaccgttaacccgg

SEQ ID NO: 76392 - DNA, 782 bp, Homo sapiens
  misc_feature: GYAE6OF02HI8AF.15.33.C11.1.454.CMB.1.raw
  modified_base (557)..(557): a, c, t, g, unknown or other
  misc_feature (557)..(557): n is a, c, g, or t
tcagtctacgtagccacgaccggtgctcgatttagagtgagctcgttgggtttggggtacgatttgatgttacctgatgcttagaggctttttcctggaagcagggctatttgttgcttcagcaccgtagtgcctcgtcatcaccgcctcagtccttgtactttttccggatttcgccgtaggaaaaccagccctaacacgtaccgttaaaccgggaccaaccggtccgcccggccaaacatacgcccttcctccccgttccccccttcgcaacgtaaccaccaaagtacaaggtaattaacttaacctgtttcccatccgactaccgtcctttccggcctccggtccgttaggggccacctccaccctcgaccccgtattacggtggacacggtacccttggtccttccgggcgtaggccgggttcttttaccgacccgttctttacgttacgtttacttacgttcgtactagtcctaatttcccgcttacttgtactacttaccctaccacgtcctactcgtccctacaccgaccgtaccaacccttcccgttanaaccgtacggtcctttaaaccgaccgtaacccgtccccttaacccccaaacctaaaccgaaccgtaaccctaaggtaaccgacccgttcggtacctccgtcccgtaccgtcggttaccgttccgggtacgtccgttacgttttaccgggtttacccgtacccctttggtaccctttcccgttccccgtcctactcccggttacaccgttaccgttacggtaccgg

SEQ ID NO: 76393 - DNA, 861 bp, Homo sapiens
  misc_feature: GYAE6OF02IY6KG.15.33.C11.1.454.CMB.1.raw
tcagtctacgtagccacgaccggtgctcgatttagagtgagctcgttgggtttggggtacgatttgatgttacctgatgcttagaggtcttttcctggaagcagggcatttgttgcttcagcaccgtagtgcctcgtcatcacgcctcagtccttgtacttttccggatttgcctaggaaaaccacgcctacacgtaccttaaaccgggaccaaccggtccgcccggacctaaacacgtacgccctttcctccccggtccccccttgacctaacgtaaaccacccgaaagtaccgaaggtaaacttaacttaaccctgtttaccccagtaccgaccttaccgtccgtttccggcccttccggtaccggtttaacgggggtcctaacctccctaacccgtccggacccccgttaactttaaaccgggttcggaaccgtaccgggtaaaccccgtttgggttacccgttccgggacggtaccgggtccgggttccctttttacccgaccccgtttacttttaccgttaccgtttacctttagccggtcctaacggtccttaacgtttcccgacttacgtttctacgttacctcccgttaccaacggtctacgtccgtaccctacaacgtaccgacctacccttacctacgtaccgacggttacctaacgaaaccggtccctaccctaccccgtaaacctaaaccaccgactaacgtaacgtccgtccgtcgtaccgacccgtcgtaaccggtcccgttacgggtacgaccgtttacggtttacgggtttaaccccgtaccctttagtaacccgtccccgttccggacttaccgtacgtacgaaccggttccgtaacggttcgg

SEQ ID NO: 76394 - DNA, 698 bp, Homo sapiens
  misc_feature: GYAE6OF02IQLV8.15.33.C11.1.454.CMB.1.raw
tcagtctacgtagccacgaccggtgctcgattttagagtgagctcgttgggtttgggggtacggatttgatgttacctgatgcttagaggcttttcctggagcagggcatttgttgcttcagcaccgtagtgcctcgtcatcacgcctcagccttgatttttccggattttgcctaggaaaaccagcctacacgcttaaaccgggacaaccgtcgccggaccaacatagccttctcccgtccccttcgcacgtaacacaagtacagaatataacctgttccatcgactacgctttcgcctcgtccgtagggtcactcaccctcgccccgtattaacgttggacgtacggaaccttcggtcttccggacgagtccaggttacctttccgaccgttctttatcgttacttatgtactagtctattcgacctacttctgaacttaccctacgtacgctactacgtcctaccacgaactccgaaccttacgtaccaacgtaacgtaccgttaacgaaaccgtaacccgtccctaccccgtaaaccccaaaccgtaacccggactaaacgtaacgaccggtaccaccgtacgacccgtactacgtccgtttcgggtactacgtacgttacgggttttacccgtcccgttcttaccgtaccgtttaccttaccccgaccttacgccgttagacccgttaaccgg

SEQ ID NO: 76395 - DNA, 688 bp, Homo sapiens
  misc_feature: GYAE6OF02G7XYS.15.33.C11.1.454.CMB.1.raw
  modified_base (183)..(183): a, c, t, g, unknown or other
  misc_feature (183)..(183): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgatttttccggattttgcctaggaaaaccngcctacacgcttaaaccgggacaaccgtcgcccggcaacatagccttctccgtcccccttgcagtaacaccaagtacaggaatattaacctgttcccatcgactacgctttcgcctcgccttagggcactcaccctgccccgtattaacgttggactcggaaccctttggtcttccggcgacgctacgggtcctttttcaccccgtcttttactcgtttacttactgtcagctattcgctacgttctgactacctccagctatcgtctcacacgccactacctacacgtacggtacttacgaacgtaaccgtcccttacccctaacccgaaccgaacctaccgtaacgttaaacgtccgttccggcccgttacgcccgtacgtaaccgtcgtttaccgggtctaccgttaggtttcccgggtttaccccgtaccccggtttacctttacccgttacgtttccccgttaccccggtaccctacgttccgttacggacgttacccgg

SEQ ID NO: 76396 - DNA, 848 bp, Homo sapiens
  misc_feature: GYAE6OF02JIEQB.15.33.C11.1.454.CMB.1.raw
  modified_base (455)..(455): a, c, t, g, unknown or other
  misc_feature (455)..(455): n is a, c, g, or t
tcagtctacgtagccacgaccggtgctcgatttagagtgagctcgttgggtttggggtacgatttgatgttacctgatgcttagaggctttcctggaagcagggcatttgttgcttcagcaccgtagtgcctcgtcatcacgcctcagccttgacttttccggatttgcctaggaaaccagcctaacacgcttaaaccgggacaaccgtcgccggaccacactacgccttccgtcccgtcccccttcgaccacgtaacaccaagtaccagaactacttaacctagtttccccagtccgtactaccgtccgtttccggcctccgtccttaagggtccgtaactccaacccgtcgtaccccgtagttaaccgttcggaacctacggaaccctttgggtcctttacccggacggtaacggtccgggttacccttttaccgaccccggtacgttttacnccggttttaaccttacgtacgtaccgaggtcctaacgtttccgacctacgttcgtacgtaccttacctaccgacgtctaacgtcgtaacccgtacaacgaaccgctaacctaaccttccgtaacgtaccggtaccttaaccggaactaacccgttacccctaacccccttaaccccgaaaacctaccgtaacccgttaagtaacccggtaccggtccaccgttccgccgtaacccgaacgttccggttaaccgggtttcggaccgttaacggtttacccggtttacccggtttaaccccgttaggttaaccccgttcccggttttaacccccgccgttttaaccgcccgggttaccgtttaaaccggtcccgtttaaacccgggttaaccggg

SEQ ID NO: 76397 - DNA, 703 bp, Homo sapiens
  misc_feature: GYAE6OF02JY5NG.15.33.C11.1.454.CMB.1.raw
  modified_base (182)..(182): a, c, t, g, unknown or other
  misc_feature (182)..(182): n is a, c, g, or t
  modified_base (407)..(407): a, c, t, g, unknown or other
  misc_feature (407)..(407): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (448)..(448): a, c, t, g, unknown or other
  misc_feature (448)..(448): n is a, c, g, or t
tcagtctacgtagccacgaccggtgctcgatttagagtgagctcgttgggtttggggtacgatttgatgttacctgatgcttagaggcttttctggaagcagggcatttgttgcttcagcaccgtagtgcctcgtcatcacgcctcagccttgacttttccggatttgcctaggaaaacccngcctacacgtcttaaaccgggacaaccgtcgcccggaccaacatacgccttcctcccgtccccccttgcagtacaccagtacagatattacctgttcccatcgactacgtcctttcgcctcgtccttacggggcgtacctcaccctcggtacccccgtattaaccgtcggactacggtacccgttggtcctttccggcgaggccgggtccttttaccgacccgtntttactcgtttacttagtgttcncntactcgtctactttcngtactacctccacgtctatccgtctacgactcgcctaccgtaccttacaccgtactccttaacgacctaaacccgtcccgacccccttaacccaaccaaacccgtactaaccgttaacgtccggtacccgtacgttccggcccgttacgtaaccgttgttacggtcgaccttaagggttcgttaacccggtcctaccgttccgtaccttcccggttcccaccggttacacggtcccgtacgtaccgttaaccggg

SEQ ID NO: 76398 - DNA, 558 bp, Homo sapiens
  misc_feature: GYAE6OF01D5SEK.36.86.H09.1.454.CMB.1.raw
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (475)..(475): a, c, t, g, unknown or other
  misc_feature (475)..(475): n is a, c, g, or t
tcagtacgctgtctcacgaccggtgctcgatttagtgctatagacttgggtttgggggaggcttggtacagcctggcaggtccctgagactctcctgtgcagcctctggattcagctttgatgattatggcatgcactgggtccggcaagctccgagggaagggcctggagtgggtctcaggtattagttggaacagtggtaggataggctatgcggactctgtgaagggccgattcagcatctccagagacaacgccaaagaattccctgtatctaacaaatgaacagtctgagagctgaggacacggctttgtattacngtgactaaaagtnttttgagtttagagtagtaaggtctaatactacggtatggacgtcgtggggaccaagggccacggtcaccgtctctcgacgcctccaaccgaacgggcccagttcccggtccttccccgtggccgccctgcctccgaggcnccacctcgagagccacgacgccgcccgtgggctacgcccgtggtaccaaggtacccttaccgttaccaagaccagtccgtacg

SEQ ID NO: 76399 - DNA, 501 bp, Homo sapiens
  misc_feature: GYAE6OF01EVQ78.36.86.H09.1.454.CMB.1.raw
tcagtacgctgtctcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgcttataattatgtctcctggttccaacagcattcaggcagcgccccgaaactcttaatttatgaggtctttcgtcgccctcaggggtttctagtcgcttctccggctccaagtctggcaacacggctccctgaccatctctagactccaggctgaggacgaggctgactattattgcagctcatatactgaagtcaatggtatccatggctgttcggcggagggacctagttcgaccgtcgtaggcagcccgaagctccg

SEQ ID NO: 76400 - DNA, 507 bp, Homo sapiens
  misc_feature: GYAE6OF01A1VY7.36.86.H09.1.454.CMB.1.raw
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctctggtaccaacagcaccgggcaatcgacccccaaaatcatgatttatgaggtcactcatcggcctcagggtttctaatcgcttctctgcatccaagtctgacaacacggcctccctgaccatctctcgggtctccaggctgaggacgaggcttaattattctgcagttcatatacaaccagacaacactctgtctagttcggcggtaggaccagctgaccgtcaacgtcacgacccaggctcgtcccccg

SEQ ID NO: 76401 - DNA, 537 bp, Homo sapiens
  misc_feature: GYAE6OF01DBUFC.36.86.H09.1.454.CMB.1.raw
  modified_base (228)..(228): a, c, t, g, unknown or other
  misc_feature (228)..(228): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtggttataattgtctcctggtaccaacagcacccgggcaatcgacccccaaaatcatgatttatgaggtcactcatcggccctcgtagggtttctaatcgtcttctctgcatcaagtctggcaacacggcctcctgaccatctcgtcgggcctccgaggctgacggacgaggtcttaattatttctgctagtttcaattactaacaaccagacaacactctgtacttagttccggacggacgggaccaagctcggacccgtacctaagtccacgacccgaacggcctcgtcccccg

SEQ ID NO: 76402 - DNA, 570 bp, Homo sapiens
  misc_feature: GYAE6OF01DT15D.36.86.H09.1.454.CMB.1.raw
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
tcagtacgctgtctcacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccntctcctgcactggaaccngcagtgacgttggtagttataaatttgtctctggtaccaacagcaccggcaatcgaccccaaaatcatgatttatgaggtcactcatcggccctcgagggtttctaatcgcttctctgcatccaagtctggcaacacggtcctccctgacctactctctcgggctccgaggctggaggacggaggtcttaatttacttctagctagttctaatactaccaactacgacaacctactctgtaccttagttaccgggacggtaacgggaaccctaaggcccgtacggtacccgtaccgtaacgtaccgaaccgacccgaacggtcccgtccggtaccccccgg

SEQ ID NO: 76403 - DNA, 616 bp, Homo sapiens
  misc_feature: GYAE6OF01CVKAI.36.86.H09.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (298)..(298): a, c, t, g, unknown or other
  misc_feature (298)..(298): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacngtcgatcacatctctgcactggaaccngcagtgacgttggtagttataatttgtctctggtacaacagcaccggcatcgaccccaaatcatcgatttangagtcactcagtccggcctacgtagggttactaagtcgtacttctctcgcactcaacgttctcggacaacgccggtccctccctgaccctactcgtcgtcggtcctccgaggtcgtaggacggacgaaggtacttaatttacgtttctacgtcttagttactaacttaactaacctaaccgacgactaaaccgtaccttactcggtaccttaggttcccgggagggaacggaaccgtaaggtccgtaacgtaccccggttaccttaacgtacccgaaccggtaccccggtaacgggtcccgtcccggtacccccccgg

SEQ ID NO: 76404 - DNA, 569 bp, Homo sapiens
  misc_feature: GYAE6OF01A6CQB.36.86.H09.1.454.CMB.1.raw
  modified_base (228)..(228): a, c, t, g, unknown or other
  misc_feature (228)..(228): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctcctggtaccaacagcaccgggcaatcgcccccaaaatcatgatttatgaggtcactcatcggccctcgtagggtttctaatcgcttctctgcatccaagtctggcaacgaccggcctccctgaccatcctcgtcgggcctccgaggtctaggacgggacgagggtaccttaaatttacgtttctcgtactagtttcaagtactaaccgaacctagacaactactctgtccttagttccgggacggacgggaccaaggcctcggacccgttaccgtaacgtccacgacccgaaggtcccgtcgtaccccccgg

SEQ ID NO: 76405 - DNA, 505 bp, Homo sapiens
  misc_feature: GYAE6OF01AGW5U.36.86.H09.1.454.CMB.1.raw
  modified_base (337)..(337): a, c, t, g, unknown or other
  misc_feature (337)..(337): n is a, c, g, or t
  modified_base (367)..(367): a, c, t, g, unknown or other
  misc_feature (367)..(367): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtagttataactttgtctcctggtaccaacagcacccaggcagacgccccccaaatcatgatttatgaggtcagaaatcggccctcgaggggtttcngatcgcttctctggctcaagtctggcgacncggcctcctgaccatctcgtgggcctcccgagcctgacggacgaggctgattattctgcagtctcatatacagtagcagcactctcgtcttacggaactgggaccaggtcacttgtcctaggcacgcccaaggacccc

SEQ ID NO: 76406 - DNA, 430 bp, Homo sapiens
  misc_feature: GYAE6OF01DDI54.36.86.H09.1.454.CMB.1.raw
  modified_base (205)..(205): a, c, t, g, unknown or other
  misc_feature (205)..(205): n is a, c, g, or t
  modified_base (349)..(349): a, c, t, g, unknown or other
  misc_feature (349)..(349): n is a, c, g, or t
  modified_base (420)..(430): a, c, t, g, unknown or other
  misc_feature (420)..(430): n is a, c, g, or t
tcagtacgctgtctcacgaccggtgctcgatttagtgctatagacttgggtttcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagnttttgagtttagagtagtaagggtctactactacggtatggacgtctggggccaagggaccacggtcaccgtctcctcagcctccaccaagggccccatcggtccttccccctggccgccctgctcccaggacgcacctcgagngcacagccggcctggctgcctggtcaaggctactccagacagcgtatgagcgggctggcaaggcgcatagnnnnnnnnnnn

SEQ ID NO: 76407 - DNA, 535 bp, Homo sapiens
  misc_feature: GYAE6OF01AG3IM.36.86.H09.1.454.CMB.1.raw
  modified_base (228)..(228): a, c, t, g, unknown or other
  misc_feature (228)..(228): n is a, c, g, or t
tcagtacgctgtctcacgaccggtgctcgatttagtgctatagacttgggtttggggggggtctcaggaggcagcgctctcaggacatctccactatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctcctggtaccaacagcacccgggcaatgcccccaaaatcatgatttatgaggtcactcatcggccctcaggggtttctaatcgcttctctgcatccaagtctggcaacacggcctccctgacccatcctctgggcctccaggctggaggacgaggtctaatttatttctgctagttcatatacaaccagaccaactactctgtctagttccggacggacgggaccaaggcgtgacccgtacctaacgtccacgaccccaacggcctccgtaccccccgg

SEQ ID NO: 76408 - DNA, 572 bp, Homo sapiens
  misc_feature: GYAE6OF01C4AFJ.36.86.H09.1.454.CMB.1.raw
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
tcagtacgctgtctcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataatttgtctcctggtaccaacacgcacccgggnaactcgaccccaaaatcatgtatttangagtcactcactccggccctcgtagggtttctaatcgtctttctctgcatccaagtcgcgacaaccgaccggtccctccctcgacctactcctacgtcgggcctccgaggtcgtaggacggacgaggtactttaaattactttctgcttacgttcaataactaccaacctgacctaactactctagtctacgtcgggacggacgggaaccacggtcgtacgacccgtctaacggccacgacccgaacggcctcccggtcccccg

SEQ ID NO: 76409 - DNA, 731 bp, Homo sapiens
  misc_feature: GYAE6OF01AYM7Q.36.86.H09.1.454.CMB.1.raw
  modified_base (230)..(230): a, c, t, g, unknown or other
  misc_feature (230)..(230): n is a, c, g, or t
  modified_base (310)..(310): a, c, t, g, unknown or other
  misc_feature (310)..(310): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctccgtggacagtcgatcaccatcctcctgcactggaaccngcagtgacgttggtaggttataattgtctcctggtaccaacagccgacccggcaactcgaccccaaaatcatgtatttangaggtcactcactccgccctgtagggtttctaagtcgtcgttctctcgctactccgtaagtcgtacggacctaaccgaccggtcccttacccgtacgaccctagttcctcgtcgggccttacccgacgggtcgtagggaacggaccggtacgggttaactttaacgttttacgttttccgtacgttaccgtaacggttttactaacgtttaaacctaaccgtaaaccctaaccggtaacccttaaaccgttaaccctaccgttacggtaccgtttaacggtttacccgggggaaccgggtaaccgggtaacccgtaaacgggtcccggttaaccggtaacccccggttaaacccgttaacggtacccgtaaccggaacccccggtaaacgggttccccggttccccggtaaccccccccgg

SEQ ID NO: 76410 - DNA, 618 bp, Homo sapiens
  misc_feature: GYAE6OF01DFJ0V.36.86.H09.1.454.CMB.1.raw
  modified_base (303)..(303): a, c, t, g, unknown or other
  misc_feature (303)..(303): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtagttataatttgtctcctggtaccaacagcaccggcaatcgaccccaaatcatgtatttangagtcactcacgtccggccctcgtagggtttactaactcgtcttctctgctatccaagtctcggaccaacgaccggtccctcccgtacgacctacgtctcgtcgggccttccgaggtcgtaggaacgggtaccgtaggtacttaaatttacgtttctaggtactagttactaacttaactaaccaaccgacgaacctaaactaccttcgtagtaccgttacggtccgggacgggtaacgggaacctaaggcgttaccggacccgttactaaacggtccaaccggacccgaacgggtcccgtcccggtacccccgg

SEQ ID NO: 76411 - DNA, 602 bp, Homo sapiens
  misc_feature: GYAE6OF01DJPB8.36.86.H09.1.454.CMB.1.raw
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctctcactcagggcacagggtcctgggcccagtctgccctggctcagcctgcctccgtgtctgggtctcctggacagtcgatcacatctcctgcactggaaccngcagtgacgttggtagttataatttgtctctggtaccaacagccaccgggcaatcgaccccaaaatcatgtatttangaggtcactcacgtccggcctcgtagggtttactatcgcttctctgctactccaagtctggaccaacgaccggtccctaccctacgaccctactcctcgtcgggcctccgacggctaggacgggacgaggtacttaatttactttctgtactagttcaattaactaacctaaccgaagtccaaactacgttctagtccgttacgtccgggacgggaacgggaaccacggtcgttaccggacccgttaccgtaacgttaccgaaccggtacccgaagggtccctcccggttaccccccgg

SEQ ID NO: 76412 - DNA, 505 bp, Homo sapiens
  misc_feature: GYAE6OF01EWMZR.36.86.H09.1.454.CMB.1.raw
  modified_base (228)..(228): a, c, t, g, unknown or other
  misc_feature (228)..(228): n is a, c, g, or t
  modified_base (298)..(298): a, c, t, g, unknown or other
  misc_feature (298)..(298): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtggttataatttgtctctgtaccaacagcaccggcaactacgaccccaaaatcatgntttatgaggtcactcatcggccctcaggggttttcaatcgcttctctgcatccaagtctggcaacacggcctccctgaccatctctgggctcaggctgacggacgaggctaagttatttctgcagttcatatacaaccagcaacactctgctattcggacggagggccaagctgaccgtccaagtcagcccaaggcctcgtcccccg

SEQ ID NO: 76413 - DNA, 841 bp, Homo sapiens
  misc_feature: GYAE6OF01C08HV.36.86.H09.1.454.CMB.1.raw
  modified_base (279)..(279): a, c, t, g, unknown or other
  misc_feature (279)..(279): n is a, c, g, or t
tcagtacgctgtctcacgaccggtgctcgatttagtgctatagacttggggtttggggggggtctcaggaggcagcgcgtctcaggacatctccaccatggcctgggctctgctgctcctcaccctctcactcgagggcacgagggtcctgggcccagtctcgccctggcctacacgcctcgcctccgtgtcgtgggtctccgtaggacaggtccgatccaccatcctcctcgcacgtggaacctgtctagtgacggtttggtagttaattaaagtttntccgtactaggtaacctaacgacgaccggaaccggacaaacgtccgaacccctaaaagtcctaagttacgtaacttttaagcggtaacggttcctaacgtaccgtaacgtcccggtacccgttaacgggtaacggggttttcctaaccgttcggtaccttcgtacgtcgactactaccggtaacgtcggtacgacccttaaacgcccggtcccttcccggtacaaccttaccttaccgtcgggtaccgggtaccctaccccggtaggttacccggtaacggggaacggttaacccgggtaagggttaaccttttaaacgggttttctttcgggtaacccgttaattaacgggttttaccaaacgttaaccttaaccggaaaacctaccggtaacctaaaaccccggttctaaacccggtttcgtacggttaacccggtccggggggaacccgttaacgggggaaacccctaaggtacccggtaaccggttaaccccgtaaacgttaccggtaaccgtacccggaaaccccggttacggccccgtttcccgtaaccccccggg

SEQ ID NO: 76414 - DNA, 731 bp, Homo sapiens
  misc_feature: GYAE6OF01C4CS9.36.86.H09.1.454.CMB.1.raw
  modified_base (296)..(296): a, c, t, g, unknown or other
  misc_feature (296)..(296): n is a, c, g, or t
tcagtacgctgtctcacgaccggtgctcgatttagtgctatagacttgggtttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagcgttggtacagcctgggcaggtccctgagactctcctgtgcagcctgtggattcagtcttgatgtatttagnggtacagttcgcgtacggtcggggtccggacgaacgtccgtaccggaggggaacgggtccgtagggagttcggtctacgtagggttactttagggtagtaacggaggttacgggtaggtagtagggtacttaaggtcggtcggtaacgttcgtagggtagggtaaccggggtcccttatttcggaacggtccgacgttccctacggaaaggtaccgaacgtaaacccggaccgtaaacgttaaccgtttaccccgtaagttaacgttaaccgttaaactaacggtacgtaaacgtacgttacccggtaggacggttaacgccggtttaacggaacgggtaacccggtacgggttcccttttaagggttaaacctttcgaacggtacgggttaaaccttaaaagggtttcgtttaccgggtaaagttttaaagggg

SEQ ID NO: 76415 - DNA, 671 bp, Homo sapiens
  misc_feature: GYAE6OF01CNR1S.36.86.H09.1.454.CMB.1.raw
  modified_base (654)..(654): a, c, t, g, unknown or other
  misc_feature (654)..(654): n is a, c, g, or t
tcagtacgctgtctcacgaccggtgctcgatttagtgctatagacttgggtttggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagcgttggtacagcctggcaggtccctgacgactctctgtcgcacgcctcgtggtacttcagtctttgatagtatttagtcggactagtcgcctacggtcggggtcccgacgaacggtccgtacccgggaagggggaacgggtcccgtagggacggtttcgggttaccttacggtaaggggtttaagttttaagggttacggaaacgtagggttaggggtaaggtaagttaaggcttaggtcggaccggtacttcgtaggtacgggaacgggcctaagttcgagtactacgttccgaaccgaaggaacgaaccgaaccgtaccaaagtaccttccgtaagtaactactaaacgaatacgaaactgtcagagcgtacgaggaacggtcctacggttaccttaggtacttacgtggtactaactaaagtttntttaggtaagtttaagg

SEQ ID NO: 76416 - DNA, 802 bp, Homo sapiens
  misc_feature: GYAE6OF01EEFJX.36.86.H09.1.454.CMB.1.raw
tcagtacgctgtctcacgaccggtgctcgatttagtgctatagacttgggtttggggagctctgggagaggagccccagccctgagattcccaggtgtttccattcagtgatcagcactgaacacagaggactcaccagtggagttgggactgagctggtatttttccttttggcttaattttaaaggtgtccagtgtgaagtgcagtcgtgggtggagtcggtgggggagtcgttggtacagccgtgggccacgggtccctagacgtaccttcctccgtgtcgcgtacgtcccttgtaggtacttcgtagttcttttagattagttaatttagtcggactagtcggaccgtacggtcggggtacccgacgaacgtccgtaccggaggggaacgggtccgtagggacggttcggtctacggtaggttacgtttagggtacggaaacgttagggtagggtaacggtaggtacggtacgtttacgtcgggtaccggttacgttcgggttacggtaacggggtaacgggtacccgttagttaccggaacgtacgtaaccgttacccgtaccgaaacggaaccgaaacccgaaccgaacccgttaaagttaaccccgtttaccgtaagttaaccttaacctaaacgttaaacgttacgtaaaccgtagttaccgtaggaagtaccggtacgtaacgggtaaccgggtaccgttacccgggttacgtttaaggtaacccgttttaggaacggtttaacgaaacgtttaaaaggttttagtttttaagggtaaaggttttaaaacggg

SEQ ID NO: 76417 - DNA, 525 bp, Homo sapiens
  misc_feature: GYAE6OF01B2G07.36.86.H09.1.454.CMB.1.raw
  modified_base (309)..(309): a, c, t, g, unknown or other
  misc_feature (309)..(309): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (516)..(516): a, c, t, g, unknown or other
  misc_feature (516)..(516): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccagcagtgacggtttggtggttataaattttgtctcctggtaccaacagcacccgggcaatcgacccccaaaatcatgatttangagtcactcatcgccctgtagggtttcaatcgcttctctgcatccaagtctgcaacacggcctccctgaccatctctgggcctcaggctggaggacgaggactaatttntttcngtctagttcataataccaaccagaccaactactctagtcttagttcggacggacgggaccagctcgaccgtcctaacgtcacgcccaacggcncgtcccccg

SEQ ID NO: 76418 - DNA, 803 bp, Homo sapiens
  misc_feature: GYAE6OF01CYI54.36.86.H09.1.454.CMB.1.raw
tcagtacgctgtctcacgaccggtgctcgatttagtgctatagacgttggggtttggggggggtctcaggaggcagcgctctcaggacatctccaccatggcctgggctctgctgctcctcaccctctcactcgagggcacgagggtcctgggcccagtcctcgccctggctcacgcctgcctccgtgtcgtggtctcgtaggacagtcgatcacattcctctgaccacgtacggaaccagcgtagtcggtacggttttggttaaggtttaattaaagtttttcggtaccgttacccgttacgggtaaacccaacgaccgcccggaaccccgggtacaacttaccccggaacccccctaaaaagtccgtaaagttcgtaattttagtacggtaacggtacctacgtactaccggtcccggtacccgttacggttaacggggttttacctaacgttcccgttccgtttcctacgttacgtaccttaaaccgtcccgttaaacgttccggtacgaaaccgtaaacccgtacccggtccccttaccgtaccggaacccttacgttcccgttccgggttccggtaccctacccggtacgggtaccggtagggaacgggtaaccgtcggtttaaacctttaagttttactttccgtacgttaccgtaagtttaccaaataaccgttaccaacgtacgactaactacctcgtacgttacgaccgtcggacggacggtacgtagtccgttaccgacccgttacgtaacggaccgtacccgaccggaaccggtcctcccgggttacccccg

SEQ ID NO: 76419 - DNA, 637 bp, Homo sapiens
  misc_feature: GYAE6OF01B2S9W.36.86.H09.1.454.CMB.1.raw
  modified_base (229)..(229): a, c, t, g, unknown or other
  misc_feature (229)..(229): n is a, c, g, or t
  modified_base (302)..(302): a, c, t, g, unknown or other
  misc_feature (302)..(302): n is a, c, g, or t
  modified_base (471)..(471): a, c, t, g, unknown or other
  misc_feature (471)..(471): n is a, c, g, or t
tcagtacgctgtctcacgaccggtgctcgatttagtgctatagacttggggtttggggggggtctcaggaggcagcgctctcaggacatctccaccatggcctgggctctgctgctcctcaccctcctcactcgagggcacgagggtcctgggcccagtctgccctggctcgagcctgcctcgtgtctgggtctcgtggacagtcgatcaccatctctgcatggaaccngcagtgacgttggtagtataattgtctctgtacagacgcgaccggcaatcgaccccaaaatcatgtacttagngagtcatcactcggcctgtacgggttactatcgtcttctctgactataccaagtctacggaccaacgtaccggtccctaccctacgtacctaacttccgtcgtcgggccttaccgaacgggtcgtacgggaacggaaccgtaggttaactttaaacgtttactttacgngtacgttaacgtttactaataacgtaccaaacgtaacacctaaactaccgttacctacggactttacggtaaccggggaaccgggaaacgggtaaccgaacggtcctacggaacccgttaccgttaaacggtccgacgaacccgaacgtcccgtccggtacccccg

SEQ ID NO: 76420 - DNA, 845 bp, Homo sapiens
  misc_feature: GYAE6OF01ELWJA.36.86.H09.1.454.CMB.1.raw
  modified_base (220)..(220): a, c, t, g, unknown or other
  misc_feature (220)..(220): n is a, c, g, or t
tcagtacgctgtctcacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatcctcccgnacctacggaaccgacgcagtggtacggttcggttaggttaagttaaattttaggtcttccgttacggtaccgtaaaccacgccgacccgggaccgaactacggaccccccaaaacctatactagtaacttttaacgttagagggtactacctacgtacgtccggtcccttaccgtaagggggttttacttaactcggtcctttccttactggtaccacttacctaacggtcgttcggaccaaacccgtaccggcccccttacccgttaccgaaccctaacctttcccgtttaccggtcgggggtccccgttaccccgaacggggaccgttcgggaaacgggggtaacccggtaacgggttacctttttaaaaacttttagttttttaccgtccggttacgaacggttttttcaaaactttaaccttaaaacccaaacccctaagggtacctaaaaccctaaccgtttcccgttagtaacccgtttacgtttacccggggccggggggtaaaacggtaccccggtaaacgtacgttcccggtaacccggttaaccctaaggttaaccccgaccggtaacccccggaaaccgggtcccgttcccggtcccccccccgttaaccgggg

SEQ ID NO: 76421 - DNA, 601 bp, Homo sapiens
  misc_feature: GYAE6OF01EAQY8.36.86.H09.1.454.CMB.1.raw
  modified_base (338)..(338): a, c, t, g, unknown or other
  misc_feature (338)..(338): n is a, c, g, or t
tcagtacgctgtctcacgaccggtgctcgatttagtgctatagacttgggtttgggggaggcttggtacagcctggcaggtccctgagactctcctgtgcagcctctggattcagctttgatgattatggcatgcacgtgggtccggcaagctccgaggggaaggcctggagtgggtctcgaggtattagttggaacagtggtaggataggctatgcggactctgtgaagggccattcagcatctcagagacaacgccaagaacttccctgtatctaacaaatgaacagtctgagagctggacggacacggtccttgtattactgtagactaaaagtnttttgagtttagagtagtaaggtctactacgtacgtatggacgtcgtggggaccaacgggaccacggtccaccgtctcctcacgcctaccaccgaacgggcccacgtccggtcccttcccccgtcggcccgcccgtcgcctaccgacggacgccacccgtccgacgacgccaaccgacggcccggcccgtcgggcctcggcccgtcgggtaccgaaacgggacccttaaccgttacccgaagaccgtacggccggttaaccgg

SEQ ID NO: 76422 - DNA, 778 bp, Homo sapiens
  misc_feature: GYAE6OF01DSF1C.36.86.H09.1.454.CMB.1.raw
tcagtacgctgtctcacgaccggtgctcgatttagtgctatagacttggggtttgggggggggtctcaggaggcagcgctctcaggacatctccaccatggcctgggctctgctgctcctcaccctcctcactcagggcacagggtcctcgggcccagtctcgccctggctcacgcctgcctccgtgtcgtgggtctcgtggacagtcgatccaccatcctcctgccacgtacggaaccagcgaggttaggtacggtttgggttaggtttaaatttaaagttttcgtccttccgttaggtaacccaacgacgtcccggaaccccgggactaaccgtaccggtaaacccccctaaaatcctaagttacgtttaactttaacggtacggtaacggttaccctacgttaccgtaaccgtccccgggtacccgttacgggtttaacggggtttaccttaacgtccggttcctttactcgtacgacctaacgtaccgtagttacgacgaacctaaccggcccgtccctccgtacacctacttaccgtcggtccggtcctaccggaggtaccgtaggaacgggacgtacgttaacttaagttttctccgtagtacttagtaacttactaaccgaaccactaacgaacctacgttccgttactcggttaccgtacggttaccggggaaccggtaacgggaaccctacggtaccgtaacccggtacccgttaacgaccggtaccgaccggtaaccccgaacggtccccgtacccggttacccccgg

SEQ ID NO: 76423 - DNA, 614 bp, Homo sapiens
  misc_feature: GYAE6OF01AT9VP.36.86.H09.1.454.CMB.1.raw
tcagtacgctgtctcacgaccggtgctcgatttagtgctatagacttgggtttggggagctctgggagaggagccccagccctgagattcccaggtgtttccattcagtgatcagcactgaacacagaggactcaccatggagttgggactgagctggattttcctttggctattttaaaggtgtccagtgtgaagtgcagctggtggagtcgtgggggagcttgggtacagcctggcaggtccctgagactctcctgtgccaggcctctggattcgagtctttgatgattatggcatgcacgtgggtccggcaagcctccgagggacgggcctgggagtgggtctgaggtattaggtggaactggtggtaggataggctagtgcgactcgtggtggaagggtcctaattcgagctatcctaccgaagacgaaccaacgaccaagtaacctttcccgagtaacttacctaaactaaaagttcgaaaccgtggttacgaggaacgtacgacgttagggaacggtaccggtacccggtacccgtttaggtaaccttttacggtacggttacgtaaaccgtaaaaggtttctttttaacgggtaaggttttaacggg

SEQ ID NO: 76424 - DNA, 637 bp, Homo sapiens
  misc_feature: GYAE6OF01CQ672.36.86.H09.1.454.CMB.1.raw
tcagtacgctgtctcacgaccggtgctcgatttagtgctatagacttgggtttgggggaggcttggtacagcctggcaggtccctgagactctcctgtgcagcctctggattcagtctttgatgattatggcatgcacgtgggtccggacaagctccgaggggacgggcctgggagtgggtctcgaggttatttaggttggaacaggtgggtaggatagggctagtgcggtactcgtggtaggaacggggtcctattccagcactcctaccgagacgaaccaacgaccaaagtaaccttccctagtaactactaaacaaatcgaaactagtcgtagagacgtcgtaggacggacgtacggtcctttagtacttacgtgtagaactaaagttgtttagtagttagtaggtaaggtagtacttactacgttacggtagtcggacggtcggacgggacgaacgggaccgacggtaccgaccgtctcctacacgtcccaccaccggacggccctagtcccgtacctccccgcggtccctcccgtcgacctaccgaggaccgcctaaccgtcgacgcaccgcgaccgccggcccgtggcctcgcggtcgacgaacgtctaccgtacagactcggtcgtacgg

SEQ ID NO: 76425 - DNA, 555 bp, Homo sapiens
  misc_feature: GYAE6OF01ELTQ9.36.86.H09.1.454.CMB.1.raw
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
tcagtacgctgtctcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctcgccctggctcagcctgcctccgtgtctgggtctcctggacagtcgatcaccatcctcctgcactacggaaccagcagtgtacgttggtagttataaatttgtctcctggtaccaacacgccgacccgggcaactcgacccccaaaatcatagtatttatgacggtcactcacgtcgccctcgtacgggtttactaagtcgtcttctctcgctaactcgtaacgtcgtcgaccaaccgaccggtccctcccgtacgacctcttctcgtcggtcctcgaggctaggacggacgagtacttaatttgttcngtctagtnatacacacganacacnctcntctagtcggacgacggacagctcgaccgtacacgtcacgaccgacgtctccgtaccccg

SEQ ID NO: 76426 - DNA, 686 bp, Homo sapiens
  misc_feature: GYAE6OF01E1LJI.36.86.H09.1.454.CMB.1.raw
  modified_base (236)..(236): a, c, t, g, unknown or other
  misc_feature (236)..(236): n is a, c, g, or t
  modified_base (317)..(317): a, c, t, g, unknown or other
  misc_feature (317)..(317): n is a, c, g, or t
tcagtacgctgtctcacgaccggtgctcgatttagtgctatagacttggggtttgggggggagaggagccccagcccctgagattcccaggtgtttccattcagtgatcagcactgaacacagaggactcaccatggagttgggactgagctggtattttccttttggcttaagttttaaaggtgtccagtgtagaagtgcagctgggtggagtcggtgggggagtcgttggtacngcctggctacggtccctgacgtactcctcctgtcgctacggtcctcgtaggtacttcgagttctttagattagtatttagnggtactagtccgacgtacggtcggggtcccggacgaacgtccgtaccgggaacgggtaacgggtccgtagggtacggttcggggtacttacgggtaaggtttaacgttaggttagggaaacgtaggtagggtaggtaagtacggacgttacggcggtacggtacgttcgtagggtaacgggaacgggtcgtagttacgacgtactacgtccgacgtaaggaacgaccgtaacgacctaaacgtaccttacctagtactactaaacgagtagaactagtacgtagacgagacgtacggacgacgtaccgtacttagtactagtagtcgaaattaagttagttagtagttaagagtttaaggtaagttacg

SEQ ID NO: 76427 - DNA, 443 bp, Homo sapiens
  misc_feature: GYAE6OF01B2YAY.36.86.H09.1.454.CMB.1.raw
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (423)..(443): a, c, t, g, unknown or other
  misc_feature (423)..(443): n is a, c, g, or t
tcagtacgctgtctcacgaccggtgctcgatttagtgctatagacttgggtttcaggtattagttggaacagtggtaggataggctatgcggactctgtgaagggccgattcagcatctccagagacaacgccaagaattccctgtatctacaaatgaacagtctgagagctgaggacacggccttgtattactgtgcaaaaagtattttgagtttagagtagtaaggtctactactacggtatggacgtcgtggggccaagggccacggtcaccgtctcctcagcctccaccaggcccatcggtctccccnggcnccngctcaggncncncgagcncacagccgccgtggctgccgtggcaaggtacctactccagacagcgtactggacggccgggctcgggacgaacggcgacgagtagnnnnnnnnnnnnnnnnnnnnn

SEQ ID NO: 76428 - DNA, 723 bp, Homo sapiens
  misc_feature: GYAE6OF01ANZ3R.36.86.H09.1.454.CMB.1.raw
tcagtacgctgtctcacgaccggtgctcgatttagtgctatagacttgggtttggggagctctgggagaggagccccagccctgagattcccaggtgtttccattcagtgatcagcactgaacacagaggactcaccatggagttgggactgagctggattttccttttggctattttaaaaggtgtccattgtgagtgcagctggtggagtcgtgggggagcttggtacagcctggcaggtccctgacgactctcctgtgcagcctcgtggattcagtctttgatgtattagtggcagtcgctacggtcgggtccggacaagccgtacggaaggggaacgggtcctagggaggttcgggtcctcgaagggttattaggtaggtcgtaggttaggggtaatttaaccaagtaaacgttagttcgggtagggtaacgttcccgggtaggggtaaccgggtcccgttaagtttacccgaacccgtacgttacccgtaccgaacgggtaaccgtaacccgaaacccgaccgtaaaccgaaccggtaccgaccgttagtaacctcgtaacgtaacgtaaagtacgaaacgtcggttacgagtaacgggaaccggtaccggaaacgggtaccggacggttacgttaggttaggtttaacttacgggtttacgtcgggttaaaccgttaaccggttttccggggtaaaagttttcccggggtaaccggg

SEQ ID NO: 76429 - DNA, 636 bp, Homo sapiens
  misc_feature: GYAE6OF01CKJMY.36.86.H09.1.454.CMB.1.raw
  modified_base (325)..(325): a, c, t, g, unknown or other
  misc_feature (325)..(325): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatcctcctgcacgtggaaccagcagtgtacgtttggagtaacatcatgtctcctggtaccaacagtaccaggacaacgcccccaaactcatctattttgacgtcggtagtcgccctnaggtatttcaatcgtcttctctcggctacgagtcctgaccacgaccggtcctcctacgacctactcttcgtcggtcctaccgtcgtcccgttaggaacggtacgtacggtctagttaatttacgttacgttcgtttacccactaactacgttaccgaacggtaccggtacgtttaccggtttcggttaccgtttccggggccggtacccggacccgtaccgtccgtaccggttccgtacgggttccaccggtccgtaacggtcccgttccgtcccccgtacgggtacctacccgttccgttcccgtccccc

SEQ ID NO: 76430 - DNA, 728 bp, Homo sapiens
  misc_feature: GYAE6OF01DDLUN.36.86.H09.1.454.CMB.1.raw
  modified_base (151)..(151): a, c, t, g, unknown or other
  misc_feature (151)..(151): n is a, c, g, or t
  modified_base (224)..(224): a, c, t, g, unknown or other
  misc_feature (224)..(224): n is a, c, g, or t
  modified_base (297)..(297): a, c, t, g, unknown or other
  misc_feature (297)..(297): n is a, c, g, or t
tcagtacgctgtctcacgaccggtgctcgatttagtgctatagacttgggtttgggggaggcttggtacagcctggcaggtccctgagactctcctgtgcagcctctggattcagtctttagatgattagtggcatgcacgtgggtccganaagcctacgagggaaggcctaggagtgggtctcgaggttattagtggaactggtggtacggagtaggcttagnggcggtactcgtgtaggacggcgattcgagcatctacgagacgacaacgacaagtactccgtatactactaanaagtgaactagtctagtagagtcgagtacggataccgtcttagtattacgtgtacgtaactaaagttagtttaggtaagtttagtacggttaaggtaacggttctaaccgtaggttaacggtagtacgggtacggttcgggtacggacccggtaacgggacccgtacggtacccgtaccgtcctcccgtacgtaaccgaccccgttaacccgaaaccggtacccgggtacccctaacggtttccccgggttacccccttccccggggtcgggacccttccccggtcgacccgttacccgggaagccgtaccccgtaccgtaccggagacccgtaccgacggccggaccccggtcgttaccgggcggtaccgtccggtcgtaaccggtaaggttaccctacggtacccaaggtaaccgcggtaacggtacgg

SEQ ID NO: 76431 - DNA, 746 bp, Homo sapiens
  misc_feature: GYAE6OF01AUX2A.36.86.H09.1.454.CMB.1.raw
  modified_base (634)..(634): a, c, t, g, unknown or other
  misc_feature (634)..(634): n is a, c, g, or t
tcagtacgctgtctcacgaccggtgctcgatttagtgctatagacttggggtttggggggggtctcgaggaggcagcgctctcaggacatctccaccatggcctgggctctgctgctcctcaccctcctcactcagggcacgagggtcctgggcccagtctgccctggctcacgtcctgcccttcgtgtcgtgggtctccgtggacagtcgactcacctatcctcctgacacgtcggaaccagcgtaaggttcggtacgtttgggttaggtttaatttaaagttttcgttcgttccgttacggtaaccaacgacgaccgacccggactaactaccgaaccccaaaatcacgtgtaatttagcggtacggtaccaccttacgacgttaccggtcccgttacggttacgggttttactaacgttccggtccttccgttacccgtccttaccgtaacgtccgtaccggaccgtaaccggcccggtacccctacccgttccgaaccttaccggttaccttaccgtaccgtaccgtcccggtacgggtacgtaccgggaacgggtaacggaccgtcgttaacgttattaacgttcgtacgcgtacgtacctagtaactaacttaaccggtaattacgtnttaacggttgtaccgtacgtacgttcgtcggttacgggccgggtacgggaaccggtacgttaccgtacgtacgttacccggtagtacccgacgaccggtcgtcgtaccccgg

SEQ ID NO: 76432 - DNA, 706 bp, Homo sapiens
  misc_feature: GYAE6OF01AKI9G.36.86.H09.1.454.CMB.1.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
tcagtacgctgtctcacgaccggtgctcgatttagtgctatagacttgggtttgggggaggcttggtacagcctggcaggtccctgagactctcctgtgcagcctctggattcagctttgatgattatggcatgcacgtgggtccgcaagctccgagggaaggcctggagtggtctgaggtattagttggaactgtggtagataggctatggcggtactntggtaggagggcctatcagcatcncagagacacgcaatactttccagtatcaacaatcgaactagtctagaagtcgctaggacggaccgacggttacctttagttagttaaccgttgtaaccgtaaagtaaaagttttcgtttaaggtaacggtttaagtagttaagggttaaccgggttcttaaaccgtaggtaacggtacgtagggtaccgtcggacggggtactaacgggtcctaccggtactaccgtacctccgtacgtccgtccctacccgaacggcccgaccgttacgtcccggtccccttccccgtcggtccctccccggtcgccgtacccggacgggtaccaccgtcccgtacggacgtaacggccctaacggcccgtacccgggtcccgtccggtccgttcccggtacggttccgtaaaccggtaaccggtacccttaccggttacccgaacgtaaccgtcgggtaccgttaccggg

SEQ ID NO: 76433 - DNA, 747 bp, Homo sapiens
  misc_feature: GYAE6OF01DSDGX.36.86.H09.1.454.CMB.1.raw
tcagtacgctgtctcacgaccggtgctcgatttagtgctatagacttggggtttggggggggtctcaggaggcagcgctctcaggacatctccaccatggcctggctctgctgcctcctcaccctcctcactcgacggcacgagggtccgtcggcccagtctcgccctggctcgacgcctcgccttccgtgtcgtcggtcctcgtacggacgtagtaccgactaccaactcgttcctcgtcgactacgtacgaaccagcgtagtcggtaggttagttaacgttaatttaacgttcgtacctacgttacggaaccaacgtcggaacccgacccggacaaccgtaccccgaaacccctaaagttcgtaacgtttagttaacgtttaggaccggttaaccgtacctaaccggttacgtacccgttacccggtacccgttagggtttaaccggttttacttaaccgttccgttacgttccgtactacgtactaaccgttaaaccgtgttcggaccaacctaaccggtcccgtaccttacccgacgtcctacgttccggtcgcgtccgtacggacggtcgaaggtacgagttacgttaactttaacttcgtacgacttacgtactaagacctaacaccgaacgtactaaccgtcttaccgtcgtacgtacggttacggaccggtaacgtaccgacgtaccgtctaccggtaacctaccgacggcccaaccggagcccttccgccctacccgg

SEQ ID NO: 76434 - DNA, 840 bp, Homo sapiens
  misc_feature: GYAE6OF01C8XR0.36.86.H09.1.454.CMB.1.raw
tcagtacgctgtctcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctcgccctggctcagcctgcctccgtgtcgtgggtcctcctggacagtcgatcaccatctcctgcacgtggaaccagcagtgtacgtttggtaggttaattaaagtttgtcctcgttaggtaacccaacgacgtccgaccccgggacaaactcccgaacccctaaaaagtacctaagttgtaatttagtaggtacggtactacgtacctaggtccgggtaccccgttacggttaacgggggttttacctaaacggttccgtttaccgttttctaccgttcgaccgtaacgtaccccgtaaaggttaccggtacggaacccgtaaacccgtaacccgggtccctttaccccgtaccgtaaccctaccgttcccgttaccgggttacggggaccccttacccggaacgggttacccgggtacgggtaaaccgggggaaccggttaacggggttaaccttttaaaacgtttttacgttttacccggtacggttaccggttaacgttttaacctaacgtttaacctaaaccgtaaacccgtaacgtaaccgaaacccttaccgttacgtactaccgttaacgtccgggggaaccgggaacgggtaaccgtaacgccgttaacccggtaaccctaccggttaacgtaccgaaccgtacccgaaacgggtccctacccggtacccccgg

SEQ ID NO: 76435 - DNA, 812 bp, Homo sapiens
  misc_feature: GYAE6OF01CWW6G.36.86.H09.1.454.CMB.1.raw
tcagtacgctgtctcacgaccggtgctcgatttagtgctatagactttggggtttgggggggggtctcaggaggcagcgctctcaggacatctccaccatggcctgggctctgctgcctcctcaccctctcactcgagggcacgagggtcctgggccctagtctcgccctggctcgagcctcgcctcgtgtcgtgggtcctccgtggacagtcgatccaccatcctcgtgcctacgtacggaaccaggcgtagtaggtcggtttgggtagttaattaacgtttcgtctccgtacgtaaccaacgaccgccgaccggataacgtacccgaaccctaaagtctagttagttaatttaggacgtacggtactacgtaccgtacgtcccggtaccgttacggttacgggtttactacgttccgttcttacgtacgtcgtactactaccgtaacgtcgacgaacctaccgaccgttccctaccgtacgaacttcgtcgtaccggtcggtacccacggtacggtacgtacgggacgggtaacggtacgtttaacgttttaaacgtttcgttaccggtacgttacgttaacggtttaacctaacgtttaaaccaacccggtaaaccgtaccgaaaccgttaacccttaacggtttccgtacgggtttaacccgttacgggggtacccggggaaccgggtaaccgggtaaacccgtaccgggttaaccgtttaccccggtaaacccggtttacccgtaaaggtccccgtaaaccccgggtcccggtaaacccggtcccgttacccccggttaacccccgg

SEQ ID NO: 76436 - DNA, 639 bp, Homo sapiens
  misc_feature: GYAE6OF01AXFKG.36.86.H09.1.454.CMB.1.raw
  modified_base (178)..(178): a, c, t, g, unknown or other
  misc_feature (178)..(178): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
tcagtacgctgtctcacgaccggtgctcgatttagtgctatagacttgggtttgggggaggcttggtacagcctggcaggtccctgagactctcctgtgcagcctctggattcagctttgatgattatggcatgcactgggtccggcaagctccgagggaaggcctggagtgggtctnaggtattagttggaacagtggtagataggctatgcggactctggtagaagggcctaattcgagctatctaccagagtacaacgccaagaacttccctgtatactanaaatgaacagtctgagnctgacggacacggccttagtattactggtnacgtaaaagtnttttagagtttagacgttagtaaggtctaactacgtacgtatggacgtcgtagggaccaagggaccgacggtcaaccgtctccgtcacgccctaccgaccgacgggccctacgtccgtccttaccccgtggtcccgccctacgtccctaccgacggacgtcctacccgtaccgaacgtaccgaccgtaccgaacggtcccggtaccccggttcgggtccgttcggtacccggttacgggtaccgtaaacggtaccgttacccgttaccgaaggtacctacggtccgttaaacccggg

SEQ ID NO: 76437 - DNA, 795 bp, Homo sapiens
  misc_feature: GYAE6OF01C8FJP.36.86.H09.1.454.CMB.1.raw
  modified_base (133)..(133): a, c, t, g, unknown or other
  misc_feature (133)..(133): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (352)..(352): a, c, t, g, unknown or other
  misc_feature (352)..(352): n is a, c, g, or t
  modified_base (656)..(656): a, c, t, g, unknown or other
  misc_feature (656)..(656): n is a, c, g, or t
  modified_base (726)..(726): a, c, t, g, unknown or other
  misc_feature (726)..(726): n is a, c, g, or t
tcagtacgctgtctcacgaccggtgctcgatttagtgctatagacttgggtttgggggaggcttggtacagcctggcaggtccctgagactctcctgtgcagccctcgtggattcagtctttgatgtattagnggctagtcgacgtacggtcgggggtccggactaaggtccgtaccgggaaggggacggtccggtagggtaggttcggggtctaggtaaggttaagtttaggtaggaaacgtaggttagggaagtagtaggctagtcggacgtatgtaggaggacggctntacgngactacttacncgaagacgaaccaacggtataacgtaccttccatacgtactaaanaatacgaacgtgtcgtaaggacggtctacggacgacggaaccgtccggtagtttattacgtatacgaagtaataaggtttgtttaaggtagtttaaaggaagtttagggtaactacggttaactagggttaacgtaggtaccggttaaccggtggggtaacccgggacggttaaacgggtacccgtaccggttacccgtaccgtaccctacccgtacgtacccggtacccgacccgtaaccgggaccgttaacccgtcccggtttacccggttcccgtaccccggtccgaccggttccccgtancccggaccggtaccgaccgtccgtaacccgcgtacgacgtaccgacgtaccggccgggccgcggttccgnggtacccggttccggtaacgtacccggttactaccggtaccggaaccgcgttaccggtaacggtccggg

SEQ ID NO: 76438 - DNA, 1056 bp, Homo sapiens
  misc_feature: GYAE6OF01DTO1D.36.86.H09.1.454.CMB.1.raw
tcagtacgctgtctcacgaccggtgctcgatttagtgctatagacgtttggggtttgggggaggctttggtacagcctggcaggtccctgagactcctcctgtgcagcctcgtggattcgagtctttagatgtatttagtcggctacgtgccgtacggtcgggggtacccggactaacggccgttaccgggaagggggtaccgggccgtggggtacggtgggtccttaggtaagggttatttagggtacggaagtaggtggggtaaggagttacggtacgtagtcgggaccggttactcggtgggaacgggaacgggtacctattcgacgtactactccgacgaagaacggaaaccgaaccgtaaccgaaaggttaccctttacccgttagttaaaccttaacgtaaacgtaaataccggaaacgtaggtaccgtaaggaacggtgtaccggtacggacggtaaccgtacggttactttagtttaacttacgtaggagtaaaacgttaagtttgtttaaggtttacggttaaacggtaggttaaacggttacgtttaacccgttaacgtttaaggttacggtacgtaccggggttacgttaccggggaaccgggaaccgggtaacccggaacccggtaccggtaccccggtacccgttaccgtacccgtaccccggaacccgtacccgtaaccccgggaaccggtaaccccggttcccgttaaccccgggtttcccccgtttaccccgttaccccccgggttcccggttacccgttccccgttaaccggggtccccgttaaacccgggtaacggaccccggtaacccccggttacccgggtaccgggtaaccgggtaccgtaaacccccgtacgggggccccccggttacccgggtaccccggggttacccgggttccccggttacccgggttaacccgggtttaaccgggaaaacccccggggtttaaccgggtttaaacccccgttaaacccggttaacccccgggggtaaaaacttacccgggggtaaacccgggttcgggtaaaccccgggg

SEQ ID NO: 76439 - DNA, 499 bp, Homo sapiens
  misc_feature: GYAE6OF02I7DO0.36.86.H09.1.454.CMB.1.raw
tcagtacgctgtctcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcaccgggcaatgcccccaaaatcatgatttatgaggtcactcatcggcctcaggggtttctaatcgcttctctgcatccaagtctggcaacacggcctccctgaccatctctgggctccaggctgaggacgaggctaattatttctgcagttcatatacaaccagcaaacactctgctattcggcggagggaccagctgaccgtcctaagtcagcccaaggctgcccccg

SEQ ID NO: 76440 - DNA, 577 bp, Homo sapiens
  misc_feature: GYAE6OF02F96OW.36.86.H09.1.454.CMB.1.raw
  modified_base (118)..(118): a, c, t, g, unknown or other
  misc_feature (118)..(118): n is a, c, g, or t
  modified_base (121)..(121): a, c, t, g, unknown or other
  misc_feature (121)..(121): n is a, c, g, or t
  modified_base (238)..(238): a, c, t, g, unknown or other
  misc_feature (238)..(238): n is a, c, g, or t
  modified_base (452)..(452): a, c, t, g, unknown or other
  misc_feature (452)..(452): n is a, c, g, or t
tcagtacgctgtctcacgaccggtgctcgatttagtgctatagacttgggtttgggggggtctcaggaggcagcgctctcaggacatctccaccatggcctgggctctgctgctcccnccnccctcctcactcgagggtcacgagggtccgtgggcccgagtacgtcgccctaggctcagcctgcctccgtgtctgggtctcctggacagtcgatcaccatctcctgcactggaaccngcagtgacgttggtggttataattgtctcctggtaccaacagcacccgggcaatcgaccccaaaatcatgatttatgagtcactcatcggccctgtacgggtttctaatcgtcttctctgctactcctaagtctggacaacgaccggccctccctacgacccatcctcgtcgggtctccgagctggacggacgaggtacttaagttactttcgngtctagttcattataccaacctagacaactactctacgcttacgttcgggacggtacgggaaccaacgcgtccgaaccgttcccgtaagttccgaacgtcccgaacggtcctccgtaccccccgg

SEQ ID NO: 76441 - DNA, 544 bp, Homo sapiens
  misc_feature: GYAE6OF02G5AWR.36.86.H09.1.454.CMB.1.raw
  modified_base (327)..(327): a, c, t, g, unknown or other
  misc_feature (327)..(327): n is a, c, g, or t
  modified_base (447)..(447): a, c, t, g, unknown or other
  misc_feature (447)..(447): n is a, c, g, or t
tcagtacgctgtctcacgaccggtgctcgatttagtgctatagacttgggtttgggggaggcttggtacagcctggcaggtccctgagactctcctgtgcagcctctggattcagctttgatgattatggcatgcactgggtccggcaagctccagggaaggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgcaaaagnttttgagtttagagtagtaagggtctactactacggtatggacgtcgtggggccaagggaccacggtcaccgtctcctcagcctccaccaagggcccagtccggtccttccccgtggccnccctgcctccgaggacgccacccgtccgagacgccacacgcggccctgggcctggccctggtaccaagggaccttacgttccagaccagccgtaacg

SEQ ID NO: 76442 - DNA, 504 bp, Homo sapiens
  misc_feature: GYAE6OF02FU97M.36.86.H09.1.454.CMB.1.raw
tcagtacgctgtctcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccgggcaatgcccccaaaatcatgatttatgaggtcactcatcggcctcaggggtttctaatcgcttctctgcatccaagtctggcaacacggcctccctgaccatctctgggctccaggctgaggacgaggctaattatttctgctagttcatatacaaccagcaacactctgctattcggcggagggaccaagctgaccgtctagtcagcccaaggcctcgtcccccg

SEQ ID NO: 76443 - DNA, 533 bp, Homo sapiens
  misc_feature: GYAE6OF02IW31J.36.86.H09.1.454.CMB.1.raw
  modified_base (458)..(458): a, c, t, g, unknown or other
  misc_feature (458)..(458): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccgggcaatcgacccccaaaatcatgatttatgaggtcactcatcggcctcgagggtttctaatcgtcttctctgcatcaagtctgcaacacggccctccctgaccatctcgtcgggctccgagctggacggacgaggtacttaatttatttcgcgtctagttcattataccaacagacaacnctctgacttagttcggcggacgggaaccaagctcgaccgtctaagtccaacgacccgaagtcctaccgtcccccg

SEQ ID NO: 76444 - DNA, 578 bp, Homo sapiens
  misc_feature: GYAE6OF02G1Q3H.36.86.H09.1.454.CMB.1.raw
  modified_base (329)..(329): a, c, t, g, unknown or other
  misc_feature (329)..(329): n is a, c, g, or t
  modified_base (481)..(481): a, c, t, g, unknown or other
  misc_feature (481)..(481): n is a, c, g, or t
tcagtacgctgtctcacgaccggtgctcgatttagtgctatagacttgggtttgggggaggcttggtacagcctggcaggtccctgagactctcctgtgcagcctctggattcagctttgatgattatggcatgcactgggtccggcaagctccagggaaggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtntttagagtttagagtagtaaggtctactactagtatggacgtcgtgggaccaagggacccacggtcacccggtctcctcacgtccctccgacccaagggcccctaagtccggtcccttcccccgtggccctccctgccctacccgaggaccnccgaccctccgacgacgccacgcggccggcccgtgggccttcggccctcgggtaccaaggtacccttaccgttccgaacggacgtacgtacgtaccg

SEQ ID NO: 76445 - DNA, 586 bp, Homo sapiens
  misc_feature: GYAE6OF02HMJU0.36.86.H09.1.454.CMB.1.raw
  modified_base (280)..(280): a, c, t, g, unknown or other
  misc_feature (280)..(280): n is a, c, g, or t
  modified_base (441)..(441): a, c, t, g, unknown or other
  misc_feature (441)..(441): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatcctcctgcactggaaccagcagtgacgttggtgttataaatttgtctctggtaccaacagcacccgggnaatcgaccccaaaatcatgatttaatgaggtcactcatccggccctcgtaggggtttactaatcgtcttctctgcatcaagtctggacaacgaccggcctcccgtcgaccattcctcgtgggcctccgaggctggacggacgaggtactaatttatttcgngtctagttactaataactaaccaaaccagaccaaactactctagtcttacgtcgggacgggaacgggaaccaacgccgttacggaacccgttaccgtaacgtccgaaccggtaccccaacgggtccctacccggtacccccccgg

SEQ ID NO: 76446 - DNA, 530 bp, Homo sapiens
  misc_feature: GYAE6OF02IQJHD.36.86.H09.1.454.CMB.1.raw
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcaccgggcaatgcccccaaaatcatgatttatgaggtcactcatcgccctcgaggggtttctaatcgcttctctgcatccaagtctggcaacacgcctcctgaccatctcgtgggctccgagctgacggacgaggcttaattactttctgctagttcatatactgtaagtcaagtggtactccacgtggtcgttggttcgggcggtacgggaccgtaaggttcgaccgtcgtaggtccacggaccctaggcctcccgg

SEQ ID NO: 76447 - DNA, 530 bp, Homo sapiens
  misc_feature: GYAE6OF02GA1UA.36.86.H09.1.454.CMB.1.raw
  modified_base (368)..(368): a, c, t, g, unknown or other
  misc_feature (368)..(368): n is a, c, g, or t
  modified_base (457)..(457): a, c, t, g, unknown or other
  misc_feature (457)..(457): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccgggcaatcgacccccaaaatcatgatttatgaggtcactcatcggccctcgaggggtttctaatcgcttctctgcatccaagtctgcaacncggcctcctgaccatctctcgggctccgaggctggaggacgaggacttaagtttacttctgtactagttcatatacaaccagaccaacnctctgtactacgttcggacggagggaccaagcctacgaccgtcctaagtcacgcccgaggtcctcgtcccccg

SEQ ID NO: 76448 - DNA, 501 bp, Homo sapiens
  misc_feature: GYAE6OF02HWSQ6.36.86.H09.1.454.CMB.1.raw
tcagtacgctgtctcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcaccgggcaatgccccaaaatcatgatttatgaggtcactcatcggccctcagggtttctaatcgcttctctgcatcaagtctggcaacacgcctccctgaccatctctggctcagctgagacgagctaattatttctgcagttcatatacaaccagacaacactctgctagttcggcggagggaccaagctcgaccgtctaagtcacgacccaaggtcctcgtcccccg

SEQ ID NO: 76449 - DNA, 584 bp, Homo sapiens
  misc_feature: GYAE6OF02IBVWB.36.86.H09.1.454.CMB.1.raw
  modified_base (292)..(292): a, c, t, g, unknown or other
  misc_feature (292)..(292): n is a, c, g, or t
  modified_base (315)..(315): a, c, t, g, unknown or other
  misc_feature (315)..(315): n is a, c, g, or t
tcagtacgctgtctcacgaccggtgctcgatttagtgctatagacttgggtttggggggggtctcaggaggcagcgctctcaggacatctccacatggcctgggctctgctgctcctcaccctcctcactcgaggcacagggtcctgggcccagtctgccctggctcagcctgcctccgtgtctgggtctcgtggacagtcgatcaccatctccgtgctagtacggaaccagctagtgacggtttggtagttaataaagtttgtcttcctacggtaaccacgagcaccgggnactcgacccaaatcatgtattangagtcactcatcgcctgtacggttactagtcgtcttctctcgcactacgtacgtctagactaaccgcgtcctcccgtagacctacgtcgtcgtcggctcgacgtcgtagacggacgagtacgttaattcgttacgtgtcgtagtactataactacgtaacgctacaaccgtctactcgtacgttacgtcgggacggtacggtaaccgacggtcgtaccggtaccgttcgtaacgaccgtacggtacctacgggtacctaccgtccccgg

SEQ ID NO: 76450 - DNA, 507 bp, Homo sapiens
  misc_feature: GYAE6OF02F1C08.36.86.H09.1.454.CMB.1.raw
  modified_base (360)..(360): a, c, t, g, unknown or other
  misc_feature (360)..(360): n is a, c, g, or t
  modified_base (400)..(400): a, c, t, g, unknown or other
  misc_feature (400)..(400): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaatctaatttatgagtctttcgtcggccctcgagggtttcagtcgcttctccggctcaagtctgcaacncggcctccctgaccatctctagacctcagctgacggacgnggctgactattatgcagctacatactactagaagttcaatggtatccatgctggttcggcggtagggacctaaggttgaccgtctacggtcacgtcccgaaggtccg

SEQ ID NO: 76451 - DNA, 693 bp, Homo sapiens
  misc_feature: GYAE6OF02HOKS1.36.86.H09.1.454.CMB.1.raw
tcagtacgctgtctcacgaccggtgctcgatttagtgctatagacttgggtttggggagctctgggagaggagccccagccctgagattcccaggtgtttccattcagtgatcagcactgaacacagaggactcaccatggagttgggactgagctggattttcctttggctattttaaaggtgtccagtgtgaagtgcagctggtggagtcgtgggggagcttggtacagcctgggcaggtcccctggagactctcctgtgcagcctgtggattcagtctttgattgtatttagtggctagtgactacgtcggggtccggacaacgtcctaccggaaggggaacggggccgttgggacggttcgggtcctacggtagggttaagtttagggtttacggaaaactagggttagggtaagggaagttaggggtacttaagtcgggaccgggtaacttcgttaggtacgggtaaacggggtccggtaacgttacgaacggtctacgttccgtaccgaacgtaacgaaccgtaaaccgaccgtaaaacggtaacctttacccgttagttaacttacctaaactaaatacgaaacctaacgtactagaacgacgtacgtaggaacggtaaccgaccggtccttaggttaacttacgtggtacgaaacttaaaaggtagttttacggagtttaacggg

SEQ ID NO: 76452 - DNA, 643 bp, Homo sapiens
  misc_feature: GYAE6OF02H5OH1.36.86.H09.1.454.CMB.1.raw
  modified_base (274)..(274): a, c, t, g, unknown or other
  misc_feature (274)..(274): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctcgtgtctgggtctccgtggacagtcgatcaccatctcctgcactggaaccagcagtgacgttggtagttataattgtctctgtacacagcgaccggnatcgacccaaatcatagtattactgacgtcactctacgtccgcctcgtacgggtttctaacgtcgtcttctctcgcacttaccgaagtcgtaggactaaaccgccggtacctcccgtacacctactcctcggttcggccgtacgcggtaccgtggaacgggtacggaaggttactttaaatttactttacgtcgtacgtacgttactaacttaactaaaccaaccgaacgaacttaacctaaccttctaccgtacgtttacgttaccgggacggggtaacggaacccgtaaacggccgtaaccggtacccgtttaaccgtaacggttacccgacggaaccccggtaggtacccgtcccgtaccccccgg

SEQ ID NO: 76453 - DNA, 615 bp, Homo sapiens
  misc_feature: GYAE6OF02JB3U1.36.86.H09.1.454.CMB.1.raw
  modified_base (307)..(307): a, c, t, g, unknown or other
  misc_feature (307)..(307): n is a, c, g, or t
tcagtacgctgtctcacgaccggtgctcgatttagtgctatagacttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctctggattcagtctttgatgtattagtggctatgcacgtgggtccgnaacgctccgaggggacggcctgggagtggtctcgaggttattaggtaggaactggtgggtaaggagtagggctaagtggacggtacttcggtggtacggaacgggcctagttcaggcctacttccgacgaggaccgaaccgaaccggacaaacgttaccttccgtagttaactacctaaacgaagtacgaactagtcgtagagacgtcgtaggacggaccgtacgttcgttagttaacgttacgtggtacgtaacgttaaaggtttgtttacggtaagtttaacgggtagttacgggtaacggttacc

SEQ ID NO: 76454 - DNA, 582 bp, Homo sapiens
  misc_feature: GYAE6OF02HDZOV.36.86.H09.1.454.CMB.1.raw
  modified_base (229)..(229): a, c, t, g, unknown or other
  misc_feature (229)..(229): n is a, c, g, or t
  modified_base (268)..(268): a, c, t, g, unknown or other
  misc_feature (268)..(268): n is a, c, g, or t
tcagtacgctgtctcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataattatgtctctgttcaacngcattcaggcagccgacccgaaactcttaattatgtaggttctttcgtccggcccttcgtaggggtttctagtcgtcttcgtccggctccaagtctggacaacacggtccctccctgacctatcctctacgactccgaggctggacggacgaggctagtacttattattgctagctatatatactgtaagtctaagttcggttaactccgaacgttggcgttcggttcgggaccgggacgggtaacctaagggttcgtaacccggttacgtacggtaccgaccggtacccgaacggtccgtaccggtcccccgg

SEQ ID NO: 76455 - DNA, 592 bp, Homo sapiens
  misc_feature: GYAE6OF02G4YU9.36.86.H09.1.454.CMB.1.raw
  modified_base (228)..(228): a, c, t, g, unknown or other
  misc_feature (228)..(228): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtggttataaatttgtctcctggtaccaacagcacccgggcaatcgacccccaaaatcatgtatttatgagtcactcactccggccctcgtagggtttctaatcgtcttctctgctatccaagtctcggaccaacgaccggtccctcccgtacgacctactcctcgtcgggcctccgaggtctaggacggacggaggtactttaagtttactttcgtgtctagttcaattactaaccaaccgacgacaacctacctctacgtacttacgttccgggacggtaacgggaaccaagtccgtacgtacccgttacgtaacgtcgaccgacccgaacggtccgtcccgtcccccgg

SEQ ID NO: 76456 - DNA, 560 bp, Homo sapiens
  misc_feature: GYAE6OF02JH0VB.36.86.H09.1.454.CMB.1.raw
  modified_base (228)..(228): a, c, t, g, unknown or other
  misc_feature (228)..(228): n is a, c, g, or t
  modified_base (493)..(493): a, c, t, g, unknown or other
  misc_feature (493)..(493): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctcctggtaccaacagccaccgggcaatcgacccccaaaatcatcgatttatgaggtcactcactcggccctcgtaggggtttctaattcgcttctctcgcatccaagtctgcaacgcggcctccctgaccatcctctcgggcctccgaggcctggacggacgagtacttaatttactttccgtgtactagttcattacaaccaacctagactaaacgcctactgccttattccgggnggaacggacctaagcgtagtacccgtacgtaacgtaccacgtacccgaaggtccgtcccgtccccgg

SEQ ID NO: 76457 - DNA, 692 bp, Homo sapiens
  misc_feature: GYAE6OF02I29WW.36.86.H09.1.454.CMB.1.raw
  modified_base (328)..(328): a, c, t, g, unknown or other
  misc_feature (328)..(328): n is a, c, g, or t
tcagtacgctgtctcacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgacactggaaccaggcaggtcgtacgttggtaggttaataatttcgtctcctacggtaaccaacgtagccgacccgggacaactcgacccccaaaatcagttgtatttagnggtacggtccactctagtccggtcctacgtacgggtttactaagttcgtcttctctgactactaccaagtcgtacgaccaaccgaccgtccctacccgtagaccctacttccgtacgtcgggtaccctcggacggtcgtacggacgggtaaccgtacggttactttaacgtttactttaccgtacggtcctaacggtttacctaagttacctaaacctaaaccgtacggaacctaaacctacggttaccttagtaccgttacgttcggggaccggaaccgggtaaccgtacgtacggttaaccggacccggttaccgtaacggtaccgaaccggtaccccgacggtccctacccggtcccccgg

SEQ ID NO: 76458 - DNA, 765 bp, Homo sapiens
  misc_feature: GYAE6OF02JOW0H.36.86.H09.1.454.CMB.1.raw
tcagtacgctgtctcacgaccggtgctcgatttagtgctatagacttgggtttgggggaggcttggtacagcctggcaggtccctgagactctcctgtgcagcctctggattcagtctttgatgattatggcatgcacgtgggtccgcaagctccgagggaacggcctggagtgggtctcgaggttattaggtaggaactaggtggtaggactaggctagtggcggacttcgtggtaggaaacggggccctaattccgaggcaagtcctaccgaagacgaaccaaccggccaaaagtaacctttcccctagtaatacctaacgaaaattcggaaacctagttccaggagacgtctaggaacggaccaccgggtcctttaggtaactttacgtggtacgaacctaaaaaggtttgtttttaggaaggtttagtaaggtaaggtttaaacggtcttaacgtacgttaggtatagggtaccgtcgttacggggaaccgtaacgggtacccgtaaccggtccgacccgtttacctcccgtacgtaccggccctacccgaaccgacccgggtaccctaaccggttcccggttaccccttccccggtacggcccgtacccgtcgtacccgtaccgtacggaccgtacccgaacccgttccgaaggaccgacgaccgacggtcccggacccgttcgggccgttaccgaccgggtcgtaccgaaccggtacccgttaccgttaacccgacggtaccgtaccggtaccgtacgg

SEQ ID NO: 76459 - DNA, 624 bp, Homo sapiens
  misc_feature: GYAE6OF02GVH5U.36.86.H09.1.454.CMB.1.raw
  modified_base (251)..(251): a, c, t, g, unknown or other
  misc_feature (251)..(251): n is a, c, g, or t
  modified_base (331)..(331): a, c, t, g, unknown or other
  misc_feature (331)..(331): n is a, c, g, or t
  modified_base (340)..(340): a, c, t, g, unknown or other
  misc_feature (340)..(340): n is a, c, g, or t
  modified_base (475)..(475): a, c, t, g, unknown or other
  misc_feature (475)..(475): n is a, c, g, or t
tcagtacgctgtctcacgaccggtgctcgatttagtgctatagacttgggtttgggggagggcttggtacagcctggcaggtccctgagactctcctgtgcagcctctggattcagctttgatgattatggcatgcactgggtccggcaagctccagggaagggcctggagtgggtctcaggtattagttggaacagtggtaggataggctatgcggacctctgtgaagggccgattcagcatctccaganacaacgccaagaattccctagtactctaacaaaatcgaaacagtctgagagctagaggacacggccttgttactactgtnacaaaagtntttgattagagttagtaaggtctaactacgtacgtagtggtacgtcgtaggggacctaacggggaccaccggtcaaccgtcctccgtcacgccctaccaccgaaggggcccctagtccggttacccttcccccgngggccctcccgtgcctacccgagggtaccgcctaaccccgtcgaacgacgtccgaacacgggccggccccgtggggtccccgttacggccgttagggtaccaaacgggtacccttacccgttacgaccgtaccgacggtaccgttccgg

SEQ ID NO: 76460 - DNA, 590 bp, Homo sapiens
  misc_feature: GYAE6OF02GRQBG.36.86.H09.1.454.CMB.1.raw
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
  modified_base (434)..(434): a, c, t, g, unknown or other
  misc_feature (434)..(434): n is a, c, g, or t
tcagtacgctgtctcacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctggctcagcctgcctccgtntctgggtctcctggacngtcgatccacatctcctgcactggaaccngcagtgacgttggtgttataattgtctctgtacaacagcaccggnaactcgaccccaaaatcatgtatttangacgtcactcactcgccttgacgggtttactaatcgtcttctctgctataccaagtctcggacaacgaccggtcctcctcaccgactctcgtcggtctaccacgggtctggacggacgagtacgttaaatttntttcgagtctagttactacgtaactaacctaaccacgtacctaacctactcgtacgtaccgttacgttaccgggacggtaacggaacccgaagtccgtaccgtaccgtaccttaacgtccgtaaccggacccgaacggtcccgtacccgtcccccg

SEQ ID NO: 76461 - DNA, 688 bp, Homo sapiens
  misc_feature: GYAE6OF02F5L4A.36.86.H09.1.454.CMB.1.raw
tcagtacgctgtctcacgaccggtgctcgatttagtgctatagacttgggtttggggagctctgggagaggagccccagccctgagattcccaggtgtttccattcagtgatcagcactgaacacagaggactcaccatggagttgggactgagctggattttcctttggcttattttaaaggtgtccagtgtgaagtgcagctggtggagtcgtgggggaggtcttggtacagccgtggcaggtccctgagactctcctgtgcagcctcgtggattcagtctttgattgattagtggcagtcgcctacggtcggggtcccgacaacggtcccgtaccggaagggggtaaccgggtccgtaggggtaacggttcggggtcctacggtaaggggtttagttaacgggtttacggaaacgtaggggttagggtaagggtaagttaggggcttaaggtcgggtacggtaacgttccggtggtaacgggtaacggggtaccgtacgtttacgaacgtacgtactccgtaccgaaggacgaaccgaaccgacctaaagtaaccttcccgtagtacttacctaactaaagtacgaaacgtagtctaggacgtacgcgtacggaacggacgtaccggtactttagtaactttacgtaggtacgtaacgtaaaggtttcgtttaggttagttaagg

SEQ ID NO: 76462 - DNA, 563 bp, Homo sapiens
  misc_feature: GYAE6OF02J15YD.36.86.H09.1.454.CMB.1.raw
  modified_base (228)..(228): a, c, t, g, unknown or other
  misc_feature (228)..(228): n is a, c, g, or t
  modified_base (266)..(266): a, c, t, g, unknown or other
  misc_feature (266)..(266): n is a, c, g, or t
tcagtacgctgtctcacgaccggtgctcgatttagtgctatagacttgggtttggggggggtctcaggaggcagcgctctcaggacatctccaccatgacctgggctctgctgctcctcaccctcctcactcagggcacagggtcctgggcccagtctgccctggctcagcctgcctccgtgtctgggtctcctggacagtcgatcaccatctcctgcactggaaccngcagtgacgttgtgttataatttgtctctggttcaacngcattcagcagccgcccgtaaactcttaattatgaggttctttcgtcggtccctcgtaggggtttctagtccgtcttctacccggctccaagtctggcaacacggcctccctgaccatcctcgtacgactcaggctggaggacgacggtctagtactattattcgcgagtctcattatactagaagtactaagttggtactaccgtacgtgcgttgttacgggacggtacgggaacctaggttacgaccgttaccgtaggtcgacgacccgaggtcccgtacggcccccgttaccgg

SEQ ID NO: 76463 - DNA, 541 bp, Homo sapiens
  misc_feature: GYAE6OF02F3F8P.36.86.H09.1.454.CMB.1.raw
  modified_base (229)..(229): a, c, t, g, unknown or other
  misc_feature (229)..(229): n is a, c, g, or t
  modified_base (270)..(270): a, c, t, g, unknown or other
  misc_feature (270)..(270): n is a, c, g, or t
  modified_base (381)..(381): a, c, t, g, unknown or other
  misc_feature (381)..(381): n is a, c, g, or t
  modified_base (399)..(399): a, c, t, g, unknown or other
  misc_feature (399)..(399): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
  modified_base (532)..(532): a, c, t, g, unknown or other
  misc_feature (532)..(532): n is a, c, g, or t
tcagtacgctgtctcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataatttgtcttcctggtaccaanacgccacccgggcaatcgacccccaaaatcatgtatttagtgacggtcactcacgtccggccctcgtaggggttttccaagtcgtcttctctgcatccaagtctagcaacnccggtcctcccgtgaccntcctcgtgggcctcgaggtctggacgcgagtntaattattcntctagttcatataacaccagacctaaccactctgtactagtcgggacggacggaacagcgtacgtacctaccgtacgcacgccgaggtccnccgtccccg

SEQ ID NO: 76464 - DNA, 730 bp, Homo sapiens
  misc_feature: GYAE6OF02GXCBV.36.86.H09.1.454.CMB.1.raw
  modified_base (187)..(187): a, c, t, g, unknown or other
  misc_feature (187)..(187): n is a, c, g, or t
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (281)..(281): a, c, t, g, unknown or other
  misc_feature (281)..(281): n is a, c, g, or t
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
tcagtacgctgtctcacgaccggtgctcgatttagtgctatagacttgggtttgggggggtcgttcgagggaggcgagcggctctcaggacatctccacatggcctgggctctgctgctcctcacccgtcctcactcgagggcacgagggtcctgggcccagtctgccctggctcagcctgcctcgngtctgggtcncctggacngtcgatcaccatcnccngacactggaaccngtcagtgacgttggagtataattgatcctggacaactagcaccggnatcggaccccaaatcactgattancgagtcatcatacggcctacagggttactaatcgcttactcngccattacgaatctaggccaaacgccggtacctaccctggaaaccctatccgttacgcgggtacccttacccgaaggtcccgtaaggacggggtaaccaccggggttaagtaaaacgtttttaaaccgtttctaacggtcccgttaagggttttacaacgttaaaaccgtttaaccgaaaaacccttacggaaacccgaaaaccttaaaccgttcttaaccgtaacgtttaacgtttaccggggtaacccgggaacggggggttaaaccccaaaagggtccgtaaccgtttaacccccggggtaaccccgttttaaagggaaccccgttaacggacccccgttttaaaacggggggcccttaaccccgggttacccccccggg

SEQ ID NO: 76465 - DNA, 577 bp, Homo sapiens
  misc_feature: GYAE6OF02GIHBR.36.86.H09.1.454.CMB.1.raw
  modified_base (277)..(277): a, c, t, g, unknown or other
  misc_feature (277)..(277): n is a, c, g, or t
  modified_base (321)..(321): a, c, t, g, unknown or other
  misc_feature (321)..(321): n is a, c, g, or t
  modified_base (329)..(329): a, c, t, g, unknown or other
  misc_feature (329)..(329): n is a, c, g, or t
  modified_base (449)..(449): a, c, t, g, unknown or other
  misc_feature (449)..(449): n is a, c, g, or t
  modified_base (564)..(564): a, c, t, g, unknown or other
  misc_feature (564)..(564): n is a, c, g, or t
tcagtacgctgtctcacgaccggtgctcgatttagtgctatagacttgggtttgggggaggcttggtacagcctggcaggtccctgagactctcctgtgcagcctctggattcagctttgatgattatggcatgcactgggtccggcaagctccagggaaggcctggagtgggtctcaggtattagttggaacagtggtaggataggctatgcggactctgtgaagggccgattcagcatctccagagacaacgccaagaattccctagtatctaanaatgaacagtctgagagctgaggacacggccttgtattactgtnacaaagtntttgagttagagttagtaggtctactacgtacgtatggacgtcgtgggaccaagggacccacggtcaccgtctcctcacgccctaccgaccaacgggcccagtccggtcccttcccccgnggtcccgtcccgtagccttaccgaggacgcctaccgtccgaggacacaccgacggcccggtccgtcgggctcggccgtcggtaccgaaggttaccttaccgttaccgaggtaccncggtaccgtacgg

SEQ ID NO: 76466 - DNA, 695 bp, Homo sapiens
  misc_feature: GYAE6OF02HAKQQ.36.86.H09.1.454.CMB.1.raw
  modified_base (230)..(230): a, c, t, g, unknown or other
  misc_feature (230)..(230): n is a, c, g, or t
  modified_base (265)..(265): a, c, t, g, unknown or other
  misc_feature (265)..(265): n is a, c, g, or t
tcagtacgctgtctcacgaccggtgctcgatttagtgctatagacttgggtttgggggggggtctcaggaggcagcgctctcaggacatctccaccatggcctgggctctgctgctcctcaccctcctcactcagggcacgagggtcctgggcccagtctgccctggctcagcctgcctccgtgtctgggtctcctggacagtcgatcaccatcctctgcactggaaccngcagtgacgttggtagttataattgtctctgacangcaccggcatcaccccaaatcatagattatgagtcactcactccgcctcgtacgggtttctaactcgtcttctctcgcactccaagtctcgacaccgtaccggtccctccctacgacctactccgtacggtcggtcctaccggaggtccgtacgggaacgggtaccggacggttaactttaaacgttttacgttcgttacggtcgttaacggtttacaactttaacctaaacccgtaaacctacggtaacctaaacccgttaccgttaccgttacgttacgttacccggtttaccggggaccggggtaaaccgggtaaaccccgtaacgggttacccgttaacccgggttaacccgtttacccgtaacggttacccggaacccggttaaccccggtaaccgggtcccgttaccccgggtttaccccccgg

SEQ ID NO: 76467 - DNA, 580 bp, Homo sapiens
  misc_feature: GYAE6OF02FTDO5.36.86.H09.1.454.CMB.1.raw
  modified_base (336)..(336): a, c, t, g, unknown or other
  misc_feature (336)..(336): n is a, c, g, or t
  modified_base (418)..(418): a, c, t, g, unknown or other
  misc_feature (418)..(418): n is a, c, g, or t
  modified_base (458)..(458): a, c, t, g, unknown or other
  misc_feature (458)..(458): n is a, c, g, or t
tcagtacgctgtctcacgaccggtgctcgatttagtgctatagacttgggtttgggggaggcttggtacagcctggcaggtccctgagactctcctgtgcagcctctggattcagctttgatgattatggcatgcactgggtccggcaagctccaggggaagggcctgggagtgggtctcaggtattagttggaacagtggtaggataggctatgcggactctgtgaagggccgattcagcatctccagagacaacgccaagaacttccctgtatctaacaaatgaacagtctgagagctgaggacacggtccttagtattactgtgacaaaagtnttttgagtttagagttagtaaggtctactactacggtatggacgtcgtaggggaccaagggaccacggtcaccgtctcctcncgccctaccaccgaacgggcccagtccggtccttccccgnggccctccctgccctccgaggacgccaccgtaccggagacgccacgacggcccggccgtgggctcggtccgtggtaccgaacggtaccttaccgttaccgaggaccgacggtaccgtaacgg

SEQ ID NO: 76468 - DNA, 651 bp, Homo sapiens
  misc_feature: GYAE6OF02FSSNP.36.86.H09.1.454.CMB.1.raw
  modified_base (287)..(287): a, c, t, g, unknown or other
  misc_feature (287)..(287): n is a, c, g, or t
tcagtacgctgtctcacgaccggtgctcgatttagtgctatagacttgggtttgggggggagaggagccccagccctgagattcccaggtgtttccattcagtgatcagcactgaacacagaggactcaccatggagttgggactgagctggattttccttttggctattttaaaggtgtccagtgtgaagtgcagctggtggagtctgggggaggcttggtacagcctggcaggtccctgacgactctcctggtgcagcctgtggacttcagcttttgatgattanggcatgcacgtgggtccggcaagcctccgaggggaacggcctgggagttggggtctcgaggttattaggtcggaacgtggttagggtaggtagttaggacttagtggccggtaatcgtaggtaggaacgggtccgtagttcgagctatcgtaccgagtacgaacaaccgtaccgaaacgtaactttccccgtagttaacctacgttaaaccaaacgttacgaaacgtacgttacgtaggtaacgagtacgtacgggaacggtaccggaccggttacccgtttaggttaactttacgtacggtacgaacgttaaagttacgttttacggtaaggtttaaggtaggtttacggttaggtttaaccg

SEQ ID NO: 76469 - DNA, 543 bp, Homo sapiens
  misc_feature: GYAE6OF02H5ISB.36.86.H09.1.454.CMB.1.raw
  modified_base (417)..(417): a, c, t, g, unknown or other
  misc_feature (417)..(417): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctggggtctcctggacagtcgatcaccatctcctgcactggaaccagcagtgacgttggtggttataaatttgtctcctggtaccaacagcacccgggcaatgcccccaaaatccatgatttatgaggtcactcatcggccctcaggggtttctaatcgcttctctgcatccagtctgcacacggcctccctgaccatctctgggctccgagctgacggtacgacggctaattntttctgccagttccaattactacaaccctagccaactactctacgcgttattcggcgggtacgggccaaggcctacggtacccgtccgtacggtcaacggccctaacggtcctacggtaccccccg

SEQ ID NO: 76470 - DNA, 578 bp, Homo sapiens
  misc_feature: GYAE6OF02FUHHT.36.86.H09.1.454.CMB.1.raw
  modified_base (429)..(429): a, c, t, g, unknown or other
  misc_feature (429)..(429): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataatttgtctcctggtaccaacacgcacccgggcaactcgaccccaaaatcatgtatttatgaggtcactcatccggcctcgtagggttctaacgtcgtcttctctgcatcaagtctcgcaacacgcctcctcgaccactctcgtcgggtcctcgacggctggacggacgtaggacttaattntttcgtgtctagttactattaactaacaaaccagacctaaactactcgtcgtaccttacgtacgggacgggacgggtaaccgtaagtccgtacggtacccgttaccgtaacggtccacgtacccgtaacggtccctcccggtacccccg

SEQ ID NO: 76471 - DNA, 796 bp, Homo sapiens
  misc_feature: GYAE6OF02I38F2.36.86.H09.1.454.CMB.1.raw
tcagtacgctgtctcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctggctcagcctgcctccgtgtctgggtctcctgacagtcgatcaccatctcctgcactcggaaccagcaaggtgacggtttggtaggttataaaatttgtctacccgtggttaaccaaacagcccgacccgggacaactccgaaccccctaaaaatccaatgtaatttatgaaggtcactcactcggcctcgtagggtttctaatcgtccttctcgttcgcaactactaaagttctacggtaccgaaacctacccgggacccttaccccgtagaaccccgtaactttccgttccggttacggggtacccttaccccggaaggtccgttaggggaaaccgggtaaccgggtaagggttaactttaaaaccgttttaattttaccgttacgggtaccgttaacggttcctaaatttaaacctaaaacccgtaaaccgaacgttaacccaaaacctacccgttttaacgtaccgtaactttaaccggtttccggggaccggggaaaacgggtaacccgtaaaacgggtcccgttaacccggggttaaaccccgtttaacccggttaaaccggtacccggtaaaccggtaccccccggtaaaacggggtccccttaccccgggtaaccccccccggg

SEQ ID NO: 76472 - DNA, 791 bp, Homo sapiens
  misc_feature: GYAE6OF02F66L9.36.86.H09.1.454.CMB.1.raw
  modified_base (129)..(129): a, c, t, g, unknown or other
  misc_feature (129)..(129): n is a, c, g, or t
  modified_base (141)..(141): a, c, t, g, unknown or other
  misc_feature (141)..(141): n is a, c, g, or t
  modified_base (183)..(183): a, c, t, g, unknown or other
  misc_feature (183)..(183): n is a, c, g, or t
  modified_base (229)..(229): a, c, t, g, unknown or other
  misc_feature (229)..(229): n is a, c, g, or t
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
tcagtacgctgtctcacgaccggtgctcgatttagtgctatagacttgggtttggggggggtcgtcaggaggcagcgctctcaggacatctccaccatggcctgggctctgctgctcctcaccctcctnactcagggcacngggtcctgggcccagtctgccctggctcagcctgcctccgtntcgtggtctctggacagtcgatcaccattcctctgcacgtgaaccngcagtggacgttggtagttattaattgtctcctagtacctaacncgaccgacccgganactaccgacccgaaaatcacgtactagttatacggacgtcacgtactacgtccgtacctcggtagggtttactaactcgtactttcgtactgactactacgtactacgtcgaacctaacgccggtcccttaccgtacgtaccgtacgtccttcggtcgggtacccttcgacggtcgacggtacggaaacggtacggtactttaacgtttaacgttttccgtacggttaccgtacggtttaaccttaacgttacttaaacccgtaaaccggaaaccgttaaaccgaaacctttaaacccgtcttttaacgggtttaaccgttaaaccccgggttttgggggaaaacccccgggttaaccggggtaaccggttaacccgggtaaccggttaacccccgggttaaacccggtttacccgttttaaacccgggggaacccttaaccccgggggtaaacccccgttacgggggttacccccggttacccccggtttaccccccccgggg

SEQ ID NO: 76473 - DNA, 718 bp, Homo sapiens
  misc_feature: GYAE6OF02HYZ8D.36.86.H09.1.454.CMB.1.raw
  modified_base (227)..(227): a, c, t, g, unknown or other
  misc_feature (227)..(227): n is a, c, g, or t
tcagtacgctgtctcacgaccggtgctcgatttagtgctatagacttgggtttggggggggtcgtcgagggaggcagcgctctcaggacatctccaccatggcctgggctctgctgctcctcaccctcctcactcgagggccacagggtcctcgggcccagtctcgcccgtggctcacgcctgcctccgtgtcgtgggtctccgtggacagtcgatcaccatctccngacactacggaaccagtccgaaggtgtacggttgggtaggttaattaaagtttgtactctacggtaaccaacacgaccgacccggataacgtaccgaaccccaaaaactacaattacgtaatttaacgtaggaacggtcctaacttcaacgttcccggtaccccttaggtacgggtttacctaaacgtccgtcttctctcgtactaactacgaacgttccgtaggtacaaccgacccggtcccttacccgtacgaacctacttccgtcgtacgggtcctaccgaggtccgtaaggacgggtaaacgaacggttactttaactttaactttcgtacgtacgtaacgttactaattaaactaccaaaccgactaaccaaaccttctactacgtacgttaacggtaccgggtacgggtaacggaaccggtaacgaccgtaccgtaacccgtacgtacgtaccgaccgacccgtaagccccgtaccgtcccccgg

SEQ ID NO: 76474 - DNA, 678 bp, Homo sapiens
  misc_feature: GYAE6OF02IARR3.36.86.H09.1.454.CMB.1.raw
  modified_base (146)..(146): a, c, t, g, unknown or other
  misc_feature (146)..(146): n is a, c, g, or t
  modified_base (494)..(494): a, c, t, g, unknown or other
  misc_feature (494)..(494): n is a, c, g, or t
  modified_base (521)..(521): a, c, t, g, unknown or other
  misc_feature (521)..(521): n is a, c, g, or t
  modified_base (545)..(545): a, c, t, g, unknown or other
  misc_feature (545)..(545): n is a, c, g, or t
  modified_base (568)..(568): a, c, t, g, unknown or other
  misc_feature (568)..(568): n is a, c, g, or t
  modified_base (596)..(596): a, c, t, g, unknown or other
  misc_feature (596)..(596): n is a, c, g, or t
tcagtacgctgtctcacgaccggtgctcgatttagtgctatagacttggggtttgggggggggtctcaggaggcagcgctctcaggacatctccaccatggcctgggctctgctgctcctccaccctcctcactcgacgggcacgngggtccgtcgggcccagtctcgccctgactcagcctgcccgtcgtgtcgtcgggtctccgtaggactagtcgataccaccattctcctgacctaacgtacggaaccaggctaggtagtacgggtttggttaagtttaattaacctttgtccttaccgttacggaaccaacgaccgaccctaacccgagggcaaacggaacccaaccccctaaagtctaaatcgttaagtttagacggtaaggtaaccaaagtaaaccgtcccggtaccgttaggttacgggtttccaaggtccttcgtccgttactcgcgtacctaacgacgttcgcggacgactacccggcctaccncgtaactgtcttccggcgtaaccgccnggtaccgacggaacggcgacggtntacgtaattccgagtacgctacnccgtaatactaaagtacgaagactacgnaacccttcgtcgttcgtacgtacggtaacggaggctaaacgttcagttcgtaacgacgtacgaacgacccgaacgtaacccg

SEQ ID NO: 76475 - DNA, 655 bp, Homo sapiens
  misc_feature: GYAE6OF02I9N9R.36.86.H09.1.454.CMB.1.raw
  modified_base (170)..(170): a, c, t, g, unknown or other
  misc_feature (170)..(170): n is a, c, g, or t
  modified_base (174)..(174): a, c, t, g, unknown or other
  misc_feature (174)..(174): n is a, c, g, or t
  modified_base (234)..(234): a, c, t, g, unknown or other
  misc_feature (234)..(234): n is a, c, g, or t
  modified_base (275)..(275): a, c, t, g, unknown or other
  misc_feature (275)..(275): n is a, c, g, or t
tcagtacgctgtctcacgaccggtgctcgatttagtgctatagacttgggtttggggggggtctcaggaggcagcgctctcaggacatctccaccatggcctgggctctgctgctcctcaccctcctcactcagggcacgagggtcctgggcccagtctgccctggctcngccngcctccggtgtctgggtcctcctggacagtcgatccaccattcctctgcactcggaaccngcagtggacgttggtagttatattatgtctctgttaccaangctattcagcacggccgacccgtaacttcttaattagtggtcgttctttcgtccgtcctgtacggggtttctacggtccgtcgttcgtccggtcttccgtagtcgtggacctaaacgccggtccctcccgtacgacctacgtcctcttacgtacctcgaggtacgtcggaagacgggtacgtacgtaggtacctttaagtttaacgttcgtacgcgtacctacttaacttaactttaaccgtaggtaacgttacgtaagttcgttaaccgtcccgttaacgtcgggttcgttacgggttcggggacgggtacggttaaccgtacggtcgtaccggttacgtcggttacaccggacccgaacccggtacccacccgtaccg

SEQ ID NO: 76476 - DNA, 641 bp, Homo sapiens
  misc_feature: GYAE6OF02G000W.36.86.H09.1.454.CMB.1.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (293)..(293): a, c, t, g, unknown or other
  misc_feature (293)..(293): n is a, c, g, or t
tcagtacgctgtctcacgaccggtgctcgatttagtgctatagacttgggtttgggggggtctcaggaggcagcgctctcaggacatctccacatggcctggctctgctgctcctcacctcctcactcagggcacagggtcctgggcccagtctgcctggctcagcctgcctccgtgtctgggtctcctggacagtcgatcaccatcnctagcactggaaccngcagtgacgttggngttataattgtntctggtaccaactgcaccgggcaatgcccaaaatcatgatttangagtcactcatcggcctcgtagggttctaatcgctttctctcgcgaatccaaagtctcgggacaaccgtacggcctccctgaccctaatccgtctcggggaccttcccgaacggtcttacgacgggtaaccggtacgggcttacggaactttaacgtttaagttacggccgtaaggtactaccgtaagttaacttacgtacgtaaacgttaccgtaaattacgggtaactcccgaacgtttcgggtaccgttggtttaccgggaccggtaacgggggtaaccctaaaggttttcggtaacccggttccccgttaagggttacccgtaacggttaccccggtaaaccgg

SEQ ID NO: 76477 - DNA, 727 bp, Homo sapiens
  misc_feature: GYAE6OF02G00CU.36.86.H09.1.454.CMB.1.raw
  modified_base (291)..(291): a, c, t, g, unknown or other
  misc_feature (291)..(291): n is a, c, g, or t
tcagtacgctgtctcacgaccggtgctcgatttagtgctatagacttgggtttggggagctctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggtagtcgttggacaggcctggcaggtccctggacgaccttctccgtgtgcagtccctcgtggtattcngtctttgattgtattagtggctagtcgcgtaccggtcgggtcccggacgaacgtccgtaccgggaacgggggtacgggtccgtaggggtacgggttccgggttaccgtacggtaagggtttaacgtttaaggtttacgggaaacgttaggggtagggttaagggacgttagggtaccgttaaggtcgggtaccgtaccgttggtagggtaacgggtaacggggtacccgtagttccgaaggtcctaacgttccgaccgtaagaccggaaccaaaccggcccgtaaagttacccgttacctaggttaacttaactaaacgaacgttagaaccgtagttcgagacgtacgagtacgggaacggtcccgtacggttacctggtttaacttacggtcgttacgaaacgttaaaggtttcgtttacggttaaggttaacgg

SEQ ID NO: 76478 - DNA, 867 bp, Homo sapiens
  misc_feature: GYAE6OF02HZC8F.36.86.H09.1.454.CMB.1.raw
tcagtacgctgtctcacgaccggtgctcgatttagtgctatagacttgggtttgggggaggcttggtacagcctggcaggtccctgagactctcctgtgcagcctctggattcagtctttgatgtattagtggcatgcacgttcgggtcccggacaagccgtaccgaaggggaacggtccgtggaggttgggtcctagaggttattaggtacgaacgaggttaggtaaggagtaggctaagtcggacgtacttgtggtaggaacgggaccgtattcgagtacctaattccgtacgaaaggacgaaaccgtaaccgaccgtaaaaggtaaccctttcccgtagtaacttacgtaaactaaacgtacggtaaacacgttcgaaggaacgtacggtacctaggaacggtaccgtaccggtttacttacgttaagttaacgtcgtaaaggtaacgttaaaaagtttgtttaaggtaggttttaaaggaacgttaaggtaacgttactaacgttaacgtacggtagttacggcgttaccggacgggaacaaggacccgtacggtacgtacccgtccgtaccgtacgtccgtaccctacggaacccggtaaccgaccgttaccgtttcccggtacccccgtttcccggacggtcccgtaccccgttcggtaccccgtaaccggtaaccgggtacccgtacccgtaccccggtaaccggtaagacccggaacccgaccggttacccgggccccgggttaaccggtcggggtaacccgtccggttacccgggtaaggtaaaccccgggtaccggtttaacccggttaacccgtaccggttaaacgggaccttaccggggttaccgtaacccgggg

SEQ ID NO: 76479 - DNA, 619 bp, Homo sapiens
  misc_feature: GYAE6OF02F6CXJ.36.86.H09.1.454.CMB.1.raw
  modified_base (291)..(291): a, c, t, g, unknown or other
  misc_feature (291)..(291): n is a, c, g, or t
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
tcagtacgctgtctcacgaccggtgctcgatttagtgctatagacttgggtttgggggggagaggagccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggaggcttgggtacacgcctggcaggtccctgagactctcctggtgcagcctctagattcagctttgattgattagnggcatcgcacgtgggtccggcaaggctcggaggggacgggcctgggngtgggtctgaggtattaggtggaanggtagggtaggatagggctagtggcggtacttcgtaggtcggaacgggtccgtagttcaaggtctatcctaccgaagacgacaacggtaccaaggtaacttccctagtacctacgtaaaccgtaaatacggtaacacggttcgtacgaagtacgcgtaggaacgggacctacgggtcctttagggtaactttacgttggtaacgtaacgtaaaggttactttggttaaagtttaggtaggttacgttaacgggtac

SEQ ID NO: 76480 - DNA, 792 bp, Homo sapiens
  misc_feature: GYAE6OF02FISXS.36.86.H09.1.454.CMB.1.raw
tcagtacgctgtctcacgaccggtgctcgatttagtgctatagacttgggtttggggagctctgggagaggagccccagccctgagattcccaggtgtttccattcagtgatcagcactgaacacagaggactcaccatggagttgggactgagctggtattttcctttggcttaattttaaaggtgtccagtgtgaagtgcagcgtggtggagtcgtgggggagtcgttggtacagcctggcaggtccctgagacctcgtcctgtcgccaggcccttcgtaggtacttcgaggttccttttagtagttgtaatttagtcgggactaaggttcgccgtaacggttcgggggtacccgtacgaaacggtcccgttacccgggaacgggggtaacggggtcccgttagggggtaacggttcggggtacccttacgggtaaggggttaacgttttaacgggttaacgggaaaacggtagggttaggggtaacggtaaggttaacgggtacgttacgggtcggtaccggggtacttcggtacgggtagggaacgggttcccgtattacggacgtactacgtccctacggaagacgtaaccaacgtaccgtaaagtaccttcccgtagttaaccttaccgtaaactaaacgtacgtaaacgtacgtacgtaagacgggtagtcgtaacgggaaccggtaaccggtacggttacccgtttaaggttaaccgtttaacggtcggttaaaccggtaaacttaaagggttttacgtttttaagggaaggtttttaacgggg

SEQ ID NO: 76481 - DNA, 757 bp, Homo sapiens
  misc_feature: GYAE6OF02GXD6E.36.86.H09.1.454.CMB.1.raw
  modified_base (297)..(297): a, c, t, g, unknown or other
  misc_feature (297)..(297): n is a, c, g, or t
tcagtacgctgtctcacgaccggtgctcgatttagtgctatagacttggggtttggggggggggtctcaggaggcagcgctctcaggacatctccaccatggcctgggctctgctgctcctcaccctcctcactcgagggcacgagggtcctgggcccagtctcgccctggctcagcctgcctccgtgtcgtgggtcctccgtggacagtcgactccaccgatcctcctgcactcggaaccagcagtgacgttggtagttaattaattgtctctggtaccacagccgaccggacacnccgaccccaaatcatgtattagtggtacggtccactacgtacgtccggtccgttacggtacggggtttactaacgtcgttaccttctcgtcgacctactaccgtaacggttccgtacggaccaaccgtacccggtaccccttacccgtacgtaccctacgttccgttcgggtccggtccgtaccgtacgggtaccgttacgggaacgggtaccggtaacggttaactttaagtttaccgtttccgtagttaccgtaacgtttactaacgttaaacctaacccgaacgaaccgtaacctaaaccgttaccttacgttaccgttacgttaccgggtaccggggaaccgggtaaccgggaccgtaaaccggtccgttaaccgggttaaccccgttaaccggtaaccggtttaccgaaacccggtacccggtaacggtccccggttaccccggtaacccccggg

SEQ ID NO: 76482 - DNA, 715 bp, Homo sapiens
  misc_feature: GYAE6OF02F0O0F.36.86.H09.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
  modified_base (291)..(291): a, c, t, g, unknown or other
  misc_feature (291)..(291): n is a, c, g, or t
tcagtacgctgtctcacgaccggtgctcgatttagtgctatagacttgggtttgggggggggtctcaggaggcagcgctctcaggacatctccaccatggcctgggctctgctgctctcaccctcctcactcagggcacgagggtcctgggcccagtctgccctggctcagcctgcctccgtgtctgggtctcctggacngtcgatccacctatcctcctgacacgtcggaaccngctagtgtacgttggtcgtcttaataattagtgttcctccgttaggttaccaaacngtctagttcgaggccgacggtcccgaccccgtaaaactttacctttaaatttacgtaggtacggtttcttttaccggcccgggttcccttaggttggggttttactacggttccgtcgtttccggccggtcctaccgtaaggttcgtacggaacctaaccgtccgtccccttcccgtacgaacccgtacttccgttaccgtacgtacccgtccgtacgggtccgtaacgggtacgggaaccggtacgggtcgttaacgttaacgttaagttttacgttacgcgtacgcctaacgttagtacttacgtagttaacgtactagttacgtactcgtacgtggtacttggtccgggacggtaacggacgttaacggttaccgtaccgttaccggtcggtacgaaccgccgtacggccgttacccccgg

SEQ ID NO: 76483 - DNA, 621 bp, Homo sapiens
  misc_feature: GYAE6OF02G7KYT.36.86.H09.1.454.CMB.1.raw
  modified_base (231)..(231): a, c, t, g, unknown or other
  misc_feature (231)..(231): n is a, c, g, or t
  modified_base (291)..(291): a, c, t, g, unknown or other
  misc_feature (291)..(291): n is a, c, g, or t
  modified_base (320)..(320): a, c, t, g, unknown or other
  misc_feature (320)..(320): n is a, c, g, or t
  modified_base (461)..(461): a, c, t, g, unknown or other
  misc_feature (461)..(461): n is a, c, g, or t
tcagtacgctgtctcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctcgccctggctcagcctgcctccgtgtctgggtctcctggacagtcgatcaccatctcctgcactcggaaccngcagtgacggttggtgttaattaatttcgtcttcctggtaaccaacacgcccgacccggnaactccgacccccaaatcatcgtatttangtagtcactcacgtccggcctcggtacgggtttactacgttcgtcttctctcgactacgtccaagtctgaccaacgaccgtccctcctacgaccacgtctcgtcggcctcgagcgtagaggacgacgtattaattcttacngtctacgttacattaactacccaaacacgtaacaacctactctacgttacttacggtacggaccgggaacgggtaacccgtacgtaccggtaccggtaacccgtttacggtaaccgtaccggacccgtaacccggtacggtacccgtccttaccccccgg

SEQ ID NO: 76484 - DNA, 777 bp, Homo sapiens
  misc_feature: GYAE6OF02F500P.36.86.H09.1.454.CMB.1.raw
  modified_base (196)..(196): a, c, t, g, unknown or other
  misc_feature (196)..(196): n is a, c, g, or t
tcagtacgctgtctcacgaccggtgctcgatttagtgctatagacttggggtttgggggggggtctcaggaggcagcgctctcaggacatctccaccatggcctgggctctgctgctcctcaccctcctcactcagggcacgagggtcctggggcccagtctcgccctggctcagcctgcctcgtgtctggtctcnggacagtcgatcaccatctcctgccacgtcggaaaccagcgagtgtacggtggttaggttattaattgtcctccgtaggtaacctaacacggccacccgggactactacgaccccctaaaatcaactgtaatttagtaggacggttactacctcgtaaccgttccggtaccccgttcggttacggggtttacctaacgtccgttcttccgttctcgtacctacgtacccttaaaggtcctacgggacctaaaccggacccggtccccttaccccgtacggaacccttaccgtttccgtaccggttcgggcccttacccggacggtccggttacggggacgggtaaccgggtaaccgtactttaagttttaccgtttaccgttcgtacgttacggtttaactaacgttaacctaaaccgtaaacccgacgtaacctaaaccgtaccttaccgttaggtaccgtttacggttccgggggaccgggtaacgggtaccgaacggttccgtaacggtaaccccgttacggttaaccggttaccgaccccgtacccggaacggttcccgtacccggttaccccccgg

SEQ ID NO: 76485 - DNA, 676 bp, Homo sapiens
  misc_feature: GYAE6OF02HS0Y6.36.86.H09.1.454.CMB.1.raw
  modified_base (187)..(187): a, c, t, g, unknown or other
  misc_feature (187)..(187): n is a, c, g, or t
  modified_base (301)..(301): a, c, t, g, unknown or other
  misc_feature (301)..(301): n is a, c, g, or t
  modified_base (328)..(328): a, c, t, g, unknown or other
  misc_feature (328)..(328): n is a, c, g, or t
tcagtacgctgtctcacgaccggtgctcgatttagtgctatagacttgggtttggggagctctgggagaggagccccagccctgagattcccaggtgtttccattcagtgatcagcactgaacacagaggactcaccatggagttgggactgagctggattttccgttttggctattttaaaaggtntcagtgtgaagtgcagctggtggagtcgtgggggagtcttggtacagcctggctacggtcctgagacctctcctgtgcagcctcgtggacttcgagtctttgattcgatttagnggcaagtgctacgttggggcccggtanaaacgtcctacggaaggggtaacggtcccgtagggtacggtcgggtctacggtaggttacttagggtacggtaacgtgggttacggaaggtaatagggtactaagtcgacggtacgttcgtaggtaggacgggcgtacttacgacgtcacgttccacgtaagacgaaccgaacgtaccgtaagtaccttccgtaacgttaacgtactaaagtaaacgtcgaaacgtacgtacgacggaagtacgacgttacggaacggtaaccgtacggttaccgttagttaacgtttcgttaacggtcggtaaaacgttaaaagtttacggtttttaacggtacggttttaaacggg

SEQ ID NO: 76486 - DNA, 717 bp, Homo sapiens
  misc_feature: GYAE6OF02HO9AT.36.86.H09.1.454.CMB.1.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (388)..(388): a, c, t, g, unknown or other
  misc_feature (388)..(388): n is a, c, g, or t
tcagtacgctgtctcacgaccggtgctcgatttagtgctatagacttggggtttggggggggtctcaggaggcagcgctctcaggacatctccaccatggcctgggctctgctgctcctcaccctcctcactcagggcacgagggtcctagggcccagtctcgccctggctcgacgcctgcctcgtgtcgtgggtctccgnggacagtcgatccacctattccgtcctcgtccagtacggaaacccnggtcctaaggtcggtacggtttagggttaggtttaacttaaagttttcggtacctccggttacggtaacctaacgaaccggtccgaaccccgggctaaacgtcccggaaaccccctaaaaatccgtattagttaacttcgngtacggtcactcgacgtccggccttaggtacgttactacttcggtacttcgtgtcgtacgtactaccgtacgtcgtacggaactaccggtacccggtcccttccgtacgtaccgtacgtcctcggtacgtcgaccggtagtacgtacggacggtacgtacggtaacgttttaacgttacgttcgtagtacgtacggttacttaactaaaccgtaccgaactacgaactacctaacgtctgtacgttcggcgggtacggacggtacgaacgtctaaccggtaccttacggtacgacgtacgtaacccggtcggtaccgtccgtaccccgg

SEQ ID NO: 76487 - DNA, 869 bp, Homo sapiens
  misc_feature: GYAE6OF02HO9MQ.36.86.H09.1.454.CMB.1.raw
  modified_base (256)..(256): a, c, t, g, unknown or other
  misc_feature (256)..(256): n is a, c, g, or t
  modified_base (346)..(346): a, c, t, g, unknown or other
  misc_feature (346)..(346): n is a, c, g, or t
  modified_base (752)..(752): a, c, t, g, unknown or other
  misc_feature (752)..(752): n is a, c, g, or t
  modified_base (778)..(778): a, c, t, g, unknown or other
  misc_feature (778)..(778): n is a, c, g, or t
tcagtacgctgtctcacgaccggtgctcgatttagtgctatagacttgggtttggggagctctgggagaggagccccagccctgagattcccgaggtgtttccattcagtgatcagcactgaacacagaggactcaccagtggacggttggactgagcgtggtatttttcgtttgtcttaagtttaaaggtcgtccagttgtagaagtgacgtagcgttaggtggtagtcggtgggggtacgtcgttcgggtaacncggcgttgggacctaggtcccgtagagtacctcgtctggtcgctacgtcctcgtaggtcttcgcgttgttacgtatcgtaatttaccggngtcgtaacgtcggtacctcgggtttaccgggggccgtaaccgacgtccccggttaaacggggtaaacgggggtacccggggtaccggtttacggggtaagggttcccggttacggttaaccggggttaaggtttaaaccgggtttaacgggggttttaaacccgggaaacggtttacgggggtttaaagggggtttaaccggttaaacgggtttaaaccggggtccccgggtttttaaaggggtccgggttacccggtttaaccggttcccgggtttagggtaaccgggtaacgggtaccgttacgttaccggacgtaccgtaacggtactaaccggaacggtaaccgaacggacccgttaacgaacgttaaccttaccggttagtacgttaacctaacgtaaacnggttaacgacttacgtagtaccgggnacggtacgaccgggtactacccggttacgttaacggtaacgtttagtacggtacggaaacgtttacggttagttttaggaggtttaacggg

SEQ ID NO: 76488 - DNA, 249 bp, Homo sapiens
  misc_feature: GYAE6OF01B50ED.8.34.D01.1.454.CMB.1.raw
  modified_base (246)..(249): a, c, t, g, unknown or other
  misc_feature (246)..(249): n is a, c, g, or t
tcagctcgcgtgtccacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctccgagagcacagcggccctgggctgcctggtcaaggactacttccgacacgcgagctgagcgggctggcaaggcgcatagnnnn

SEQ ID NO: 76489 - DNA, 250 bp, Homo sapiens
  misc_feature: GYAE6OF01D352R.8.34.D01.1.454.CMB.1.raw
  modified_base (247)..(250): a, c, t, g, unknown or other
  misc_feature (247)..(250): n is a, c, g, or t
tcagctcgcgtgtccacgaccggtgctcgatttagatcgtctgtgttgggtttgggtgccgaagttgctggaggtcacggtcaccacgctgctgagggagtagagtcctgaggactgtaggacagcccatcggtcttccccctggcgccctgctccaggagcacctccgagagcacagcggccctgggctgcctggtcaaggactacttccgacacgcgagctgagcgggctggcaaggcgcatagnnnn

SEQ ID NO: 76490 - DNA, 251 bp, Homo sapiens
  misc_feature: GYAE6OF01BP0PD.8.34.D01.1.454.CMB.1.raw
  modified_base (246)..(251): a, c, t, g, unknown or other
  misc_feature (246)..(251): n is a, c, g, or t
tcagctcgcgtgtccacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctccgagagcacagcggccctgggctgcctggtcaaggactacttccgacacgcgagctgagcgggctggcaaggcgcatagnnnnnn

SEQ ID NO: 76491 - DNA, 269 bp, Homo sapiens
  misc_feature: GYAE6OF01DP6MD.8.34.D01.1.454.CMB.1.raw
  modified_base (175)..(175): a, c, t, g, unknown or other
  misc_feature (175)..(175): n is a, c, g, or t
  modified_base (238)..(238): a, c, t, g, unknown or other
  misc_feature (238)..(238): n is a, c, g, or t
  modified_base (244)..(269): a, c, t, g, unknown or other
  misc_feature (244)..(269): n is a, c, g, or t
tcagctcgcgtgtccacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctcgagagcacngccggccctgggctgcctggtcaaggctactccgacacgcgagctgagcgggctggcaaggcncatagnnnnnnnnnnnnnnnnnnnnnnnnnn

SEQ ID NO: 76492 - DNA, 248 bp, Homo sapiens
  misc_feature: GYAE6OF01B62OF.8.34.D01.1.454.CMB.1.raw
  modified_base (246)..(248): a, c, t, g, unknown or other
  misc_feature (246)..(248): n is a, c, g, or t
tcagctcgcgtgtccacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctccgagagcacagcggccctgggctgcctggtcaaggactacttccgacacgcgagctgagcgggctggcaaggcgcatagnnn

SEQ ID NO: 76493 - DNA, 523 bp, Homo sapiens
  misc_feature: GYAE6OF01ESD2T.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctccaggcccctcatctatggtgcatccaacagggccactggcatcccagccaggttcagtggcagtgggtatgggacagacttcactctcaccatcatcagcctggacgcctgaggatgttgctagtttattactgtcaacatcgtacgagtggccgtccggggcctaccgtttcggccctgggacccaaaggtcggatagtacgaaacgaactggtcgctgcaccatctgtcttctac

SEQ ID NO: 76494 - DNA, 522 bp, Homo sapiens
  misc_feature: GYAE6OF01BNORR.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacaggacttcactctcaccatcatcagcctggacgcctgaggatgttgctagtttattactgtacaacatcgtacgagtcggccgtccggggcctacgttcggcccgtcgggaccaaggtgatactacgaacgactggtcgctgcacactctcgtcttctac

SEQ ID NO: 76495 - DNA, 526 bp, Homo sapiens
  misc_feature: GYAE6OF01EN9MK.8.34.D01.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (387)..(387): a, c, t, g, unknown or other
  misc_feature (387)..(387): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcncctacgtatcctggtaccaacagaaacctggccaggcctcccaggcccctcatctatggtgcatccaacgagggccactggcatcccagccaggttcaggtgcaggtgggtatgggacagcttcactctcacatcatcanctgagcctgagatgttgctagtttatactgtacaactatcgtacgagtcggccgtccggggtcctcgtttcggcccgtacgggaccaagtgatacgtacgaaacgtatggtggctgactaccactctcgttcttctacg

SEQ ID NO: 76496 - DNA, 509 bp, Homo sapiens
  misc_feature: GYAE6OF01AW9RJ.8.34.D01.1.454.CMB.1.raw
  modified_base (506)..(506): a, c, t, g, unknown or other
  misc_feature (506)..(506): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtggtatgggacagacttcactctcaccatcatcagcctggagcctgaggatgttgctagtttattactgtcaacatcgtacgagtcggccgtccggggcctacgtttcggccctggaccaagtgatatcgaaacgatggtgctgcacatctgtcttntac

SEQ ID NO: 76497 - DNA, 576 bp, Homo sapiens
  misc_feature: GYAE6OF01D5JW3.8.34.D01.1.454.CMB.1.raw
  modified_base (209)..(209): a, c, t, g, unknown or other
  misc_feature (209)..(209): n is a, c, g, or t
  modified_base (378)..(378): a, c, t, g, unknown or other
  misc_feature (378)..(378): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctacgtatcctggtaccaacagaaacctggccaggcctcccaggcccctcatctagtggtgcatccaacgagggccactggcatcccagccaggttcaggtggcaggtgggtatgggacagcttcactctnaccatcatcagctgacgctgagatgttgactagtttattacgtgtacaactagttccgtaccggtaggtcgggcccgtcccgggggtccttaccggtttccgggtcccggtacgggtaacccaaagggttcggaactaacgtaccgtaaacgtaacgtcggtcggcgtacgacctactactctcgttccttcgtaccg

SEQ ID NO: 76498 - DNA, 518 bp, Homo sapiens
  misc_feature: GYAE6OF01ERF9I.8.34.D01.1.454.CMB.1.raw
  modified_base (209)..(209): a, c, t, g, unknown or other
  misc_feature (209)..(209): n is a, c, g, or t
  modified_base (367)..(367): a, c, t, g, unknown or other
  misc_feature (367)..(367): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttgcgcctagtatcctggtaccaacagaaacctggccaggctcccaggcccctcatctatggtgcatccaacagggccactggcatcccagccaggttcagtggcagtgggtatgggacagacttnactctcaccatcatcagctgagcctgagatgttgcagtttattactgtcaacatcgtaccgagtggccgtccgggggtccaccgtttcggcccgtcgggaccaaagtggatatacaaacgaactaggtggctgacaccatctgtcttctac

SEQ ID NO: 76499 - DNA, 541 bp, Homo sapiens
  misc_feature: GYAE6OF01DU9UE.8.34.D01.1.454.CMB.1.raw
  modified_base (529)..(529): a, c, t, g, unknown or other
  misc_feature (529)..(529): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagcgccaccctctcctgcagggccagtcagaatgttggcgcctacgtatcctggtaccaacagaaacctggccaggcctcccacggcccctcactctatggtgcatccaacgagggcccactggccactcccagccaggttcaggtggcaggtgggtatggggacaggtacttcactctacaccatcatcagcctggacgcctgaggtatgttgctagtttattactgtcaactataccgtacgtgtcggccgtccggggtcctacgttccggcccgtagggaccaagtcgatacgtacgaacgatggtggctgacacatntcgttctctacg

SEQ ID NO: 76500 - DNA, 253 bp, Homo sapiens
  misc_feature: GYAE6OF01EGXVE.8.34.D01.1.454.CMB.1.raw
  modified_base (246)..(253): a, c, t, g, unknown or other
  misc_feature (246)..(253): n is a, c, g, or t
tcagctcgcgtgtccacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctccgagagcacagcggccctgggctgcctggtcaaggactacttccgacacgcgagctgagcgggctggcaaggcgcatagnnnnnnnn

SEQ ID NO: 76501 - DNA, 546 bp, Homo sapiens
  misc_feature: GYAE6OF01DZEYL.8.34.D01.1.454.CMB.1.raw
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggggagattgtgttgacacaatctccagccaccctgtcttcgtctccaggggaaanagccaccctctcctgcagggccagtcagaatgttggcgcctacgtatcctggtaccaacagaaacctggccaggcctcccaggcccctnatctatggtgcatccaacgngggcccacgtggcatcccagccaggttcagtggcaggtgggtatgggacagtacttcactctcacatcatcacgcctggacgcctgaggtagtgttgacgtagtttattactgtacaactatcgtacgagtcggtccgtccggggcctacgtttccggcccgtcgggaccaaggtgatacgtacgaaacgtacgtgtcggctcgacactactctatctctcgttcccg

SEQ ID NO: 76502 - DNA, 662 bp, Homo sapiens
  misc_feature: GYAE6OF01A0AU2.8.34.D01.1.454.CMB.1.raw
  modified_base (320)..(320): a, c, t, g, unknown or other
  misc_feature (320)..(320): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggtttcctcgttgctcttttaagaggtgtccagtgtcaagtgcaactggtggagtcgtgggggagcgtggtccagccgtgggaggtcacagagactctcgtgtgcagcctgtggttcaccttcagtaactacggcatgcacgtgggtcccaccaagcctccgaggcaaggggnttgggagtgggtgctaggttgtttcattcgtggagggtcaggttcgttacaagttggtatggacagtaccgtccggtaggaacgggtccgtattccaacctatcctaccgaagacgaacctaacgttacccgaaggaaaccaacgtaagttacgttagttaggagtacgtagaacaacgtacccgtaacgttaccgtacggaacgggtaccgaccgggtacgttaacgtaccgtacgtacggtaaccgggaacggggtaacgggggaacccgaagggtaccgggtaacggttaccgtaaacggttacccgttaccgtttacggtacggttcggtaccggggg

SEQ ID NO: 76503 - DNA, 588 bp, Homo sapiens
  misc_feature: GYAE6OF01CNEM9.8.34.D01.1.454.CMB.1.raw
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtggggggaggcgtggtccagcctggggaggtcacagagactctcgtgtgcagcctctgggttcaccttnagtaactacggcatgcactgggtcccncaagctccgaggcaagggnttgggagtgggtgctagttgttcatcgtgagggctaggtgttacaagtggtatgcagactccgtagaacgggccattcacctatctaccagacgacaaattccaaggaacacaatgttatttaggagactagaacacgacctaagtccgtagacggacgacgggacgtacgtactacgtaggtaacggaaggggagggggaaccgagggaccgggtaacggttaccgaacggttacgttaccgtttaggaccggttcggtaccggggg

SEQ ID NO: 76504 - DNA, 264 bp, Homo sapiens
  misc_feature: GYAE6OF01EEH7H.8.34.D01.1.454.CMB.1.raw
  modified_base (246)..(264): a, c, t, g, unknown or other
  misc_feature (246)..(264): n is a, c, g, or t
tcagctcgcgtgtccacgaccggtgctcgatttagatcgtctgtgttgggtttgggtgccgaagttgctggaggtcacggtcaccacgctgctgagggagtagacgtcctgaggactgtaggacagcccatcggtcttccccctggcgccctgctccaggagcacctccgagagcacagcggccctgggctgcctggtcaaggctactccgacacgcgagctgagcgggctggcaaggcgcatagnnnnnnnnnnnnnnnnnnn

SEQ ID NO: 76505 - DNA, 534 bp, Homo sapiens
  misc_feature: GYAE6OF01D6PK9.8.34.D01.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (449)..(449): a, c, t, g, unknown or other
  misc_feature (449)..(449): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanacgccaccctctcctgcagggccagtcagaatgtgcncctagtatcctggtaccaacagaaacctggccaggcctcccaggcccctcatctatggtgcatccaacgacggggccacgtggcactcccagccaggttcagtggcaggtgggtatgggacagacttcactctcaccatccatcacgcctggacgccgtagaggtatggttgcgtagtttattactgtacaactatcgtacgngtcggccgtccggggtcctacgttccgccgtggacctaagtgatagtacgaaacgtatggtcgctgactaccatctcgtctctac

SEQ ID NO: 76506 - DNA, 577 bp, Homo sapiens
  misc_feature: GYAE6OF01ASTY4.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagatgttgcgcctacgtatcctggtaccaacagaaacctggccaggcctcccgacggcccctcactctatggtgcactcccaacgacgggccacgtggccactccccagccgaggttcaggtggcaggtgggtagtgggacagtacttcgactctacaccatcatcacgcctggacgcctagaggatgttgacgtagtttattactgtacaactactaccgtacgtaggtcggtcccgtccggggtcctaccgttccggacccgtacgggaccgtaaggtcgtacgtagtaccgaaacgtacgtggtcgacgtcgacgtaccattctcgtccgttctacg

SEQ ID NO: 76507 - DNA, 571 bp, Homo sapiens
  misc_feature: GYAE6OF01AUKD0.8.34.D01.1.454.CMB.1.raw
  modified_base (246)..(246): a, c, t, g, unknown or other
  misc_feature (246)..(246): n is a, c, g, or t
  modified_base (378)..(378): a, c, t, g, unknown or other
  misc_feature (378)..(378): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccacctctcctgcagggccagtcagaatgttggcncctacgtatcctggtaccaacagaaacctggccaggcctcccaggcccctcatctatggtgcatccaacgagggccactggcactccccagccaggttcagtggcagtgggtatggggacagacttcactcncacatcatcagctggactccgtagaggactgttgcgtagtttacttactgtaccaacgtatccgtaaccgtgtacgggtcccgtccggggtcctaccgtttacgcccgttagggacccgtaaaggcggtataacgtacgaaacgtaacgtggtcggccgttacgccgtactactcttcggttcttcgtaaccg

SEQ ID NO: 76508 - DNA, 586 bp, Homo sapiens
  misc_feature: GYAE6OF01C7LF6.8.34.D01.1.454.CMB.1.raw
  modified_base (209)..(209): a, c, t, g, unknown or other
  misc_feature (209)..(209): n is a, c, g, or t
  modified_base (306)..(306): a, c, t, g, unknown or other
  misc_feature (306)..(306): n is a, c, g, or t
  modified_base (375)..(375): a, c, t, g, unknown or other
  misc_feature (375)..(375): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctacgtatcctggtaccaacagaacctggccaggcctcccaggcccctcatctatggtncatccaacgagggccatggcactcccagccaggttcagtggcagtgggtatgggacagacttcacttcncaccatcatcagcctggacgcctgaggatgttgctagtttattactgtacaactactccgtaccgtagtcgggtcccggttcccgggggtcctaccgtttcccgggtcccgtcgggaacccgtaaagggtcggaacgttacgtaccgtaaaaccggtaacgttaggtcggacgttacggaccgtacctacttccttacgtccttcgtaccg

SEQ ID NO: 76509 - DNA, 652 bp, Homo sapiens
  misc_feature: GYAE6OF01A0LTT.8.34.D01.1.454.CMB.1.raw
  modified_base (230)..(230): a, c, t, g, unknown or other
  misc_feature (230)..(230): n is a, c, g, or t
  modified_base (639)..(639): a, c, t, g, unknown or other
  misc_feature (639)..(639): n is a, c, g, or t
tcagctcgcgtgtccacgaccggtgctcgatttagatcgtctgtgttgggtttggggaggaactggctcagttagggacccagagggaacccatggaagccccaagctccagtcctttctcttcctcctgctactctaggctcccaggtttcagactaccaccgggagtaggatttgtcgtttggtacactaatctcctagccaccctgtcttcgtctccgaggggaaanaggccaccgtcgtccggtgctagggccagtccaggaatcgttggcgcctacgtatccgtggtaccaacacgtaaaacctgggaccctagggccctcccaagggtcccccttcgtactcctagtcgggtcgcgtactccgaacgagggggcccacgttgggcgtacgtccccagtcctacgggttacaggtggaccaggtaggggtacgtcgggaactagaacttcaccgtcgtacgacccgtatccaactcacgccctaggacgacctagtacgatgttcgacttagttttattacttagtactaactatccgtacgtagtacggtccgtccgggggtacctaccgtttcgtcccgttcggaaccgttaaggtcggagtacgtacgaacgaactgtgcgtagcctacgntatgtcttctaac

SEQ ID NO: 76510 - DNA, 655 bp, Homo sapiens
  misc_feature: GYAE6OF01DQI9W.8.34.D01.1.454.CMB.1.raw
  modified_base (302)..(302): a, c, t, g, unknown or other
  misc_feature (302)..(302): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgggttggggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagccgtgggaggtcacagagactctcgtgtgcagcctcgtgggttccacctttcagtaactacggcatgcacgtgggtccncaagctccgaggcaagggnttggagtggggtgctagtttgttcagtcgtggaggtctaggttgttacaagttggtatgacagtactccggtagaacgggtcctaattccacctatcctaccgagacgaactaacgtaccgaaggaaccaacgtaattagttagtttaggagtacgtagaacacgtacctaagtcccgtaggtaacggacgtaacgggtaccgtaacgttaaccgtaccgtacggtaacgggaaacgggggtaacgggggaacccgaggggtaccgggtaacggttaaccccgaacggttaaccttacccggtttaaggaccggttcggtcggggtaaccccgg

SEQ ID NO: 76511 - DNA, 611 bp, Homo sapiens
  misc_feature: GYAE6OF01C1R9A.8.34.D01.1.454.CMB.1.raw
  modified_base (299)..(299): a, c, t, g, unknown or other
  misc_feature (299)..(299): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagccttcgtgggttccaccttcagtaactacggcatgtactgggtccnccaagcctccgaggcaagggattgggagtgggtgctaggtttgttcatcgtggagggctaggttgttacaagttgggtaatggactaggtacctccggtaggaaacggggcctattccacctatcctaccagacgaactaactaccaagaacacaatgtatttaggagtctagaacacgtacctaacgtccgtaggacggacgacgggtcgtaactacgtacgtacggtaacggaaggggacgggggaaccgagggacgggtacgttaccgaacgttaccgttaccgttaggaccgtcggtcggggtacccg

SEQ ID NO: 76512 - DNA, 537 bp, Homo sapiens
  misc_feature: GYAE6OF01C2KZE.8.34.D01.1.454.CMB.1.raw
  modified_base (247)..(247): a, c, t, g, unknown or other
  misc_feature (247)..(247): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (534)..(534): a, c, t, g, unknown or other
  misc_feature (534)..(534): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcncctacgtatcctggtaccaacagaaacctggccaggcctcccaggccccctnatctatgggtncatccaacagggcccacgtcggcactcccagccaggttcaggtggcaggtgggtangggacagacttcactcncacntcatcagcctaggacgcctgaggtatgttgctagttttattactgtacaacatcgtacgagtcggccggtccggggtcctacgttcggacccgtggaaccgaaggtggactatacgaaacgtatggtgctgctaccatctcgtcttntac

SEQ ID NO: 76513 - DNA, 537 bp, Homo sapiens
  misc_feature: GYAE6OF01EKVF3.8.34.D01.1.454.CMB.1.raw
  modified_base (316)..(316): a, c, t, g, unknown or other
  misc_feature (316)..(316): n is a, c, g, or t
  modified_base (428)..(428): a, c, t, g, unknown or other
  misc_feature (428)..(428): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccgaggcaagggnttgggagtgggtgcagttgtttcatctgagggcagtgttcaatggtatgcagactccgtgaacgggccgattcaccatctccagagacaatccagaacacaatgtattgganctagaacagacctaagtcctagacggacgacgggctatactacgtagtacggaagggagggggaacaggacgggagttaccgaagtacctaccgttgcgtcgtacgggg

SEQ ID NO: 76514 - DNA, 519 bp, Homo sapiens
  misc_feature: GYAE6OF01A5QWH.8.34.D01.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (315)..(315): a, c, t, g, unknown or other
  misc_feature (315)..(315): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcncctacgtatcctggtaccaacagaaacctggccaggctcccaggcccctcatctatggtgcatccaancgggccactggcatcccagccaggttcagtggcagtggtatgggacagtactcactctcaccatcatcagcctgacgtctgaggatgtgctagtttatactgtacaactatcgtacgagtcggccgtccgggggcctacgttcggcccgtcggaccaaggtcgtatactacgaaacgagtcggtggctgcacatctgtctctac

SEQ ID NO: 76515 - DNA, 557 bp, Homo sapiens
  misc_feature: GYAE6OF01ENZ23.8.34.D01.1.454.CMB.1.raw
  modified_base (436)..(436): a, c, t, g, unknown or other
  misc_feature (436)..(436): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctctgggttcaccttcagtaactacggcatgcacgtgggtcccgccaagcctccgaggcaaggggattgggagtgggtggctaggtttgttcatcgtggagggcagttgtacaagtggtatgcagctccggtgaagggccgatcacatctcagagacaatccagaacacaatgtagttgganctagaacagacctaagtcctaggacgacgacgggcgtatacgtacgtaggtaacggaacgggagggggaaccgaggacgggacgttaccgaacgttactaccgtttgtcgtcggtacgggg

SEQ ID NO: 76516 - DNA, 577 bp, Homo sapiens
  misc_feature: GYAE6OF01BNL05.8.34.D01.1.454.CMB.1.raw
  modified_base (303)..(303): a, c, t, g, unknown or other
  misc_feature (303)..(303): n is a, c, g, or t
tcagctcgcgtgtccacgaccggtgctcgatttagatcgtctgtgttgggtttggggggaagaggaagactgacggtcctgccacaggtggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggagtcacagagactctcgtgtgcagcctctgggttcaccttcagtaactacggcatgcacgtgggtcccnccaagcctccgaggcaagggattggagtgggtgctagttgtttcatcgtggagggcaggttgttacaagtggtatgcagactcgtagaacgggccgattcaccatcctcagagacaatccagaacacaatgtattggatctagaacagacctaagtccgtagacggacgacgggacgtactactacgtaggtaacggaacggggagggggaaccgagggaccgggtacgttaccgtaacgtaccgttaccgtttggaccggttcggtaccgggg

SEQ ID NO: 76517 - DNA, 541 bp, Homo sapiens
  misc_feature: GYAE6OF01A5P9V.8.34.D01.1.454.CMB.1.raw
  modified_base (209)..(209): a, c, t, g, unknown or other
  misc_feature (209)..(209): n is a, c, g, or t
  modified_base (532)..(532): a, c, t, g, unknown or other
  misc_feature (532)..(532): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctacgtatcctggtaccaacagaaacctggccaggcctcccaggcccctcatctatggtgcatccaaacagggccacgtggcatccccagccaggttcaggtggcaggtgggtatgggacagacttcacctctcaaccatcatcacgcctggacgtcctgaagtatgttagctaagtttattactgtacaacatacgtacgagtcggccgtccggggtacctaccgtttcgccgtcggacgtaggtggacgagtacgaaacgagtggtggctgaccactatcgtnttctctacg

SEQ ID NO: 76518 - DNA, 762 bp, Homo sapiens
  misc_feature: GYAE6OF01CQ75D.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctcgtgtgcagcctcgtgggttcaccttcaagtaactacggcatgcacgtcgggtcccaccaagcctccgaggcaagggattgggagtgggtgctagttgttcatcgtggagggctaggtgttacaagtggtatgacaggtactccggtaggaacgggccgtacttaccacctactcctacccgaagtaacgtaactaaacttaccgaacgggtaaacctaacgtaaagttagttaacgttttagggaacgtaccgttaacggaaaccgtaacggtacccgttaaacgggttacccgttaacgggaaccgggtaacccggtaaccgggggttaacccgttaaacgttaacccgttaaaccggttaacgggttaaaaccgggggaaaacggggggaaaccgggggggtaaacccgtaacgggggtacccgggggttaaacggtttaaccccggtaaacgggttaacccgtttaccccgggttttaacgggtaacccgggtttccgggtaacccggggggg

SEQ ID NO: 76519 - DNA, 514 bp, Homo sapiens
  misc_feature: GYAE6OF01BAFGW.8.34.D01.1.454.CMB.1.raw
  modified_base (209)..(209): a, c, t, g, unknown or other
  misc_feature (209)..(209): n is a, c, g, or t
  modified_base (510)..(510): a, c, t, g, unknown or other
  misc_feature (510)..(510): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagatgtggcgcctagtatcctggtaccaacagaaacctggccaggctcccaggcccctcatctatggtgcatccaacagggccactggcatcccagccaggttcagtggcagtgggtatgggacagacttcactctcaccatcatcagcctggacgcctgagatgttgctagtttatactgtcaactatcgtacgagtcggccgtccggggcctacgttcggcccgtagggaccaaggtcggatagtacgaaacgatgtgctgcacatctgtctntacg

SEQ ID NO: 76520 - DNA, 537 bp, Homo sapiens
  misc_feature: GYAE6OF01BKEDU.8.34.D01.1.454.CMB.1.raw
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcactgggtccnccaagctccaggcaagggnttgggagtgggtggctagttgttcatctggaggtcagtgttcaagtggtatgcagactcgtgaagggccgattcacatctcagagacaatacagaacacaatgtattggagctagaacagaccgtaagtcctagacggacgacggacgtatactacgtagtacggaagggaggggaaccgaggacgggtagtaccgaacgtactaccgttgcgtcgtacgggg

SEQ ID NO: 76521 - DNA, 653 bp, Homo sapiens
  misc_feature: GYAE6OF01A4Q4J.8.34.D01.1.454.CMB.1.raw
  modified_base (169)..(169): a, c, t, g, unknown or other
  misc_feature (169)..(169): n is a, c, g, or t
  modified_base (173)..(173): a, c, t, g, unknown or other
  misc_feature (173)..(173): n is a, c, g, or t
  modified_base (277)..(277): a, c, t, g, unknown or other
  misc_feature (277)..(277): n is a, c, g, or t
  modified_base (436)..(436): a, c, t, g, unknown or other
  misc_feature (436)..(436): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaactgggtttcctcgttgcttctttaagnggtntccagtgtcaagtgcaatggtggagtcgtgggggagcggtggtccaggccgtggggagtcacgagacgactcgtcgtgtgcagccctgtcgggttcaccgtttnagtaactaccggctagtgcacgtcgggtccgccaagcctccaggcgaaggattggagtgggtgctagttgttcagttcgaggacgggtcaggttcgtttagaacgttgggtagtaggccgtaggaccgtccggttagggaacggccgtattcgaacctntccgtaccaagacgtaacaacgcgaacgaacactaatagtattgacctagaacagtacctaggtccctaggaacggtacgacggttacgaacgttaccgtacgtacgttaaacggaaggggtaaccgggggaaccaggggtaccgggttaaccgttaaccggaaaccggtttaccttaccgggtttaacggaaccggttcggtggggtaaccccggg

SEQ ID NO: 76522 - DNA, 606 bp, Homo sapiens
  misc_feature: GYAE6OF01C4O40.8.34.D01.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (387)..(387): a, c, t, g, unknown or other
  misc_feature (387)..(387): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagatttgtgttgacacaatctccagccaccctgtcttcgtctccgaggggaaangccaccctctcctgcagggccagtcagaatgttggcncctagtntccgtggtaccaacagaacctggccaggcctcccgacggcccctcatctatggtcgcactccaacgacgggccacgtcggcactccccagcctaggttcagtggcaggtgggtatgggacagacttcactcncacatcatcacgccgtggacgccgtaggaggtattgttgtctagtttattacgtgtactaactacgttacggtacggtacgtcgggtcccggttcccgggggtcctaccggtttcccgggcccggtacgggaaccgtaaaggtcggtaacgttaacgtaccgtaaaacggtacgtaggtcggtaccgtcgacgtacctatcgttcgttccttcgtaccg

SEQ ID NO: 76523 - DNA, 755 bp, Homo sapiens
  misc_feature: GYAE6OF01DS0TS.8.34.D01.1.454.CMB.1.raw
  modified_base (309)..(309): a, c, t, g, unknown or other
  misc_feature (309)..(309): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagatgttggcgcctacgtatccgtaggtaaccaacaacgaaaccgtggaccgaggcctcccgacggcccctnactctagtggtgcactccaacgacgggccacgtcggacactaccccgagaccgtaggttccaggtcggacgtagggttagggtagtacggggaacaggtacctttcgaaccttccgtaccaacccgtattaccgaactccgaacggcccgttaggggaaccgtaccggttaaggtaaacggtacgtttggttacgacgtttaacggtttttaacttaaccgttgtaaccaaacgtaacgttacccgggttaacggtacggttccgggtaccccgggttcccggggggtacccctttaaccgggttttcccgggaccccgggttacgggggtaaacccggtaaaggggttacgggaaacggtaacgtaacccggtaaaacggtaaccgttcgggtacgggaccgttcggaacccgtacctacgttccgttacgttccttcgtacccg

SEQ ID NO: 76524 - DNA, 616 bp, Homo sapiens
  misc_feature: GYAE6OF01CZ0XJ.8.34.D01.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
  modified_base (602)..(602): a, c, t, g, unknown or other
  misc_feature (602)..(602): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaangccaccctctcctgcagggccagtcagatgtgcnctagtntcctggtaccaacagaacctggccaggcctcccgaggcccctnatcctagtggtcncactaccgaacgtacgggccctacgtcggccactcccgagaccctaggttcaggtcggcaggtgggtatggggtactttcggttcacttccgtaccaccgtatcagcacgtcctagacgccgtagtaacgtatttcgactttagtttacttacgtacgttacaactacgttacgtacgtacggttcggcccggtaccggggtcccttaccggttccggcccgttacgggtaacctaagttcgaagtactacgtaaacgacgtcgtcgtcgtcgactacctagttctacgttcttcncttcccgttacccg

SEQ ID NO: 76525 - DNA, 692 bp, Homo sapiens
  misc_feature: GYAE6OF01ELTBH.8.34.D01.1.454.CMB.1.raw
  modified_base (321)..(321): a, c, t, g, unknown or other
  misc_feature (321)..(321): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctcgtgggttcaccttcaagtaaatacggcatgcactgggtcccgccaagcctccgaggcaagggnttgggagtgggtggctagtttgttcatcgtggagggctaggttgttcaagttgggtatgacgagactccggtaggaacgggtccgtattccgacctactcctaccgaagacgaactaacgttacccgaaggaacctaacgtaaagttagttaagtttagggaacgtacgtagaaaccgtacggtaccttaaacggtcccgttaggaacggtaaccggacggggtacgttaacgtaccgttaaccgtacgggtaaaccggggaaacgggggaaccggggggaaacccggtacggggacccggggtaacgtttaacccggtaaacggtttaccgttacccgttttaagggaaacggttccgggtaccgggggg

SEQ ID NO: 76526 - DNA, 650 bp, Homo sapiens
  misc_feature: GYAE6OF01B12I3.8.34.D01.1.454.CMB.1.raw
  modified_base (207)..(207): a, c, t, g, unknown or other
  misc_feature (207)..(207): n is a, c, g, or t
  modified_base (243)..(243): a, c, t, g, unknown or other
  misc_feature (243)..(243): n is a, c, g, or t
  modified_base (379)..(379): a, c, t, g, unknown or other
  misc_feature (379)..(379): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccaggggaangccacctctcctgcagggccagtcagaatgttggcncctagtatcctggtaccaacagaaacctggaccaggctcccaggccccctcgaatcctatcggtgcactccaacacgggccacgtggcatcccgagccaggttcagtggcaggtggtatgggacagacttcactcncaccatcactcagactggacgctagagtacgtgttcgcttaaggtttacttacgtcgttacaactagttaccgtaacgtacggttacggtacccggttcccggggggtacccttaaccgtttcccggggtaccccgttacgggggtaaaccccgtaaagggttaccgggtaaacgttaacgtaaccggtaaaaccggaaccggtttacgggtccggtaccggttacgacccgtaaccctacttaccgttacggttccgttccgttaacccg

SEQ ID NO: 76527 - DNA, 533 bp, Homo sapiens
  misc_feature: GYAE6OF01B3IG5.8.34.D01.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
  modified_base (394)..(394): a, c, t, g, unknown or other
  misc_feature (394)..(394): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcncctacgtatcctggtaccaacagaaacctggccaggcctccaggcccctnatctatggtgcatccaanagggccactggcatcccagccaggttcagtcgcagtgggtatgggacagacttcactctcaccatcatcagcctggacncctgaggatgttgctagtttacttactgtactaactatcgtacgagtacggccgtccggggcctacgtttccggcccgtcgggaccaagtcggatacgtacgaaacgtactggtcggctgacacactctcgtctctacg

SEQ ID NO: 76528 - DNA, 583 bp, Homo sapiens
  misc_feature: GYAE6OF01C8E0O.8.34.D01.1.454.CMB.1.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
  modified_base (405)..(405): a, c, t, g, unknown or other
  misc_feature (405)..(405): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaaangccaccctctcctgcagggccagtcagaatgttggcgcctacgtatcctggtaccaacagaaacctggccaggctcccaggcccctnatctatggtcgcactccaacgacgggccacgtcggacactccccagccaggttcagtggcaggtgggtatgggacagacttcactctcactatcatcacgcctaggacncctgaggatgtgctagtttatacgtgtacaacgtacttaccgtacgagtcggtcccggttcccgggggacccttacgtttcccgggaccccgttggggaaccctaaagggttggaacttaacgtaccgaaaacgtacgttggtggtaccgtgacctacctatcttcgttcttctaccg

SEQ ID NO: 76529 - DNA, 549 bp, Homo sapiens
  misc_feature: GYAE6OF01BKL4K.8.34.D01.1.454.CMB.1.raw
  modified_base (247)..(247): a, c, t, g, unknown or other
  misc_feature (247)..(247): n is a, c, g, or t
  modified_base (536)..(536): a, c, t, g, unknown or other
  misc_feature (536)..(536): n is a, c, g, or t
  modified_base (545)..(545): a, c, t, g, unknown or other
  misc_feature (545)..(545): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcncctacgtatcctggtaccaacagaaacctggccaggctcccaggcccctcatctatggtgcatccaacagggccactggcatcccagccaggttcaggtggcagtgggtatgggacaggtacttcactctcaccatcatcagcctggacgccgtgaggatgtgcgtaagtttattacgttgtactaactataccgtacgacgtcggcccgtccgggggcctaccgtttccggcccgtcgggaccaacggtggactagtacgaacgtacgtaggtcggctgactacactntcgttcttntacc

SEQ ID NO: 76530 - DNA, 702 bp, Homo sapiens
  misc_feature: GYAE6OF01DDPDB.8.34.D01.1.454.CMB.1.raw
  modified_base (299)..(299): a, c, t, g, unknown or other
  misc_feature (299)..(299): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcagggccagtcagaatgttggcgccttcgtaagctggtaccaacacaaacctggccaggctcccaggcccctnactctagtggtcgcactccaacgacggggcccaacgtcggccaactccccgaacggccgaacgggtttcaacggttggactagggtacggggtaatggggaacaggtacctttcacgtctacaaccaatccaatccaacggccgttacgggacgtacccgtaggaaacgtagttggtttagacgttaaggttttaattaccgttagttaccaacttaagttacccggtaacggtacggttaccgggtcccggttcccggggggtacccttaacccggttttcccgggaccccggttacggggtaaccgtaacgggttacgggaacgtaacgttaaccgaaacggtaacgtcgggtcggtaccgtaggacctaccgtacttcgttacggttccttcgttacccg

SEQ ID NO: 76531 - DNA, 529 bp, Homo sapiens
  misc_feature: GYAE6OF01DH7RW.8.34.D01.1.454.CMB.1.raw
  modified_base (396)..(396): a, c, t, g, unknown or other
  misc_feature (396)..(396): n is a, c, g, or t
  modified_base (519)..(519): a, c, t, g, unknown or other
  misc_feature (519)..(519): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccaccggagagattgtgttgacacaatctccagccaccctgtcttcgtctccgaggggaaagcgcccaccctctcctgcgagggccagtcagaatgttggcgcctacgtatcctaggtaccaacagaaacctggaccaggcctcccaggccccctcatctatggtgcatccaacagggccactggcactcccagccaggttcagtgcagtgggatgggacagcttcactctcaccatcatcagcctggnccgtgagattgtgtctagtttattactgtcaactatcgtacgtacgtcggtccgtccggggcctcgttcgccgtcggaccgtaagtgtatacgtacgaaacgtacgtgtcgctgctacatctntcgtctaccg

SEQ ID NO: 76532 - DNA, 649 bp, Homo sapiens
  misc_feature: GYAE6OF01DLYJG.8.34.D01.1.454.CMB.1.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (378)..(378): a, c, t, g, unknown or other
  misc_feature (378)..(378): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccacggagagattgtgttgacacaatctcagccacctgtcttcgtctccgaggggaancgccacctctccngcaggccagtcagatgtgcgctagtatcctggtaccaacagaacctggccaggctccgagcccctnatctatggtnctatccaaacgcgggccacgtggacactccccagccaggttcaaggtggacaggttgggatgggacaggacttcactctacacntcgatcacgctggacgccgtgacggtatgttgacgttagtttattacgttcgtactaaactgttacccggtaacggtacgtccgggtaccccgggttacccggggggtacccttaccggtttcccggggtacccggttacggggtaaacccgttaaacgggttacggtaaaacgttacgtaaaccggtaaaaccggtaacggttacggtaccgggtaccgttaccggaccgtaaccgtaagtttccgttacggtttacctcgtttaacccg

SEQ ID NO: 76533 - DNA, 645 bp, Homo sapiens
  misc_feature: GYAE6OF01EQ3P7.8.34.D01.1.454.CMB.1.raw
  modified_base (208)..(208): a, c, t, g, unknown or other
  misc_feature (208)..(208): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaanagccacctctcctgcagggccagtcagatgttggcgcctacgtatcctggtaccaacagtaaacctggccaggcctccgaggcccctcatctatggtgcagtccgaacgacgggccacgtggcacgtcccagccgaggttcaggtggctaggtgggtatcgggacaggtacttcactctacacctatcaactcacgtcctagggactcccgtaggacggtacttcggttagtaccgtaggttttacttaccgtcgtacctaacgtacgttaccggtaacggtacggtaccggggtcccgtacccggggggtacctaccgggttttcccgggtcccgtacggggtaacccgtaaaggtcggtaaccgttaacgtaaccgtaaacggtacgtacggtggtacctacggacctacgtacttaccgtgttcccgtacgtac

SEQ ID NO: 76534 - DNA, 548 bp, Homo sapiens
  misc_feature: GYAE6OF01B6DGP.8.34.D01.1.454.CMB.1.raw
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
  modified_base (404)..(404): a, c, t, g, unknown or other
  misc_feature (404)..(404): n is a, c, g, or t
  modified_base (451)..(451): a, c, t, g, unknown or other
  misc_feature (451)..(451): n is a, c, g, or t
  modified_base (538)..(538): a, c, t, g, unknown or other
  misc_feature (538)..(538): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctacgtatcctggtaccaacagaaacctggccaggcctcccaggccccctnactctatggtgcatccaacgagggcccacgtcggcactcccagccaggttcaggtggcaggtgggtatgggacagtacttcactctcaccatcatcagcctggacnccgtagaggtattgttagctagtttatactgtacactagtcgtacgngtcggccggtcccggggtcctacgttccggcccgtagggaacctaaggtcggatacgtacgaaacgtatggtcgctgctaccatctntcctctaccg

SEQ ID NO: 76535 - DNA, 616 bp, Homo sapiens
  misc_feature: GYAE6OF01CG682.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctggggggaggcgtggtccagcctggggaggtcacagagactctcgtgtgcagcctctgggttcaccttcagtaactacggcatgcacgtgggtcccgccaagcctccgaggccaagggattgggaggtgggtggcgtagttgtttcagtcgtggagggtctaggtgttacaagttgggtattggcagacctccggtggaacgggccgattccgacctactctccagacgacaattaccaggaacaacaatgttagtttggagtacgtagaacgacgtaccgtaacgtcctaggaacggaccgacggggacgtagtactacgtacggtaacggaaaggggaggggggaaccgagggacgggtacggttaccgaacggttaccgttaccgtttacggacggttcggtaccggggg

SEQ ID NO: 76536 - DNA, 533 bp, Homo sapiens
  misc_feature: GYAE6OF01E2QHY.8.34.D01.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (372)..(372): a, c, t, g, unknown or other
  misc_feature (372)..(372): n is a, c, g, or t
  modified_base (516)..(516): a, c, t, g, unknown or other
  misc_feature (516)..(516): n is a, c, g, or t
  modified_base (522)..(522): a, c, t, g, unknown or other
  misc_feature (522)..(522): n is a, c, g, or t
  modified_base (531)..(531): a, c, t, g, unknown or other
  misc_feature (531)..(531): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaangccaccctctcctgcagggccagtcagatgtgcncctagtatcctgtaccaacagaaacctggccaggctccaggcccctcatctatggtgcatccaacacgggccacgtggcactccccagccaggttcagtggcagtgggtatgggacagacttcactcncaccatcatcagcctggacgccgtagaacgtagtgttagcttagtttattactgtactaactatcgtacgtagtacggccgtccggggcctcgttccggccgtacgggaccgaagggtcggagtactacgaaacgactggcgcngacacntactgtctntc

SEQ ID NO: 76537 - DNA, 739 bp, Homo sapiens
  misc_feature: GYAE6OF01DI21A.8.34.D01.1.454.CMB.1.raw
  modified_base (332)..(332): a, c, t, g, unknown or other
  misc_feature (332)..(332): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactgggtggagtcgtgggggaggcgtggtccagccgtggggaggtcacagagactctcgtgtgcagcctcgtgggttccaccttcaagtaacctacggcatgccactggggtcccacctaagcctccgaggcgaaagggngtggaggtggggtgctagtttgttcattcgtggagggctagttcgttacaagttggtaatcgctacggtaccgtccggtaggaacgggccgtacttacccgaaccctaacttccgtacccgaagaacggtaacctaaacgttcccgaaacgggaaacctaaccgtaaagttacgtttaaggttttacggaacgttacgtaacgtaaaccgtaaccgtaacccgttaaacgttcccggtaaggaacgggtaacccggtacggggtacgttaaacgttaaccgtaacgttaacgggtaaaccgggaaaggggggaaaccgggggaaacccggtagggtaccggggtaacgttacccgtaaacggtttacccgttaccgtttacggtaccgttcgggtaaccccgggggg

SEQ ID NO: 76538 - DNA, 622 bp, Homo sapiens
  misc_feature: GYAE6OF01A028Z.8.34.D01.1.454.CMB.1.raw
  modified_base (369)..(369): a, c, t, g, unknown or other
  misc_feature (369)..(369): n is a, c, g, or t
  modified_base (573)..(573): a, c, t, g, unknown or other
  misc_feature (573)..(573): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtggggagtcacagagactctcgtgtgcagcctctgggttccaccttcaagtaaatacggcatgcacgtgggtcccgaccaagcctaccgaggccgaagggtacttgggagtggggtggcgtagtttgttcatcgtggagggntagtgtacaagtggtatgcagtcctcggtagaacgggtccgtatccgacctactcctaccgagaacgaactaacttaccgaaggaacctaacgtaagttacggttagtttacgggagtaccgtaacgaacgacgtaccgtaacgtccgtagacggacgacggtacgtactacgtacgtaggtaacggaacggggacgggaacgnggaccgggtacgtacgtaacgttacgttacgttagaggtcggtacgggg

SEQ ID NO: 76539 - DNA, 590 bp, Homo sapiens
  misc_feature: GYAE6OF01BJ28B.8.34.D01.1.454.CMB.1.raw
  modified_base (303)..(303): a, c, t, g, unknown or other
  misc_feature (303)..(303): n is a, c, g, or t
  modified_base (542)..(542): a, c, t, g, unknown or other
  misc_feature (542)..(542): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcacccatggagtttgggctagaacttgggttttcctcgttgctcttttaagaggtgtccagtgtcaagtgcaactggtggagtcgtgggggagccgtggtccagcctggggagtcacagagactctcgtgtgcagcctcgtgggttcaccttcagtaactacggcagtgcacgtgggtccnccaaggctccgaggcaagggcttgggagtgggtgctaggtttgtttcattcctaggacggggctaggttgttacaagttggtaatggccagtacctccggtagaacgggccgtattccacctatctaccagacgacaacgttccaggaacacaatgtatttggagtctagaacacgacctaagtcctaggacggacgacgggtcgtatactacgtgtaacggaagggagggggaaccgnggacgggtagttaccgaagttacctaccgtttcgccggtcgtacgggg

SEQ ID NO: 76540 - DNA, 748 bp, Homo sapiens
  misc_feature: GYAE6OF01DDPIA.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttccgtctccgaggggaaagagccaccctctcctgcagggccagtcagaatgttgcgcctacgtatccgtggtaccaacacgaacctcggccaggcctacccacggcccctcactctatggtcgcactaccgaacgacgggccacgtcggcacgtcccacgccgaggttcaggtcggacgaggtagggtagtgggactacggtaccttcgaccttccgtaccaacctactacctactaccgtaacgcccgttacgggacgtacccgtagggtaacgggtaagttcggttacggtaccgtttaaggttttaaccgtttaaccgttaggttaaccgtaaacgtaacgttacccgggttaaccggtaacgggttcccgggtaccccgggtttacccgggggggtacccttaacccgggtttccgggacccgttacggggtaacccgtaaggggttacggaacggtaacgtaaccggtaaaacccggtacggtttacgggtcgggtaccgtaccggtccgtaacccgtacgttcttacggttcccttcccgttaaccccgg

SEQ ID NO: 76541 - DNA, 698 bp, Homo sapiens
  misc_feature: GYAE6OF01C1UR2.8.34.D01.1.454.CMB.1.raw
  modified_base (245)..(245): a, c, t, g, unknown or other
  misc_feature (245)..(245): n is a, c, g, or t
  modified_base (313)..(313): a, c, t, g, unknown or other
  misc_feature (313)..(313): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcaggccagtcagatgtgcncctagtatcctgtaccaacagaacctggccaggctcccaggcccctcatctatggtagcatccaacgngggccaactggcactccccaagcctaggttcaggtggaccaggtgggtatgggactaaggacctttcgaacttcgtaccacctatccactctaagccgtagggaacgtcccgtaggaggtaacgttcggtttcggtaccgtaaggtttttaacttacgttacggttacctaaaccgtagttacccggttaacccgggtacgggttaccggggtaccccggttacccgggggggtaccccttaaccggttttcccgggacccccggttacggggaaccccgtaaaagggtcgggtaaaccgttacgtaaccgtaaaccggtaaacgttcggtcgggtacccgtaggaccgtacccgtaacttccgttcggttccttcgttaacccg

SEQ ID NO: 76542 - DNA, 766 bp, Homo sapiens
  misc_feature: GYAE6OF01DMRN9.8.34.D01.1.454.CMB.1.raw
  modified_base (181)..(181): a, c, t, g, unknown or other
  misc_feature (181)..(181): n is a, c, g, or t
  modified_base (308)..(308): a, c, t, g, unknown or other
  misc_feature (308)..(308): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
tcagctcgcgtgtccacgaccggtgctcgatttagatcgtctgtgttggggtcctagggagacggagcccgagcacctagaagtcggcggtgtttccattcggtgatcagcactgaacacagaggtactcaccatggagtttgggctggaacttgggttttcctcgttgcttcttttaagnggttgtccagtgtcaagtgacaacgttgggtggagtcggtggggggacgcgtggtcccaggccgtggggagtcacgagagactctcgtgtgcagccttgtgggttccaccttcaagttaacctcggnagtgcacgtgggtcccacaagcctccgaggcaagggnttggagtggngctagttnttcatcgagaggctagtgtacgaattggtatgactagtacctaccgggtagaaccgggtcctaacgttaccgaacccgtacgttaccgtacccgtaacggtaaaccgtaaaccgtaaacgtttacccggaaacggtaaacccgtaaacgtaaagttacggtttaaggttttacggaacggttaccgtaacgtaaacccgtaaccgtaacccgtttaacggtacccgttaacgggaaccggtaccggtaaccggggtaccgtttaaagtacccggttaaacggttaacgggttaaaccggggtaaacgggggtaaccgggggtaaacctacggggtaaccgggtacgttaacccgtaacggtttacccgttacggtttaccggaaccggttccgggtaccgggg

SEQ ID NO: 76543 - DNA, 917 bp, Homo sapiens
  misc_feature: GYAE6OF01AOUJ8.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgtggcgcctagtatcctggtaccaacagaaacctggccaggctcccaggccccctcatctatgggtgcactaccaacggcggacctacgtcggactacccgtacccgaccgaccggttacggttacgtacgggtcggaccggttaggggttacgggttacgggtacgggaaccgaaccggttaccgttaacccgtaccgttcctaaccccgtaaccgttacttacccgaacttacgacccggttaccgggtaacgggtaccgtaccggttagggtaacgggttacggtttacgggtttaccggaaccggtttttaaaggttttaaaccgtttaccggtttaccggttaaccgtaaaccgttaaccgggtttaaccccgggttaaccggggttaccggggttacccggggttacccccggggggtaccccgggggttaaccccgttttaaccccgggttttcccccggggtacccccggggttaaccggggaaaacccggtttaaaggggtaccgggtaaacgtttaacccggtaaaaacccgggttaaaaccccgggtttaacggggttacggggttaacccgggttcccggttaacccggttaaccccgtaacccgtttaacccggtttaccggttaccccggtttttaaccccgttaccgttttaaccccccggg

SEQ ID NO: 76544 - DNA, 533 bp, Homo sapiens
  misc_feature: GYAE6OF01CD3IB.8.34.D01.1.454.CMB.1.raw
  modified_base (209)..(209): a, c, t, g, unknown or other
  misc_feature (209)..(209): n is a, c, g, or t
  modified_base (378)..(378): a, c, t, g, unknown or other
  misc_feature (378)..(378): n is a, c, g, or t
  modified_base (529)..(529): a, c, t, g, unknown or other
  misc_feature (529)..(529): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctacgtatcctaggtaccaacagaaacctggccaggcctcccaggcccctcatctatggtgcatccaacgagggccacgtggcactcccagccaggttcagtggcaggtggtatgggacagacttcactcncaccatcatcagccgtggacgccgtgaggattgttgcttagtttattacgtgtacaactagtaccgtacgagtcggaccgtccggggtcctacgttccggccgtaggaccgaagtgatatacgaaacgtatgtgctgctacatctcgtctntacg

SEQ ID NO: 76545 - DNA, 546 bp, Homo sapiens
  misc_feature: GYAE6OF01AWHE7.8.34.D01.1.454.CMB.1.raw
  modified_base (210)..(210): a, c, t, g, unknown or other
  misc_feature (210)..(210): n is a, c, g, or t
  modified_base (449)..(449): a, c, t, g, unknown or other
  misc_feature (449)..(449): n is a, c, g, or t
  modified_base (516)..(516): a, c, t, g, unknown or other
  misc_feature (516)..(516): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaangccaccctctcctgcagggccagtcagaatgttggcgcctacgtatcctggtaccaacagaaacctggccaggctcccaggcccctcatctatggtgctataccaacgacgggccacgtggccactcccagcctaggttcaggtggcaggtgggtatgggacagcttcactctcaccatcatcacgcctggacgccgtgaggactgttgctagttttatactgtacaactatcgtacgngtcggccgtccggggcctacgttccggccgtcggaccgaaagtcggatagtaccgaaacgagtcggnggctcggactaccattctcgtcttcccgta

SEQ ID NO: 76546 - DNA, 603 bp, Homo sapiens
  misc_feature: GYAE6OF01BC726.8.34.D01.1.454.CMB.1.raw
  modified_base (210)..(210): a, c, t, g, unknown or other
  misc_feature (210)..(210): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaangccaccctctcctgcaggccagtcagaatgttgcgcctagtatcctggtaccaacagaaacctggccaggctcccaggcccctcatctatggtgcactccaacgacgggccactggcatcccagccaggttcagtggcaggtgggtatgggacagacttcactctcacctatcatcagcctggacgtccgtgaggatgtgtcgtagttttatacgtgtacaactactaccggttacgaggttccggcccggtccgggggtccctaccggtttcccggccccgttacggggaacccgtaaaggtcggtaacgtaacgtaccgtaaaaccggtacgtacgggtacggaccgttcgacctaacccgtagttaccttacggttccttccgtaacccg

SEQ ID NO: 76547 - DNA, 700 bp, Homo sapiens
  misc_feature: GYAE6OF01EMTX7.8.34.D01.1.454.CMB.1.raw
  modified_base (222)..(222): a, c, t, g, unknown or other
  misc_feature (222)..(222): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagactaccgacggagagtattgtgtagacaacatcctaccacgccctaccctgttcttcgtcctacggaagggaaacncgccctaccctctcgcgcgacggcctagtacaagtaacgttcggttcggccgtaccgttaacgttactaccgttacggtaaaccaaacgaacgtaaacccgtcggaccgacggtccctaccgacccggtcccctatacttccgtagtcggtcacctactacccgaacggccggaccctaggtcgactacccgtacccgacgtccgtacggttacagggtcgacgtaggggttcgggtaggtacggaactacggtaccttacaccgtcctaaccaacgttactactacgtacgacgtccgtaggacgtcgtaggaacgtgttgtactagttagtttactagtactacaactcgtacgacgtagttccggcccggtccggtactaccggttccggaccgtagggaacccgtaggttacgactaacgtaacgaacgttagtcggcgtacgcctaccgtactacttagtcgttcgtctaccg

SEQ ID NO: 76548 - DNA, 607 bp, Homo sapiens
  misc_feature: GYAE6OF01CP4Q6.8.34.D01.1.454.CMB.1.raw
  modified_base (184)..(184): a, c, t, g, unknown or other
  misc_feature (184)..(184): n is a, c, g, or t
  modified_base (210)..(210): a, c, t, g, unknown or other
  misc_feature (210)..(210): n is a, c, g, or t
  modified_base (249)..(249): a, c, t, g, unknown or other
  misc_feature (249)..(249): n is a, c, g, or t
  modified_base (387)..(387): a, c, t, g, unknown or other
  misc_feature (387)..(387): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccnccctgtcttcgtctccgaggggaaanagcccaccctctcctgcagggccagtcagaatgttggcnctacgtatcctggtaccaacagaaacctggccaggcctccgaggccccctcactctagtggtgcataccgaacagggcctacgtggcactcccagccaggttcagtggcaggttgggtatgggacagacttcgactcncaccatcatcacgtcctggacgcctggacggtattgttgtacgtagtttacttacgtgtactaactacgtacgtaccgtaggtccggtccggtacccgggggtcctacggtttcccgggcccgtacgggaaccctaaagggtcggtaataacgtaccgtaaaaccggtacgttacggtcggcttacgaccgtaacctacttcgttacgttccttctaccg

SEQ ID NO: 76549 - DNA, 536 bp, Homo sapiens
  misc_feature: GYAE6OF01EIAJO.8.34.D01.1.454.CMB.1.raw
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (414)..(414): a, c, t, g, unknown or other
  misc_feature (414)..(414): n is a, c, g, or t
tcagctcgcgtgtccacgaccggtgctcgatttagatcgtctgtgttgggttggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtcccncaagcctccgaggcaagggnttgggagtgggtgctagttgttcatctgaggcagtgtcaatggtatgcagactcgtgacggcatcacatcncaganacatcagacacatgtattganctagacacgactagtctagagacgacggactatactacgtagtacggaagggacggggaacgagggcgggtacgttaccgaacgttaccgttaccgttaggacgttcggtcggggtacccgg

SEQ ID NO: 76550 - DNA, 594 bp, Homo sapiens
  misc_feature: GYAE6OF01BVEBL.8.34.D01.1.454.CMB.1.raw
  modified_base (209)..(209): a, c, t, g, unknown or other
  misc_feature (209)..(209): n is a, c, g, or t
  modified_base (316)..(316): a, c, t, g, unknown or other
  misc_feature (316)..(316): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctccaggcccctcatctatggtgcatccaacgngggccacgtggcatcccagccaggttcagtggcaggtgggtatgggacagacttcactctcacatcatcagcctggacgcctgaggtatgttgactagttttattacgttcgtactaactacgtaccgtacggtacgttcgggcccgtcccggggggtaccctaccgtttccgggaccccgttacggggaaccgtaaacggtcggtaacgtaacgtaccgaaacggtaacgtaggtcggacgtcgacctaccgtacgttccttcgttccttccgtacc

SEQ ID NO: 76551 - DNA, 547 bp, Homo sapiens
  misc_feature: GYAE6OF01CFB2N.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctattctggctcccagtttcagataccaccggagagattgtgttgacacaatctccagccaccctgtcttcgtctccaggggaaangccaccctctcctgcagggccagtcagaatgttggcgcctacgtatcctggtaccaacagaaacctggccaggcctcccaggccccctcatctatggtgcatccaacaggggccactgggcatcccagccaggttcaggtggcaggtgggtatggggacagacttcactctacaccatcactcacgccgtggagccgtgaggatgttgacgtagtttattacgtgtacaactataccgtacgagtcggccgtccgggggtccctacgttccggccgtcgggaaccaaggtggatacgtacgaaacgactggtcgcgtgactaccatctcgtcttctac

SEQ ID NO: 76552 - DNA, 571 bp, Homo sapiens
  misc_feature: GYAE6OF01AGXGQ.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggaggcgtggtccagcctggggaggtcacagagactctcctgtgcagcctctgggttcaccttcagtagctacggcatgcacgtgggtcccgaccaaactccgaggcgaagggattgggaggtgggtggctagttgtttcagtcgtggagggctaggtgttacaagtggtatgctgaccgcgtaggacggccgtatcacatctcagacgacactacagaacacatgtattcgactagaacagacctaagtccgtagacggacgtacggtagtaacgtacgtacgtacggtaacggaaggggacggggaacgacggcgggtacgttaccgaagttacctacgttagcgtcggtcggggtaccg

SEQ ID NO: 76553 - DNA, 528 bp, Homo sapiens
  misc_feature: GYAE6OF01CLM7M.8.34.D01.1.454.CMB.1.raw
  modified_base (422)..(422): a, c, t, g, unknown or other
  misc_feature (422)..(422): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcactgggtccgccaagctccgaggcaagggattgggagtgggtggctagttgtttcatctgagggcagtgttcaatggtatgcagactcgtgaaggcgatcacatctcagagacaatcagaacacaatgtatttgganctagaacagacctaagtcctagacgacgacgggcgtatactacgtgtacggaagggaggggaacgaggacgggagttaccgaagtactcgttcgcgtcgtacgggg

SEQ ID NO: 76554 - DNA, 949 bp, Homo sapiens
  misc_feature: GYAE6OF01ETVXY.8.34.D01.1.454.CMB.1.raw
  modified_base (172)..(172): a, c, t, g, unknown or other
  misc_feature (172)..(172): n is a, c, g, or t
  modified_base (455)..(455): a, c, t, g, unknown or other
  misc_feature (455)..(455): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaaagnggtcgtctagtgtacaagtgactaacgtgggtggtagttcgggtggggggacggtcgggttcggtacccgacggtccggtagggggtacggtaccaacgaaggacgtaccttcgtcggtggtcgacgacgtcccttcggttcgggttccctacccttacgtaaacggttaaaccgtaccggctaagttcgacctacggttccggggtccccgaccgaacgtccctaccggaggacggtaagggtgttgggagggttggggtcggacgttaggttttcggttanacgttcggtagggacgggtacgtaggtttcgttaacgtaaggtttagggttagtacggaccgtaacggtaccccggttacgggttaagggaaccggggtacccgtttaacgttacccctaacccgttacgttcccccgttaaccgaaacgggtaaaccgaaaccgttaaaccgtttaacccggaaaccgggtaaaaccctaaacgtaagtttacgttttaagggtttacgggtaacgtacgttaacgaaaccggtaaccggttaacccgtttaaccggtaccgtaagggtacgggtaacccgggtaaccggggttaacttaaaccggttaaccttaccgggttaaacgggttaaccgggggaaaacggggggtaacccggggggtaaaccgagggggtaacccggggttaaacgtttaaaccccggttaaaccggtttacccggttttacccggtttaacggggttacccggttcccggggttaacccgggggg

SEQ ID NO: 76555 - DNA, 517 bp, Homo sapiens
  misc_feature: GYAE6OF01BJZ7V.8.34.D01.1.454.CMB.1.raw
  modified_base (210)..(210): a, c, t, g, unknown or other
  misc_feature (210)..(210): n is a, c, g, or t
  modified_base (316)..(316): a, c, t, g, unknown or other
  misc_feature (316)..(316): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
  modified_base (433)..(433): a, c, t, g, unknown or other
  misc_feature (433)..(433): n is a, c, g, or t
  modified_base (512)..(512): a, c, t, g, unknown or other
  misc_feature (512)..(512): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagngccaccctctcctgcagggccagtcagaatgttggcgcctacgtatcctggtaccaacagaaacctggccaggctccaggccccctcatctatggtgcatccaacngggccactggcatcccagccaggttcagtggcagtgggtatgggacagtctcactctcaccatcatccngcctggancctgaggntgtgactgtttattactgtacatatcgtacgngtcggccgtccggggtctcgttcgccgtggaccaagtcgatactacgaacgtactggtgcgtagcctacatctgttctntaccg

SEQ ID NO: 76556 - DNA, 591 bp, Homo sapiens
  misc_feature: GYAE6OF01EVUHO.8.34.D01.1.454.CMB.1.raw
  modified_base (302)..(302): a, c, t, g, unknown or other
  misc_feature (302)..(302): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagatgtgcgcctacgtatctgtaccaacagaaacctggccaggctcccaggcccctcatctatggtncatccaacacggggcccacgtggcactcccagccaggttcaggtggcaggtgggtatggggacagacttcacgtctcaccatcatcagtccgtggacgccgtgaggtattggttagtcttaaggttttacttacgtcgtacaacgtactacggtaaccgaggtacggtcccggtccgggggtcctacgttccggcccgtacgggaacctaaaggtcggtaatacgtaccgaaaaccgtacgttggtcggtactacggtaccaacgtacttacttcgttccttcgtaccg

SEQ ID NO: 76557 - DNA, 871 bp, Homo sapiens
  misc_feature: GYAE6OF01B2QQU.8.34.D01.1.454.CMB.1.raw
tcagctcgcgtgtccacgaccggtgctcgatttagatcgtctgtgttgggtttgggggaagaggaagactgacggtcctgccacaggtggtgtttccattcggtgatcagcactgaacacagaggactcaccatggagtttggctgaactgggttttcctcgttgcttcttttaagaggtgtccagtgtcaagtgcaacgtggtggagtcgtgggggagcgtagtccagccgtgggagtcacagagacctctcctgtgcacgccttcgtcggttcctaccttcagtacgcgtacggctagtcgccacgtcgggtaccccgaccaaaaccgtccgaaggaccgaaggggtagttgggaggtggggtgacgttagtttcgtttacagtcgtaggacgggtctaggttgttacgaagttggtatcggcgtaggaccggtaccggtaggaaccgggtccgtacttccgaacctacgtacccgtaccgaaggtaaccgaacctaaacccgttaccgaaacgggtaaacctaacgttaaacgtttacggtttaacggttttaccggaaacccgttaacggaaaccgtaaccggttaaacccgttaaaccggttacccggtaacgggtaaaccgggttaaccggttaaccgggggttaacgtttaaaccggtttaaacccgttaaaccgggttaacggggttaaaaccgggggtaaaacggggggtaaaccgggggggtaaaacccggtaacgggggtaaacccgggggttaaacccggtttaaacccggtaaaccgggttttaaccccggttttacccgggttttaaacggggtaaccccgggtttacccggggttacccgggggtaaaccccgggg

SEQ ID NO: 76558 - DNA, 790 bp, Homo sapiens
  misc_feature: GYAE6OF01CTGD5.8.34.D01.1.454.CMB.1.raw
  modified_base (210)..(210): a, c, t, g, unknown or other
  misc_feature (210)..(210): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaangccaccctctcctgcagggccagtcagaatgttggcgcctacgtatccgtggtaccaacagaaacctggccaggcctacccgacggccccctcactctagtggtgccactcccgaacgacggggcccaacgtcggacctacgtccccacgcccgtacgggtttcaacggttcggaccgtagggttacgggggttaagttcgggggaactaacgggtacctttaccgaccgttaccctaccaacccttattaccctaacgttaccgaaccggtccccgttacggggtaccggtcccggttagggaacgggttaactttcggggttttacgtaccgtttaaggtttttaacgttttaccgttacggtttaacctaaacgttacgttacccgggttaaccggtacgggttccggggtcccgggttacccggggggtaccccttaccgggttttcccgggaccccggttacgggtaaccgtaaacggtacggtaacgttaacgttaaccgaaaaccggtaacgttcgggtacggtaccgtacgacccgtaccctacgttccttacggttcctttccgtaacccg

SEQ ID NO: 76559 - DNA, 879 bp, Homo sapiens
  misc_feature: GYAE6OF01DROMR.8.34.D01.1.454.CMB.1.raw
  modified_base (210)..(210): a, c, t, g, unknown or other
  misc_feature (210)..(210): n is a, c, g, or t
  modified_base (254)..(254): a, c, t, g, unknown or other
  misc_feature (254)..(254): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaangccaccctctcctgcaggccagtcagaatgttggcgcctacgtntcctggtaaccaacagaaacctggaccaggcctcccacggcccctcactcgtatggtcgcactaccgaacgacgggccctacgtcggacctactccccgaagccgtaggttcaggtcggacgtagggttaggggtagtcggggaactaggtaccttacgaccgttcctaccgaaccctattaccgactaccgacggtacccgttacggggacgtcccgttagggtaacgggtaacgtttggtttacggtacgtttaacggttttttaacctttaaccgtttacggttaacccgtaaacgttaaccggtttacccgggtaaacccgggttacgggtttaccccgggggttacccccgggtttacccccggggggggttaacccctttaccccggggttttttaccccggggtaccccccggggtttaaccgggggtaaaacccccggttaaaacggggtttaccggggtaaaccgtttaaacccggttaaaacccgggtaaaaacccgggttaaaccggtttacggggttaccgggttacccggttaccgggtaacccccgtaacccggttaaaccgtttaccggttttcccggtttacccgttttaaccccgttttaacccccgg

SEQ ID NO: 76560 - DNA, 626 bp, Homo sapiens
  misc_feature: GYAE6OF01BV1FC.8.34.D01.1.454.CMB.1.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctctagccaccctgtcttcgtctccaggggaaanagccaccctctcctgcagggccagtcagatgttggcgcctacgtatcctggtaccaacagaaacctggccaggctcccaggcccctnatctatggtgcatccaacgacgggccacgtcggccactccccagccaggttccaggtggcaggtgggtatgggacagtacttcactctcaccatcatcgagcctggacgccgtgaggtattggtgacttagttttacttacgtgtaccaacgtcttaccgtacgaggtccggtacccggttcccggggtaacccttaccggttttcccgggcccgttaggggaaaccctaaagggtcggtaacttaacgtaccgtaaaaccggtaccgttagggtcgggaccttacggaccctaacccgtacgttaccttcggtttccctacgttacccg

SEQ ID NO: 76561 - DNA, 552 bp, Homo sapiens
  misc_feature: GYAE6OF01B04VX.8.34.D01.1.454.CMB.1.raw
  modified_base (208)..(208): a, c, t, g, unknown or other
  misc_feature (208)..(208): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (452)..(452): a, c, t, g, unknown or other
  misc_feature (452)..(452): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccaggggaaangccaccctctcctgcagggccagtcagatgtgcnctacgtatccnggtaccaacagaaacctggcccaggcctcccgaggccccctgactcctatggtcgcatcccaacgcgggccacgtggcactcccagccaggttcagtggcaggtgggtatgggacaggacttcacttctcaccatcatcagcctggacgccgtggaggtatggttcgactagtttattactgtacaactatccgtacgngtcggccgtccggggcctacgttccgccgtacggaccgtaaggtcggatacgtacgaaacgtacgtaggtcgcgtgacctactactctcgttctctaccg

SEQ ID NO: 76562 - DNA, 609 bp, Homo sapiens
  misc_feature: GYAE6OF01EUK2P.8.34.D01.1.454.CMB.1.raw
  modified_base (304)..(304): a, c, t, g, unknown or other
  misc_feature (304)..(304): n is a, c, g, or t
  modified_base (328)..(328): a, c, t, g, unknown or other
  misc_feature (328)..(328): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaagtggtggagtcgtgggggagcgtggtccagccgtgggagtcacagagacctctcgtgtgcagcctcgtgggttcaccttcagtaacctacggcatgcacgtcgggtcccnccaagcctaccgaggcgaagggtnttgggagtgggtgctagtttgttcagtcgtggagggtctaaggttgttacaagtggtatgcagtaccgtcggtaggaacgggcctactccacctatctacgagacgaactaacttaccaacgaacactaagtagttagtttaggagtcgtagaacacgtaccgtaagtccgtaggacggacgacggtacgtatacgtacgtagtaacggaacgggaacggggacgacgggacggtacgttacccgtaagtaccgttacgttacggtcggtcggtaccgggg

SEQ ID NO: 76563 - DNA, 642 bp, Homo sapiens
  misc_feature: GYAE6OF01ETAAY.8.34.D01.1.454.CMB.1.raw
  modified_base (299)..(299): a, c, t, g, unknown or other
  misc_feature (299)..(299): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctgggaggtcacagagactctcgtgtgcagcctctgggttcaccttcagtaactacggcatgcacgtgggtccnccaagcctccgagggcaagggatttgggagtgggtggctagtttgtttcatcgtggagggcaggttgttcaaagttggtatgacagtaccgtccggtaggaacgggccgtattaccacctatcctaccgagaacgaactaacttacccgaaggaaccaactaatagttagtttaggacgtactagaacctacgaccgtaacgtaccgtaggacggaaccgaccgggacgttaactaacgtacgtaggtaaacgggaacggggaacggggggaaccgagggtacggggtaacgttaccgtaaagttaccgttacccggtttcggtaccggttcggtaccggggg

SEQ ID NO: 76564 - DNA, 518 bp, Homo sapiens
  misc_feature: GYAE6OF01BTQXY.8.34.D01.1.454.CMB.1.raw
  modified_base (209)..(209): a, c, t, g, unknown or other
  misc_feature (209)..(209): n is a, c, g, or t
  modified_base (299)..(299): a, c, t, g, unknown or other
  misc_feature (299)..(299): n is a, c, g, or t
  modified_base (320)..(320): a, c, t, g, unknown or other
  misc_feature (320)..(320): n is a, c, g, or t
  modified_base (399)..(399): a, c, t, g, unknown or other
  misc_feature (399)..(399): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctacgtatcctggtaccaacacgaaacctggccaggcctcccaggccccctnatcctatggtgcatccaacgngggccactggcatccccagccaggttcagtggcaggtgggtatgggacagacttcactctcaccatcatcagcctggancctgagatgtgctagtttatctgtacaactatcgtacgagtcgccggtccggggcctacgttccggccgtacggacaaggtgatatacaacgtactggtgctgctacatctgtctgtac

SEQ ID NO: 76565 - DNA, 694 bp, Homo sapiens
  misc_feature: GYAE6OF01EGEZ7.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttggggagaactgctcagttaggacccagagggaaccatggaagccccagctcagcttctcttcctcctgctactctggctcccagtttcagataccaccggagagattgtgttgacacaatctccagcccaccctgtcttcgtctccgaggggaacncgcccaccctctcctgcgagggtccagtcaagaattggttcggcgcctacgtatccgtaggtaaccaacaacgaaacccgtggtaccacggccctacccgacggccccctcacgttcctagtcgggtcacctacgtacccgaaacggaccgggccaaccgtcggaccaacgtccccgaagtcccgtaagggttcagggttcggactagggtggggtaatggggaaccacggtacttcactcctacaacctataccaactcgacgtccgtagggactacggtaggtagtcttggtcgtactttagttaattcgtacgtactacgtacgttccggtaacgtcggttccgggacccggttccggggtaccttacccgggtttccggaccggtaacgggaacctaagggtcgtaacttacggaaaccgaaacggttctagggtaccgctacgaccctaccgtattcccgtttcgttacctcgttacccg

SEQ ID NO: 76566 - DNA, 616 bp, Homo sapiens
  misc_feature: GYAE6OF01D9ILH.8.34.D01.1.454.CMB.1.raw
  modified_base (210)..(210): a, c, t, g, unknown or other
  misc_feature (210)..(210): n is a, c, g, or t
  modified_base (401)..(401): a, c, t, g, unknown or other
  misc_feature (401)..(401): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaangccaccctctcctgcagggccagtcagaatgttggcgcctacgtatcctggtaccaacagaaacctggccaggcctcccgacggcccctcatctatggtgcactccaacgacgggccacgtggcactcccagccaggttcagtgcaggtggtatgggacagacttcactctcaccatcatcagcctggacncgtgaggtatgttgactagtttacttacgtgtacctaacgtacttccgtaacgtacggtcgggtcccggttcccgggggtacccttaccggtttccgggtacccgttacggggaacccgtaaaggtacggtaacgtaacgtaaccgaaaaccggtaacgttacggtcggaccgtacggaccctacccgtacgttccgttcgttccttcgttaccg

SEQ ID NO: 76567 - DNA, 555 bp, Homo sapiens
  misc_feature: GYAE6OF01A3RVZ.8.34.D01.1.454.CMB.1.raw
  modified_base (247)..(247): a, c, t, g, unknown or other
  misc_feature (247)..(247): n is a, c, g, or t
  modified_base (307)..(307): a, c, t, g, unknown or other
  misc_feature (307)..(307): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcncctacgtatcctggtaccaacagaaacctggccaggctcccaggcccctcatctatggtncataccaacagggccacgtggcactccccagccaggttcagtcggcaggtgggtatggggacaggtacttcactctcaccatcatcacgcctggacgccgtaggacggtattggttgactaggtttattacgtgtacctaactatccgtaccgagtcggtcccgtccgggggtcctacgtttcggacccgtacgggacctaaggtgactagtacgaaacgtatggcgcgtgctacatctgtctctacg

SEQ ID NO: 76568 - DNA, 788 bp, Homo sapiens
  misc_feature: GYAE6OF01DE82D.8.34.D01.1.454.CMB.1.raw
  modified_base (271)..(271): a, c, t, g, unknown or other
  misc_feature (271)..(271): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctggggagtcacagagactctcgtgtgcagcctcgtgggttcaccttnagtaactacggcatgcacgtcgggtcccaccaagcctccgaggcaagggnttgggagtgggtgctagttgttcatcgtggagggctaaggttgttacaaagttgggtaatcggacaaggtaccgttccgggtagggaaacggggtcccgtaatttcccaacccgtacttcctaccgaacggaacgtaacctaaacgttacccgaaacgggaaacctaaaccgtaaagttacggtttaagtttttacggggaacgtaccgttaacggaaaaccgtaacggtaaccccgtttaaacggttcccgttagggaacgggtaacccggtaccgggggtaccgttaaaccgttaaccgttaaaccggttacgggttaaaccgggaaaacggggggtaaccggggggggtaaaccccgtaaaggggtaacccgggggttaaaccggtttaaccccggtaaaacgggtttaacccgtttaccccggttttaacgggaacccgggtttcccgggtaacccggggggg

SEQ ID NO: 76569 - DNA, 599 bp, Homo sapiens
  misc_feature: GYAE6OF01CJQHT.8.34.D01.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (295)..(295): a, c, t, g, unknown or other
  misc_feature (295)..(295): n is a, c, g, or t
  modified_base (368)..(368): a, c, t, g, unknown or other
  misc_feature (368)..(368): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagatgttggcncctagntcctggtaccaacagaaacctggccaggcctcccgaggcccctnactctatggtgcatccaacgacgggccacgtggctaactccccagccaaggttcaggtggacaggtcgggtangggacagacttcactctcacctatcactcgagccgtggacgtccgtaggacggtattcggttgactagttttattacgtgttacaatacgttaccgtacgacggtccggccgtcccgggggtccctacggtttcccgggccgtacgggaaccctaaggtcggaactacgtacgaaaccgtagtcggtacggtccgtagacctacctacttccgtacgttccgttctaaccg

SEQ ID NO: 76570 - DNA, 580 bp, Homo sapiens
  misc_feature: GYAE6OF01A7ELU.8.34.D01.1.454.CMB.1.raw
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (356)..(356): a, c, t, g, unknown or other
  misc_feature (356)..(356): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccaggggaangccacctctcctgcaggccagtcagatgtgcnctagtatcctgtacaacagaacctggccaggctcccaggcccctnactctatggtcncactaccaacacgggccacgtggacactccccagccaggttccagtggcaggtcgggtanggggacagtacttcactctcacatcatcagcctggacgtcctgaggagttgttgtacttagtttattacgttcgtacaactagtaccgtacgaggtccggtcccggtcccgggggtacccttaccggtttccggcccgtacgggtaaccctaaagggtcggaacttaacgtaccgaaacgtacgtggtcggactcgacctaccgtacttctcgttcctctaccg

SEQ ID NO: 76571 - DNA, 664 bp, Homo sapiens
  misc_feature: GYAE6OF01AYMPU.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgagggaagcgccaccctctcctgcagggccagtcagaatgttggctcctacgtatcctggtaaccaacaccaaaccgtcggaccaggcctccgacggcccctcacttctagtcggtcgctactacccaaacgcggggccctacgtcggcctactccccgaggccctaggttccaggtcggacagggtggtagacgggacagtaccttcacctcgaccaccgactcactcgacgtccgtaggaccgtaccgtaggtaagtacgttcgttacgcgtttaagttttacgtactacgttacaactacgtacccgtacggtacggtcggggtccccggttaccgggggacccttaccggtttcccgggacccgtacgggaaccgtagggtacgacggtactaaccggtaaacgtacgtacggtcggtactacggaccctacgtacttccgttcggtcccttgtaccccg

SEQ ID NO: 76572 - DNA, 535 bp, Homo sapiens
  misc_feature: GYAE6OF01DTDHE.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctacgtatccgtggtaccaacagaaacctggccagctccaggcccctcatctatggtgcatccacagggccatggcatcccagccaggttcagtggcaggtgggtatgggacaggacttcgactctcaccatacactcacgcctggagccgtgagtatgtgtctagtttattactgtaccaactatcgtaccgagtcggtaccgtccgggggtactacgtttcggccgtgggaaccgaagtggatagtacgaaacgtacgtgtggctgacactatctctcgttctacg

SEQ ID NO: 76573 - DNA, 532 bp, Homo sapiens
  misc_feature: GYAE6OF01EAK53.8.34.D01.1.454.CMB.1.raw
  modified_base (428)..(428): a, c, t, g, unknown or other
  misc_feature (428)..(428): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcacgtgggtccgccaagctccgaggcaagggattgggagtgggtggctaggttgtttcatcgtgagggcagtgttcaatggtatgcagctcgtgaaggcgatcacatctacagagacaatccagacaacatagtagttggagntagaacacgacctaagtactgacggacgacggacgtatacgtactacgtacggaagggaggggacgaggacggagtaccgagtactacttcgcgtcgtacgggg

SEQ ID NO: 76574 - DNA, 617 bp, Homo sapiens
  misc_feature: GYAE6OF01EXJOP.8.34.D01.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (289)..(289): a, c, t, g, unknown or other
  misc_feature (289)..(289): n is a, c, g, or t
  modified_base (363)..(363): a, c, t, g, unknown or other
  misc_feature (363)..(363): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagccaccctctcctgcaggccagtcagatgtgcnctagtatctgtaccaanagaacctggccaggctcccgagcccctnatctatggtgcactccgaacgacgggccacgtcggcacgtcccagccgtaggttcaggtcggctaggtgggtangggacacgtacttcgactctacacctatcatcacgtcctggacgtccgtaggagtagttcgtacgtacgttaagttttactacgtacgtacctaacgtacgttaccggtacgacggttaccgggccccggtaccggggtacccttacggtttacccggaccggtacgggtaaccgtaaggtcgtaactaacgtaaccgaaacgtacgttggacgtacgtacgaccgtacctagttcctcgttcctcgttacccg

SEQ ID NO: 76575 - DNA, 588 bp, Homo sapiens
  misc_feature: GYAE6OF01AEJ70.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggagcggtggtccagccgtgggaggtcacagagactctcgtgtgcagcctctgggttcaccttcagtaactacggcatgcacgtcgggtcccgccaagcctccgaggccaagggattgggagtggggtgctaggttgtttcattcgtggagggctaggttgttacaagttggtatgcagactccggtaggacgggccgatcactatctcagacgacaactccagaacaacatagtagttggagtctagaacacgtacctaacgtccgtaggacggacgacgggtacgtactacgtacgtagtacggaacgggagggggaaccgacgggacgggtacgttaccgtaacgtacgttaccgtttcgacggtcggtaccgggg

SEQ ID NO: 76576 - DNA, 601 bp, Homo sapiens
  misc_feature: GYAE6OF01BQ3W2.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctgtgtgcagcctctgggttcaccttcagtaactacggcatgcactggtccgccaagctccgaggcgaagggacttggagtgggtggcaggttgtttcatcgtaggagggcagttgttacaagtggtatgctagactccgtagagggccgacttacaccatctaccagacgacattaccagaacacaactgtactttggagctagtaacacgtaccgtaagtacccgtaggaacggacgacgggtacgtactaccgtacgtacggtaacgggaacgggtaaccgggggaaacggtacgggacgggtaacgttaccgtaacgttaaccgttaccgtttcggtaccggtcgttacccggggg

SEQ ID NO: 76577 - DNA, 536 bp, Homo sapiens
  misc_feature: GYAE6OF01CGNLG.8.34.D01.1.454.CMB.1.raw
  modified_base (209)..(209): a, c, t, g, unknown or other
  misc_feature (209)..(209): n is a, c, g, or t
  modified_base (363)..(363): a, c, t, g, unknown or other
  misc_feature (363)..(363): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctcccaggccccctcatctatggtgcatccaacagggccactggcatcccagccaggttcagtgcagtgggtatgggacngacttcactctcaccatcatcacgcctggacgccgtgaggatgttgctagttttattacgtgtacaactagtcgtacgtagtcggccgtccgggggtcctacgtttccggcccgtcggaccgtaaggtggatactacgaaacgactaggtcggctgcacatctcgtcttctac

SEQ ID NO: 76578 - DNA, 774 bp, Homo sapiens
  misc_feature: GYAE6OF01A57OB.8.34.D01.1.454.CMB.1.raw
  modified_base (319)..(319): a, c, t, g, unknown or other
  misc_feature (319)..(319): n is a, c, g, or t
  modified_base (531)..(531): a, c, t, g, unknown or other
  misc_feature (531)..(531): n is a, c, g, or t
tcagctcgcgtgtccacgaccggtgctcgatttagatcgtctgtgttgggtttgggggaggaactgctcagtttaggacccgagaggggaaccatggaagccccaggctcagcttctacttcctcctgctactctggctcccagtttcagataccaccggagagattggtgttgactacaatctccagccaccgtgtcttcgtctccgaggggaaactcgcccgaccctcgtcctgcagggccagtcagactcgtacgcgcctagtactcctcgtaccacacgaaccgtcggccaaggcctacccgacggtccccctanatcctagtcgggtcgcctacgtacccaacggacgggtccaacgtcgggacctaaccttccccgaaggtaccccgtaagggttttccaagggttcgggacccgtaggggttcgggtaacgtacgggggaactacggtacctttccgaaccgttccgtaaccaacctacgttaccaattccgaacgtcccgtagggacctccgtaggaacggtnttcggttacgaccgtttaagttttacgtaaccgttgtacctaaacgtcgttaccggtacggtacgggtccggtcccgggttaccgggggtacccttacggttttcccgggacccggttacggggtaacccggtaaggggttaccggaacggttaacgtaaccccggtaaaacgggtaccgttgggtacccggtacgttacgacccgtaaccgtacgtttaccgtcggttccttccgtaacccg

SEQ ID NO: 76579 - DNA, 778 bp, Homo sapiens
  misc_feature: GYAE6OF01D1E3N.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagactaccacggagagattgtgttgacacaatctccacgccacctgtcttcgtctccgaggggaancgcccaccctctcctgcgcgggccagtcaagatggttcggccgtcctacgtatccgtcggtaaccaacgagaaccgtggaccacggtcctaccgacgtcccctgtactcgtagtggtcgacctactacccgaacgtacgggaccctacggtcggacctaccgtaccgacgtaccgtacgggttcacgggtggaccgtaggggttacgggtacgtcggggactaacggtaccttacacgttaccctacaaccgtacttacacgtaccgtaacggtccggtagggaccgttaccgggttaggtaacgggttaacgttcgggtttcggtaacgtttttaaacggtttttacgttacccgtttacgttaaccgaacgtttaacccggttacgggtaacccgggttaaggggttccccgggtaccccggggttcccggggtacctttacccggggtttccgggaaccccggtttaacggggaaacctaagggtacgtaacgttacgtaaaccggtaaacgtacgtcgggttacgtaccgtcgaaccgtcgttactccgttacttcgtacctccg

SEQ ID NO: 76580 - DNA, 717 bp, Homo sapiens
  misc_feature: GYAE6OF01BPUA9.8.34.D01.1.454.CMB.1.raw
  modified_base (171)..(171): a, c, t, g, unknown or other
  misc_feature (171)..(171): n is a, c, g, or t
  modified_base (272)..(272): a, c, t, g, unknown or other
  misc_feature (272)..(272): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactggtggagtcgtgggggagcgtggtccagccgtgggagtcacagagactctcgtgtgcagccttcgtggttccaccttnaagtaactacgctatgcacgtcgggtccaccaagcctacgaggaccgaagggtattgggaggtcgggtgcgtaggtttgttacagttcgtggagggtctaggttcgttacaagtggtatcggactaacgggtctacgggtacggaacggtccgtacgttaccgacctagtcctaccgaagaaccgtaactaacgttacccgaaggtaaacctaacgtaacgttagttacgtttaggaacgtacgttaacgaaacgtaacggtacccgttaacggtacccgtacggtaacggtaaccggtacgggtaccgttaacgttaaccgtaacggttaacggtaaaccggggtaaacggggaaccgggggtaaacccggagggtacccggggtaacgttacccgtaacggttaccgtttccggttaacgggtaccggtacgggttaccgggg

SEQ ID NO: 76581 - DNA, 733 bp, Homo sapiens
  misc_feature: GYAE6OF01EIPI6.8.34.D01.1.454.CMB.1.raw
  modified_base (210)..(210): a, c, t, g, unknown or other
  misc_feature (210)..(210): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagcccaccctctcctgcagggccagtcagtatgttggcgcctacgtatcctaggtaccaacagaaacctggaccaggcctcccgacggccccctacgactcttagtgggtcgaccaactacccaaacgacgggcccaacgtcggactactcccagaccaggttcaggtgcgaggtgggtatgggacaggtactcacctctacgaactctacatcgacgtcccgtaggacgtccgtggtaacggtagttggtacggtacgtttaagtttttaacttaccgttaggttaccaaacgttaaccgttccgggtaaaccgggtacgggttacccgggtccccggggttacccggggggtacccttaacccgggttttcccggggacccccggttaacgggggaaaccctaaaaggggttcgtaaacgttaaccggttaaaccgaaaaccgggttaacgtcgggttacgggtaccgtacggaacccgttaaaccgtacggtttccttcggtttaacccttccgttaccg

SEQ ID NO: 76582 - DNA, 689 bp, Homo sapiens
  misc_feature: GYAE6OF01DWBRJ.8.34.D01.1.454.CMB.1.raw
  modified_base (351)..(351): a, c, t, g, unknown or other
  misc_feature (351)..(351): n is a, c, g, or t
  modified_base (402)..(402): a, c, t, g, unknown or other
  misc_feature (402)..(402): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtgggtggagtcgtgggggaggcgtggtccaggccgtggggaggtcacagagactcgtcgtgtgcacgccttcgtcgggttccacctttacaacgtaaccgtacggctaatcgctacggtcggggtcccaccaagcctaccgaggacgaaagggtnttgggagtggggtgcttagttcgttcagtcgtggagggtctaggttcgtanaagttggtatggactacggaccgttcggaaggaccgggtccgtattacccgactactaccgtaccgaagtaacgtaacctaaagttacccgaaggaactaacgtaagttagttacgtttaggagtaccgtagaacgtacgtaccgttaacgtacgtaggacggaacgtacgggtactacgtaccgtacgtagggtaacgggaacggggtacggggaacgtacgggacgggtaacggttaccgtaacggttaccgttaccggtttacggccggttcgggtacccgggg

SEQ ID NO: 76583 - DNA, 592 bp, Homo sapiens
  misc_feature: GYAE6OF01EOAF9.8.34.D01.1.454.CMB.1.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (407)..(407): a, c, t, g, unknown or other
  misc_feature (407)..(407): n is a, c, g, or t
  modified_base (421)..(421): a, c, t, g, unknown or other
  misc_feature (421)..(421): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagccacctctcctgcagggccagtcagatgtggcncctagtatcctggtaccaacagaaacctggaccaggctcccacggcccctcatctatggtgcatccaacacgggccacgtggcactcccagccaggttcaggtcgcgtaggtcgggtagtgggactacgtacttcactctccacctatcatcagcctggacnccgtgagtatgttnactagtttattactgtacaacgtactacgtacggagtccggccggtcccgggggtaccttaccgtttccgggacccgttacggggaacctaaacggtggtaacgttacgaacgtaaaccgtacgttaggtcggaccgtgacccgtctaacgttcttcgttccttcgtaccg

SEQ ID NO: 76584 - DNA, 759 bp, Homo sapiens
  misc_feature: GYAE6OF01C24C8.8.34.D01.1.454.CMB.1.raw
  modified_base (341)..(341): a, c, t, g, unknown or other
  misc_feature (341)..(341): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgacaactgggtggagtcgtgggggagcgtagtccagccgtgggaggtcacagacgactctccgtgtgcacgcctcgttgggttaccacctttcaaggttacgcctaacggcatgccacgtgggtcccaccaaactccgaggacgaagggtnttgggaggtcgggtgctaggttcgtttacattccggtaggacgggtctaggttcgtttacgaaagttgggtaactggccgttaggaacccggtccggttaagggaacccggggtcccggttaactttacccgaacccgtacgttaccgtaacccgaaacggtaaccgaacctaaaacccgtacccgaacgggtaaaccctaacgtaaacgttacgtttaacgttttacgggaaccctacggaaccgtaacgtacccgtttaaagtcccgtacggaacggaacgtaacgggttagttaacttaaccgttaacgtacgggtaacgggaaacgggggacgggggaaaccgtacggggaccgggtacgtttaacccgaaacgttcccgtttacgttacggaccggtcggtcggggtacccgg

SEQ ID NO: 76585 - DNA, 537 bp, Homo sapiens
  misc_feature: GYAE6OF01BZMD1.8.34.D01.1.454.CMB.1.raw
  modified_base (209)..(209): a, c, t, g, unknown or other
  misc_feature (209)..(209): n is a, c, g, or t
  modified_base (413)..(413): a, c, t, g, unknown or other
  misc_feature (413)..(413): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggcctcccaggcccctcactctatggtgcatccaacgagggcccacgtggccatccccagccaggttccaggtcggctaggtgggtatggggactagacttcactctcaccatcatcagcctgagcctgagntgtgctagtttntatgacaatntccgtacgngtcggccggtccggggtcctacgtttccggccgtacgggaccaagtggatatacgtaaacgatgtcggctgactacctatcttctcttctccg

SEQ ID NO: 76586 - DNA, 781 bp, Homo sapiens
  misc_feature: GYAE6OF01D4DJV.8.34.D01.1.454.CMB.1.raw
  modified_base (176)..(176): a, c, t, g, unknown or other
  misc_feature (176)..(176): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttctttaagaggtntccagtgtacaagtgcaagtggtggagtcgtgggggagcgtggtccagccgtgggagtcaacagagacctctcgtgtgcagccttcgtgggttaccacccttcgaacgttaactacggctatcgtaccgtgggtcccaccgaagcctaccgagggaccgaagggtattgggaggtgggttgcttagtttgttacgagttcgtggaggctaggtcgttacgaaagttggtatacggcgtaacgtaccgttaccggtaggtaaacggggtccctaacgtttacccaacccgtacgtaccgttaccgaaacggtaacgtaacgtaaaccgttacccgtaaccggtaaaaccgtaaaccgtaaagtttaggttaacgttttacgggaacgttaacccgttaaggtaaaccgtaacggtacccgttaaacggtacccgttaacggaacgggaaccgtaaccggggtaccgttaacgttaccggttaaaccgttaacgggttaaccggggaaacgggtaacggggggaaaccccgtaagggtaccgggttaacggttacccgaaccgttaccgttaccgtttacggtaccggttccgtcgggggtaacccg

SEQ ID NO: 76587 - DNA, 700 bp, Homo sapiens
  misc_feature: GYAE6OF01DU3SK.8.34.D01.1.454.CMB.1.raw
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
  modified_base (337)..(337): a, c, t, g, unknown or other
  misc_feature (337)..(337): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacagagactctcgtgtgcagcctgtggttcaccttcagtaactcggcagtgcacgtcgggtccncaagcctcgaggcgaagggtnttggagtgggtgctagttnttcatcgtggaggctagtgttacaagttggtatgactacggtacttccggaggaacgggtcctacttacccaacctactcctaccgaagtaacgtaactaacttacccgaagaaacctaacgtaagttacggttaagtttacgggaacgtaccgtacgaaaccgtacgtaacccgttaacgttaccgtagggaaccggtaccggtaccggggtaacttaaacgtaccgttaaccgttaacgggtaaaccgggtaaacgggggtaaccgggggaaaccggacggggtacccggggtaaccgtttacccgtaaacggttacccgtttacccggtttacggtaccgggttccgggtaacccggggg

SEQ ID NO: 76588 - DNA, 539 bp, Homo sapiens
  misc_feature: GYAE6OF01AX8I6.8.34.D01.1.454.CMB.1.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
  modified_base (403)..(403): a, c, t, g, unknown or other
  misc_feature (403)..(403): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaangcccaccctctcctgcagggccagtcagatgtgcnctacgtatcctgtaccaacagaaacctggccaggcctcccaggcccctnatcctatggtnccatccaaacgcgggccacgtcggcactcccagccaggttcaggtggcaggtgggtatgggacagtacttccactctacacatcatcacgcctggacncctagaagagttgtgactagtttattactgtacaacatcgtacgagtcggcccgtccggggtcctacgttccgcccgtgggaccagggtgacgagtacgaacgtatggtcgctgaccactagtctgtcttcgtacc

SEQ ID NO: 76589 - DNA, 842 bp, Homo sapiens
  misc_feature: GYAE6OF01DZKWS.8.34.D01.1.454.CMB.1.raw
  modified_base (211)..(211): a, c, t, g, unknown or other
  misc_feature (211)..(211): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtccttcgtctccgaggggaaancgccaccctctcctgcacgggccagtcagaatggttcggcgcctacgtactccgtaggtaccaacacgaaaccgtcggaccaggcctcccgacggtccccctcactcctagtcggtcgcctactacccgaaacgaccggggaccctaacgtcgggaccaccgttccccgaacggtcccgtaacgggtttcagggttcggtaccgtagggttcggggtaacgttcggggaacctacgggttacctttacgaaccgttcccgttaccgaacccgtattaccgaacgttccgacggtacccgttacgggaaccgtcccgtaagggtacggtacgttcggtttaccgtacgtttaaggtttttaacgttaccgttacggttaacctaaacgttacgttaccgggttaaccggtgggtttacccgggtccccgggttacccggggggttacccctttacccgggtttcccggggtaccccggtttacggggaaaacccgttaaacgggttaccgggaaacgtttaaaccgtaaaccgtaaaacccgggttaacgttccggggttaacgggtcccgtttacggaccccgttaaccgttacgtttacccggttacgtttcctttacccggttaacccg

SEQ ID NO: 76590 - DNA, 682 bp, Homo sapiens
  misc_feature: GYAE6OF01CUEJF.8.34.D01.1.454.CMB.1.raw
  modified_base (323)..(323): a, c, t, g, unknown or other
  misc_feature (323)..(323): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacagagactctcgtgtgcagtcctcgtgggttccaccttcaagtaactacggcatgcacgtgggtcccaccaaactccgaggcgaaggtnttggagtgggtgctaggttgttcagtcgtggaggctagttgtacaagttggtatgacgtacgtaccgttccggtaggaaaccggggtcctacgttaccgaacccgtactccgttaccgaaggtaacgtaaaccgtaaacgttacccgaagggtaaaccctaacgtaaacgttacggttaagtttacgggaacgtacgtaacgaacgtaacgtaacccgttaacgtccgtaggaacgaaccggtacgggtactaacgtacgtacgtaggtaaccggaaggggtaacggggaacgagggtaaccgggtacgttaccgaacgttacccgttacgttacggccggtcgggtcggggtacccgg

SEQ ID NO: 76591 - DNA, 700 bp, Homo sapiens
  misc_feature: GYAE6OF01CB1RR.8.34.D01.1.454.CMB.1.raw
  modified_base (277)..(277): a, c, t, g, unknown or other
  misc_feature (277)..(277): n is a, c, g, or t
  modified_base (307)..(307): a, c, t, g, unknown or other
  misc_feature (307)..(307): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggaggcgtggtccagccgtggggagtcacagagactctcgtgtgcagcctcgttgggttccaccttnagtaactacggctatgcacgtcgggtcccncaagcctccgaggcgaagggtattgggaggtgggtggtctaggttgtttcattcgtggacgggtctaggttcgttacaagttggtatcgactacggtaccgtccggtaggaacgggtccgtacgttccaacctacttcctaccgaagtaacgtaacgtaaacgttaccgaaacgggtaaacctaactaaagtttacgtttacgtttagggacgtacgttacgaaccgtacgtacccgtaacgtccgtaggaacggtaaccggtacgggtacgttaacgttaacgtacggtacggtaacgggaacgggggtaacgggggaaaccgagggtaccgggtaaccgttaaccgtaacggttaccgttccgtttaacggtccggttcgggtacccgggg

SEQ ID NO: 76592 - DNA, 603 bp, Homo sapiens
  misc_feature: GYAE6OF01AF4XI.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccaggcctggggaggtcacagagactctcgtgtgcagcctctgggtcaccttcagtaactacggcatgccacgtggggtcccgccaaggcctccgaggcaaggggattgggaggtgggtggctaggtttgtttacattcgtggagggtctaggtgttacaagttggtatgacaggtacgtccgtaggaacgggtcccgtattccacctatcctccgaagacgaactaacgttaccgaaggaacaacaatagttagtttaggagcgtagaacgacgacctagtcgtagacgacgacgggcgtatacgtacgtaggtacggaagggagggggaaccgaggacgggtacgttaccgtaagttacctacgtttcggcggtcgtacgggg

SEQ ID NO: 76593 - DNA, 805 bp, Homo sapiens
  misc_feature: GYAE6OF01ET7E2.8.34.D01.1.454.CMB.1.raw
  modified_base (277)..(277): a, c, t, g, unknown or other
  misc_feature (277)..(277): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactgggtggagtcgtgggggagcgtggtccagccgtggggagtcacagagactctcgtgtgcagtcctcgtcggttccaccttnagtaactacggcatgcacgtcgggtcccaccaagcctaccgaggcgaagggtattcgggaggttgggtggcttaggtttcgtttcgattccgtggagggtctaggttcgttacaaggttggtactcggacgtaacggtaccgttcggtagggaaccgggtcccgtacgtttacccaaccctacttccgttaccgaaggtaactaaccgtaacgttacccgaaacgggtaaacctaacgttaaagtttcgggtttaagtttacgggaacgtaccgttaacggtaaaccgtaaccggttacccgttaaacgggttcccgtaacgggtaacgggaacccggtaaccggggttaccgttaaacgttacccgttaaaccgggtaacgggttaaacccggggggtaaaaggggggaacccggggggtaaaccgacgggggttaaccggggtaaaccggtttaacccgggttaaacggtttaacccggtttacccgggttttaacgggcccgggttccgggggttaacccggggg

SEQ ID NO: 76594 - DNA, 676 bp, Homo sapiens
  misc_feature: GYAE6OF01C1G40.8.34.D01.1.454.CMB.1.raw
  modified_base (211)..(211): a, c, t, g, unknown or other
  misc_feature (211)..(211): n is a, c, g, or t
  modified_base (294)..(294): a, c, t, g, unknown or other
  misc_feature (294)..(294): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtccttcgtctccgaggggaaangcccaccctctcctgcagggccagtcagatgtgcgcctagatcctgtaccaacagaacctggccaggcctccacggcccctanactctatcggtcgacactaccgaacgacgggcccaacgtcggacactccccgagacccgtaggttcagtcggaccagggtggggtaatggggactaggtaccttcactctaccaccgtatccgatcgacgtccgtggaacgccgtagacgtattcggtcgacttaggttttaactaccgtgttacctaacgtacttaccggtaaccggtaggtccgggtccccgggttacccgggggtacccttaccgggttttcccgggaccccgttacggggaaacctaaacgggtggtaactaacgtaaccgaaaaccggttaacgttcgggttacggaccgtacggaaccctaacgttacttacgttaccgttcctttacgtaccccg

SEQ ID NO: 76595 - DNA, 757 bp, Homo sapiens
  misc_feature: GYAE6OF01BSGWM.8.34.D01.1.454.CMB.1.raw
  modified_base (337)..(337): a, c, t, g, unknown or other
  misc_feature (337)..(337): n is a, c, g, or t
tcagctcgcgtgtccacgaccggtgctcgatttagatcgtctgtgttgggtttgggggaagaggaagactgacggtcctgccacaggtggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtagtccagccgtgggagtcacagagactctcctgtgcacgcctcgtcggttccaccttgagtagccgtacggcatgctacgtcgggtcccacctaaactccgaggcgaagggtnttgggagtgggtgtctaggtttcgtttcgagttcgaggaggactagttcgttactaaggttggtatcggtacgtcggaccggtacggtacggaacgggtccgtacgttaccgaacctacgttaccgtaccgtaacggaaccgaaccgtaaacccgtaccgaaacgggtaaacctaaacgtaacgtttacgttaacggtttacccgggtaacctaacgtaaaccgtacgttaacccgttaacggtaccggtacggaacggtaaccggttacgggttacttaacgtaaccgttaacggttacgggtaaacggggaaacggggtaaccgggggaaccgtacgggtaccgggttaacgttaacccggtaaacgtttacccgtttacggttacggtaaccggttccgggtaccggggtaacccgg

SEQ ID NO: 76596 - DNA, 848 bp, Homo sapiens
  misc_feature: GYAE6OF01ET6FW.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtcgtccgggaaggaagccgaccctcctcctcgtcgacgggacggacgtacgtacgaagtagttcgggtcgccgtaccgttactaccgtcgtaccgaaaccaacgtaaaccgtacggccggaccggtaccgtcccgtaccggaccccgtccctactacgttaccgttgggtcggtacacgtaccgaaaccggaacggggcccggaaccgtacgggtaccgaaccctaccccacccggaaccggtaccgggttaccggtaacgtcggggtcggtacgggtaggggttagggttacggggacggaacgttaaccgtccgtacctacttaccgaaccctaacttacaccgtaacctccggaccgttccgggtacgacccgttacgggagtaaggtttcgttggttacccgttaaggttttaattttaccgcggttaaccctaacgtaaccgttacccggtacccgggtaacggttccggggtccccgggtaccccgggggttacccgtacgtttttaccccgggacccgggtacgggtaaaccggaaacggttgggtaccttaaacgaacccggttaaaaaccggtacggtggttccggtctccgtaaccaaccccggttatttccggtacctttttcgccccttaaggttcccccc

SEQ ID NO: 76597 - DNA, 821 bp, Homo sapiens
  misc_feature: GYAE6OF01BCURP.8.34.D01.1.454.CMB.1.raw
  modified_base (334)..(334): a, c, t, g, unknown or other
  misc_feature (334)..(334): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggaggcgtggtccagccgtggggagtcacagagactcgtcgtgtgcagcctcgtggttccaccgttcacgtaactacggcatgcacgtcggggtcccaccgaagcctaccgaggcgaaggggtnttgggaggtgggtggctagtttgttcagtcgtggaggtctagttcgttacaagttgggttatcggcgtacggaccggtccggttaagggaaccggggtccgtaactttcccgaacctacgttacccgtaccgaaaggaaccgtaaccaaacccgtacccgaaaggaaaccctaacgtaaacgtttcggttaacgttttaccgggaacccttaagtaaaccgtaaccggtaaccccgtttaaacgggtaccccgtaggggtaaaccgggtaccggttaacggggttagttaaaccgtttaaccggttaaccggttacgggtaaaacccgggggtaaaggggggggtaaacccggggggtaaacccggtaaccgggggttaaccgggggttaaacccgtttaaaccccggtaaaccggttttacccggttttacccggtttaacgggtacccgggttacccggggttacccggggggtaacccccgggg

SEQ ID NO: 76598 - DNA, 660 bp, Homo sapiens
  misc_feature: GYAE6OF01DPT50.8.34.D01.1.454.CMB.1.raw
  modified_base (208)..(208): a, c, t, g, unknown or other
  misc_feature (208)..(208): n is a, c, g, or t
  modified_base (255)..(255): a, c, t, g, unknown or other
  misc_feature (255)..(255): n is a, c, g, or t
  modified_base (293)..(293): a, c, t, g, unknown or other
  misc_feature (293)..(293): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagactaccacggagagattgtgttgacacaatctccagccacctgtcttcgtctccgagggaaancgccaccctctcctgcgagggccagtcagatgtgcgctacgtatccngtaccaacagaacctgccaggcctcccgacggcccctnactctagtggtgctactaccaacgcgggcctacgtcggctactcccgaagccgtaggttcaggtcggactaggtgggtagtgggacacgtacttcgactctacactatcatcgagcgtaggacgtcgtagaggtgttagttcgacgttaagttttactacgtcgtaacaacgtacgttccgtaacggtaggtccgggtcccggtaccgggggtcccttaccgggtttcccgggacccgttacgggaaacccgtaaacgggttcggtaaacgttaaaccgtaaccgtaaaacggtacggttacggtcggtaccgtaccggtaacctaaccgttaacgtttcccgtttcgttacctttccgttaacccg

SEQ ID NO: 76599 - DNA, 841 bp, Homo sapiens
  misc_feature: GYAE6OF01AYPEZ.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggtttcctcgttgcttctttaagaggtgtccagtgtcaagtgcaacgtggtggagtcgtgggggagtcgtggtccaggcctggggaggtcacgagagacctctcggtgtgcaggcctcgtcgggttcacctttcaaggtaaataccggcaagttcgacacgtcggggcccgtaccaaaggcctacccgaacgggaccgaaaggggtactttggggaaggttcgggggtaggccgtaaggttttcgttttaccgaagttccggtaggtacggggggaccttaaggggttcggtttaccgaaaagtttcgggggttaaagtacggtcgaaacggtaaaccgtttcccgggtaaagggaacggggtacccgtaacgtttaccgaaccccgtagttaccccgtacgtaacgaacgggaacctaaacgttacccgaaacgggtaaccaaacgtaacttacggttaagttttacgggtaagtaccgtaaggtaaccgtaaggtaccccgtttaaaggtccccgttagggtaacgggtaaccgtaaccggggtaccgttaaacgttaaaccggttaccggttaaaggtaacgggaaaccggggtaacggggggaaaccgaaaggggtaccgggtaacggtttacccggaaacggtttaacgttaacccggtttagggtaaacggttcgggtaaacccggggg

SEQ ID NO: 76600 - DNA, 636 bp, Homo sapiens
  misc_feature: GYAE6OF01BYVDE.8.34.D01.1.454.CMB.1.raw
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctaccgaggggaaancgccaccctctcctgcagggccagtcagagtgttaccacctagttacgcctaggtaccaacaacaaacctgccaggctcccacgccccnactcttgactgcactccatcaggccactggcactccagccgtaggttcagtcggcgtaggtggtcgtaggacagtacttcacgtctcacctatccagcagaccgtagacgtacctagaagttacgtttacgacttagtttaattacttacgtacctaactacgttacgtaaccgtacggtacggtcccggttacccggggtacccttaccggtttcccgggacccgttaacgggtaaccctaaaagttacggtaacgtaacgtacgtaaaaccgtacgtacggtacggtcctaccggtaccacctaacgttccttacgttccttcgtaccttccccg

SEQ ID NO: 76601 - DNA, 691 bp, Homo sapiens
  misc_feature: GYAE6OF01C2IRS.8.34.D01.1.454.CMB.1.raw
  modified_base (331)..(331): a, c, t, g, unknown or other
  misc_feature (331)..(331): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactcgtcgtgtgcagcctcgtggtctaccttcagtaactacggcatcgctacgtcgggtcccaccaacgcctaccgaggccgaagggtnttgggaggtgggtggcgtaggtttcgtttcagttcgtggagggtctaggttcgtacaagttggtatgcgtagtacgtcggtaggaacgggtccgtattccacctatcctacgaagacgtaactaacgtacccgaacggtaaactaacgtaagttcgttaagtttggaacgtacgtacgaaacgtacgtaacccgttaacggtccgtaggaaccggaccggtaccgggtacgttaacgttaaccgtacgttaacggtaaacggggaaacgggggaacgggggaaaccgacggggtacgggtaaccgttaccgtaaacggttacccgttaccggtttacggaccggttcgggtaacccgggg

SEQ ID NO: 76602 - DNA, 538 bp, Homo sapiens
  misc_feature: GYAE6OF01AKAPG.8.34.D01.1.454.CMB.1.raw
  modified_base (295)..(295): a, c, t, g, unknown or other
  misc_feature (295)..(295): n is a, c, g, or t
  modified_base (376)..(376): a, c, t, g, unknown or other
  misc_feature (376)..(376): n is a, c, g, or t
  modified_base (494)..(494): a, c, t, g, unknown or other
  misc_feature (494)..(494): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcactgggtccnccaagctccgaggcaagggattggagtgggtgctagttgttcatcgtggagggtcagtgttacaagtggtatgcagctcgngaggccgattcacatctcagagacatcagaacacatgtattgagtctagaacacgaccgtagtccgtagacgacgacggtacgtacgtactacgtagtaacggagggacggggaacgnggacgggtagtaccgacgtaccgtcgttacgtcggtcgtacggg

SEQ ID NO: 76603 - DNA, 804 bp, Homo sapiens
  misc_feature: GYAE6OF01DPJR8.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccagtggtagtttggctgtaacgttgggttttcctcgttgtcttcgttttaagaggtcgtccagtgtacaagtcgctaacgtggtggagtcggtgggggaggcggtcggtccgaggccgtggggaggtacacgagacgacctcgtcggtgtcgaccacggtcccttcggttcgggttacctaacccgtttacgaaacgttaaccgtaccggctacgtcgaccgtacggtccgggtacccgacctaacgccctaccggagggacgtaagggtacgtcgggtaggttggggtcgtacgtttaggttttcgttcaacggtttcggtagggaacgggtctaaggtttcgtaacgaaggttcggtatcgacgtacggtacccgtcggtaaggaaccgggtcctatacccactaccgttcgtaaccgaagtaaccaaccgttacgtaacccgaaacggtaacctaacgtaaaggttgttaaaggtttcggaacgtacgtaacgtaacgtaaccgtaccgttaaacggtcgtaacggaccggttaaccggacggttaaccgtaagttaccgtaacgggtaaacgggtaaaccggggaaagggggtaacccgggaaacgtcggggtaacggttaaccgttaaccggttaacgttacccgtttagttacgggagttccgggtaaccggg

SEQ ID NO: 76604 - DNA, 612 bp, Homo sapiens
  misc_feature: GYAE6OF01C4IWC.8.34.D01.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaaangccaccctctcctgcagggccagtcagatgtggcncctagtntcctgtaccacagaacctggccaggcctccaggcccctcatctatggtgcatccaacgcgggccactggcactcccagccaggtcagtggcaggtggagtggganagacttcactcncacatcatcacgtcctggacgtcctaggacggtattggttgacgttagttttacttacgtgttactaacacttaccggtaccgtaggtccgggtcccggtcccgggggtaccctaccgtttcccgggacccgttcgggtaaaccccgtaaagggttacgggaacttaacgtaccgtaaacggtaacgtcgggttacggccttaggccctaacctacgttacctttcggttccttcgttaacccg

SEQ ID NO: 76605 - DNA, 734 bp, Homo sapiens
  misc_feature: GYAE6OF01B4FQF.8.34.D01.1.454.CMB.1.raw
  modified_base (331)..(331): a, c, t, g, unknown or other
  misc_feature (331)..(331): n is a, c, g, or t
  modified_base (397)..(397): a, c, t, g, unknown or other
  misc_feature (397)..(397): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtggtccaggcctgggaggtcacgagagactctcgtgtgcagcctctagggttccaccttcagtaacctacggcatgcacgtcggggtcccgccaagcctccgaggacgaagggtnttagggagtcgggtgcgtagttcgttacagtcgtggagggtctaggttcgttacagttagggttanaggactaagtaccgtccggtaaaggaaccgggtacctacgttacccgaacctacgttacccgtaaccgaaaggtaaccgtaaaccgtaaacgttacccggaaacgggtaaaccctaaagtaaagttcggtttaagtttcgggaacgtactacggaaactaccggtaccgtaacggttccgtaacggaacggaccggacggtaacgtaacgttaacgtaccgtaaggtaaacggggaacgggggaacggggtaacccgaggggaccgggttaaaccgttaccgtaaaccgtttaccgttaacccggtttgggtaacccggttccgggtaacccggggg

SEQ ID NO: 76606 - DNA, 724 bp, Homo sapiens
  misc_feature: GYAE6OF01DVDRJ.8.34.D01.1.454.CMB.1.raw
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
  modified_base (343)..(343): a, c, t, g, unknown or other
  misc_feature (343)..(343): n is a, c, g, or t
tcagctcgcgtgtccacgaccggtgctcgatttagatcgtctgtgttgggtctggggagaggagcccagcactagaagtcgggcgggtgtttccattcggtgatcagcactgaacacagaggactcaccatggagtttgggctgaactgggttttcctcgttgctcttttaagaggtgtccagttgtcaagtgcaactggtggagtcgtgggggagcggtggtccaggcctggggaggtcacgagagactcgtcgtgtcgcagccttcgttgggttaccacctttnaagttaaccgtcggcaatgctacgtcgggtcccncgaagcctaccgaggcaagggtnttgggagttgggtcggctaggttcgtttcacgttcgtggagggtcctaggttgttacgaaagttgggtatggactaggtaccgtcggtaggaacgggtccgtattaccaacctataccgtacgaagtacgtaactaacgttaccgaaggtaactaacgaacgttaggttaacgtttacgggacgtacgtaacgaactacggtaccttaacggtaccgtaggtaacgggaaccggtacgggtacgttaacgtaaccgttacgtacgggtaaacggaaacgggggaaccggggggtaacctacggggaaccgggttaacgttacccggtaaacgggtttaaccgttaccggttttacgggaaccggttcccgggtaacggggg

SEQ ID NO: 76607 - DNA, 550 bp, Homo sapiens
  misc_feature: GYAE6OF01DKL4E.8.34.D01.1.454.CMB.1.raw
  modified_base (209)..(209): a, c, t, g, unknown or other
  misc_feature (209)..(209): n is a, c, g, or t
  modified_base (295)..(295): a, c, t, g, unknown or other
  misc_feature (295)..(295): n is a, c, g, or t
  modified_base (400)..(400): a, c, t, g, unknown or other
  misc_feature (400)..(400): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagattgttggcgcctagtatcctggtaccaacagaaacctggccaggctccaggcccctnatctatggtgcactccaacgagggcccacgtcggcactcccagccgaggttcagtggcgagtgggtatgggacagacttcactctcaccatcatcagcctaggcncctggacgtagttgttcgctagttttattactgtacaactactcgtacgagtcggtccgtccgggggtcctacgtttccggaccgtcgggaccaaggtggactatacgaaacgtacgtggtcgctgacctacgctcgtcttcttctaccg

SEQ ID NO: 76608 - DNA, 807 bp, Homo sapiens
  misc_feature: GYAE6OF01EI9A3.8.34.D01.1.454.CMB.1.raw
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtggggaggtcacagagactctcgtgtgcagcctcgtggttcaccttcagtaactacggcatgcacgtgggtccncaagctccgaggcgaagggnttggagtgggtggctaggttgtttcagtcgtaggacgggctaggtgttacaagttggtaatgactaggtaccgttccggtagggaaacggggtcccgtaacgtttacccgaaccctacgttacccgtacccgtaaggtaacgtaaccgtaaacgtttaaccccgaaacgggtaaacctaaaccgtaaacgtttacggtttaaacgtttttacgggaacggtaccgtaacggtaaaccgtaaccgggttaaccccgttaaacgggttaccccggttaacgggtaaccgggtaacccggtaaccgggggtacccgttaaacgttaacccgttaaaccggttaacgggttaaaccggggaaaacgggggtaacggggggggaaaccccgtaagggggtaacccggggttaaaccgggtttacccggttaaaacggtttacccgtttacccggttttacgggtaacccgggttccgggttaacccgggggg

SEQ ID NO: 76609 - DNA, 263 bp, Homo sapiens
  misc_feature: GYAE6OF01D8H2F.8.34.D01.1.454.CMB.1.raw
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (247)..(263): a, c, t, g, unknown or other
  misc_feature (247)..(263): n is a, c, g, or t
tcagctcgcgtgtccacgaccggtgctcgatttagatcgtctgtgttgggtttgggtgccgaagttgctggaggtcacggtcaccacgctgctgagggagtagagtcctgaggactgtaggacagcccatcggtcttccccctggcgccctgctccaggagcacctccgagagcacagcggccctgggctgcctggtcaaggtactacttccgacacgcgagctgagcgggntggcaaggncatagnnnnnnnnnnnnnnnnn

SEQ ID NO: 76610 - DNA, 557 bp, Homo sapiens
  misc_feature: GYAE6OF01DTWGU.8.34.D01.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (294)..(294): a, c, t, g, unknown or other
  misc_feature (294)..(294): n is a, c, g, or t
  modified_base (405)..(405): a, c, t, g, unknown or other
  misc_feature (405)..(405): n is a, c, g, or t
  modified_base (421)..(421): a, c, t, g, unknown or other
  misc_feature (421)..(421): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaancgccaccctctcctgcagggccagtcagaatgttggcncctagtatcctgtaccaacagaacctggccaggctcccaggcccctnatctatggtgcatcccaacgacgggccatcggcactcccagcccaggttcagtcggctaggtgggtatgggacagaccttcactcacacctatccatcacgccgtaggacncgtggaggtattgttnacgttagtttacttactgtaccaactcgtcgtacgaggtcggtaccggtcccggggtccttacgttccggaccgtcggaactaaggtgactagtacgaaacggtatggtcgctgacctacattcctagttctctac

SEQ ID NO: 76611 - DNA, 816 bp, Homo sapiens
  misc_feature: GYAE6OF01CJPCT.8.34.D01.1.454.CMB.1.raw
  modified_base (172)..(172): a, c, t, g, unknown or other
  misc_feature (172)..(172): n is a, c, g, or t
  modified_base (256)..(256): a, c, t, g, unknown or other
  misc_feature (256)..(256): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgacttgggttttcctcgttgcttcgttttaagnggtgtccagtgtcaagtgacaacgtggtggagtcgtgggggagcgtggtccagtccgtggggagtcacgagagactcgtcgtgngcacgccttcgttcgggttacctaccgtttacgaacgttaaccgtccggactagtcgaccgtaccgttcggggtacccacccgaaacggtccgtacccggaggaccgaaaggggtagtttggggaggttggggtcggacgttaggttttcgtttacgacgttccggtaggacgggtacttagggttacgtttacggtaaagttgggtaagtcggaccgtaacggtaccggtaccgggtagggtaacccggggtccctaacgtttacccgaacccgttaacgttacccgtaaccgtaaacggtaaaccggtaaaccgttaaaccgttacccggaaacgggtaaaccctaaaccggttaaagtttacggtttaacggtttagggaactaccggttaacgaaaccgtaggtaacccgttaaacggttccgaggtaaccggaacgtacgggtaacttacgtaacgtacggttacggaaacgggaacggggacggggaacgtacgggtaccggttaacgtaccgtaaacgttacgttcccgtttacggccggttgggtacccggg

SEQ ID NO: 76612 - DNA, 527 bp, Homo sapiens
  misc_feature: GYAE6OF01BXCOK.8.34.D01.1.454.CMB.1.raw
  modified_base (210)..(210): a, c, t, g, unknown or other
  misc_feature (210)..(210): n is a, c, g, or t
  modified_base (297)..(297): a, c, t, g, unknown or other
  misc_feature (297)..(297): n is a, c, g, or t
  modified_base (518)..(518): a, c, t, g, unknown or other
  misc_feature (518)..(518): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagttttcagataccaccggagagatttgtgttgacacaatctccagccaccctgtcttcgtctccaggggaaangccaccctctcctgcagggccagtcagatgtgcgctacgtatcctggtaccaacagaaacctggaccaggcctcccgaggccccctnatcctatggtgccatccaacagggcccactggcatccccagccaggttcagtgcagtgggatgggacagacttcactctcaccatcatcagcctggacgccgtgaggtatgttgacgtagtttacttacgtgtacactactcgtacgagtcggtcgtccggggtcctacgttcgccgtcggaccaaggtgatacgtacgaacgtatcggtgctgcaccatntgtctctac

SEQ ID NO: 76613 - DNA, 734 bp, Homo sapiens
  misc_feature: GYAE6OF01BYJUO.8.34.D01.1.454.CMB.1.raw
  modified_base (197)..(197): a, c, t, g, unknown or other
  misc_feature (197)..(197): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagagatcattggagaagtggtgatgacacagtctccggtcaccctgtcttgtttttccgngggggagagacgccctaccctctcctgtcgcggccagtcagagtcgttaggacgtaacttagccttggtatcagcagacggcctggccaggcctcccagacctcctcacttctttggccgtacctttaaacgacggggacctaggtacggaactccccgaagccctagggttcaggccggcgaggttcgggtcgtggggtacctttcggttacaccgttctaccgacctacgttacaaacttaaccgtcgaactaacgttcgttacggaaccgttacctttacgtacttaacgtttttactttaccgttcgttacgtacgtactacgttacgtaggtaacgtacgttcgggtccgtttaccgtaaccggttttaccgggacgggtaacgggtaccggtaagggtaccgggtaacccttaaccggaaaccgtaacgttaggttaccggacgttaccggacctaacccgtacgttaccgttaccggtttacccttacgttaacccgttcccgtttcccccgtacccgtacgttacccgg

SEQ ID NO: 76614 - DNA, 742 bp, Homo sapiens
  misc_feature: GYAE6OF01CXTRO.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaacttgggttttcctcgttgcttcttttaagaggtgtccagtgtcaagtgcaacgtggtggagtcgtgggggagcgtagtccgagccgtgggagtcaacgagacgaccttctcctggtgcacgtccctcgttcgggttacctaccttcgaagtacgccttaacggcaatcggcaacggttcgggaccccgacctaaaacgtcccgaggaccgtaaaggggtctttgggaggttggggtggaccttaggttttcgtttacgagttcgtggaagggtctaaggttcgttacaagttggtaatcgtcgtacggacggtccggtaaggacgggtaccgtacgttaccgaacctacgtaccctaaccgaagtaaccgaaccgtaaccgtacccgaacggaactaaaccgtaagtacgttacgttaacggaccgtagtaacgtaacgacccgttaacgtccgtaggaacggtacgtaacggtacgtaactaaccgtaacggtacggtaaacgggaacggggaaccggggaaaccgtacgggtaccgggtaacgttaccgtaaacggttaccgtttaccggtaggtaccggtcgggtcgggtaacccgg

SEQ ID NO: 76615 - DNA, 550 bp, Homo sapiens
  misc_feature: GYAE6OF01B2CXM.8.34.D01.1.454.CMB.1.raw
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagatacccaccggagagattgtgttgacacaatctccagcccaccctgtcttcgtctccgaggggaaanagccaccctctcctgcagggccagtcagatgttggcncctagtatcctggtaccaacagaacctggccaggcctcccaggccccctcatctatggtcgcatcccaacgaggggcccacgtggcactccccagcctaggttcaggtggcgaggtgggtagtgggacagaccttcactctcaccatcatcacgcctggacgctggaggtatgttgctagtttactactgtacaactatcgtacgtagtcggtccgtccggggtcctacgttccggcccgtcgggaacctaaggtggactacgtacgaacgtactggtcgctgcactactctcgtctcgtc

SEQ ID NO: 76616 - DNA, 635 bp, Homo sapiens
  misc_feature: GYAE6OF01D07GR.8.34.D01.1.454.CMB.1.raw
  modified_base (210)..(210): a, c, t, g, unknown or other
  misc_feature (210)..(210): n is a, c, g, or t
  modified_base (268)..(268): a, c, t, g, unknown or other
  misc_feature (268)..(268): n is a, c, g, or t
  modified_base (297)..(297): a, c, t, g, unknown or other
  misc_feature (297)..(297): n is a, c, g, or t
  modified_base (396)..(396): a, c, t, g, unknown or other
  misc_feature (396)..(396): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagcccaccctctcctgcagggccagtcagaatgttgcgcctagtatcctgtaaccaanagaaacctggccaggctcccaggcccctnatctatggtgcatccaacgagggccacgtgcactcccagccaggttcagtggcaggtgggatgggacagacttcactctcacatcatacagcctggganccgtagaggtattggttcacgttaggttttaacttacttgtactaaactacgttaccggtaaccgtaggtcgggtaccccggttacccgggggtacccttacccgttttcccgggaccccgttaggggaaccctaaagggtacggtaactaacgtaacccgtaaaaacggtaacgttacggttcggaccgttacgacccgtaaccgtacttacccgttacggtttcctttcctaacccg

SEQ ID NO: 76617 - DNA, 682 bp, Homo sapiens
  misc_feature: GYAE6OF01DOLKJ.8.34.D01.1.454.CMB.1.raw
  modified_base (171)..(171): a, c, t, g, unknown or other
  misc_feature (171)..(171): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaacttgggttttcctcgttgcttctttaagnggtgtccagtgtcaagtgcaacgtggtggagtcgtgggggagcgtggtaccagccgtgggagtcacgagacgactcgtcgtgtgcagtcctcgtagggttccacctttcgaagtaacctacggcagtgactacgtcgggtcccacaagcctaccgaggacaaggtgtaggtaggtaggtcgggtgtacgttagtttcgtatcgttcggagggtacgtagttacgtttagtaaggtaggttacgtagtcgaaggtaccgtccggtacgggaacgggtaccgtacgtaccgtaccactactcccgtaagaacgtaacgtaaccttacgtaacgaacgtaactaacgtagtttacgtaggtacgacgtacgaacgtaacgtacgtacgtacgtacgagggtaacgacgggtagtacgttacacggttaacgtacgggtaaacgggaacggggtaacggacggcgggtaaccgtccgtaacgttacgttaccgtttacggtggtcggtaccgggg

SEQ ID NO: 76618 - DNA, 812 bp, Homo sapiens
  misc_feature: GYAE6OF01D95QD.8.34.D01.1.454.CMB.1.raw
  modified_base (206)..(206): a, c, t, g, unknown or other
  misc_feature (206)..(206): n is a, c, g, or t
  modified_base (268)..(268): a, c, t, g, unknown or other
  misc_feature (268)..(268): n is a, c, g, or t
  modified_base (302)..(302): a, c, t, g, unknown or other
  misc_feature (302)..(302): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctcagccacctgtcttcgtctccgagggaanacgccacctctcctgcgaggccagtcagaatcgttggctcctagtactccgtaggtaccaanacgtaaacctggaccaggcctccgacggcccctnatctagtggcgactagtccaacgacggaccacgtcggacactacccacgaccgtacggttcaggtcggtactagggtagggtacgcgggtaactaacggtacctttcgacgttcctcgtaaccctacttacaacgtacgtaacggtccttaagggtaccggtaccgttaggtacggtaacgttcggttacggtccgtttaaaggttttactttaccgtacggttaccgtaaacgtacgttaccgggtaaccgtaccgggttccgggtaccccgggtttacccggggggtacccctttaacccgggttttccccggggtaaccccggtaacggggtttaaaaccccggtaaaacgggtttaccgggtaaaacggtttaaaccgttaaacccgggtaaaaaacccggttaacggtttaccgggtttaaaccgggacccgtttaaccgggtaacccctaaccggttaacgtttacccgggttaacctttaccgggtttaccttaaaccccggg

SEQ ID NO: 76619 - DNA, 693 bp, Homo sapiens
  misc_feature: GYAE6OF01EW2PY.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacgagagactctcgtgtgcagcctcgtggttcaccttcaagtaaatacggcatgcacgtggtcccgcaagctccaggcaagggattgggagtgggtgctagttgttcatcgtggaggcaggttgttacaagttgggtatgcacgtactccggaggaacgggccgtatccaaccactctaccgaagaacgtaacaacgttaccgaacggtaaactaacgtaaagttggttaagtttacgggaacgtacgtacgaaacgtacgtaaccgtaacgttacccgtagggaacggtaaccggaacgggtaccgtttaaacgtaaccgttaacgttaacgggtaaaccggggaaacgggggtaaacggggggtaacccgaaacggggaccggggtaaacgtttaacccggaaacggtttacccgttacccggttttacggtaaacggttccgggttaaccggggg

SEQ ID NO: 76620 - DNA, 817 bp, Homo sapiens
  misc_feature: GYAE6OF01DG2XC.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttgggggaggaactgctcagttaggacccagagggaaccatgaagccccagctcagcttctcttcctcctgctactctggctcccagtttcagataccaccggagagattgtgttgacacaatctccagccaccctgtcttcgtctccgaggggaaancgccaccctctcctgcgagggccagtcagaatgttggccgcctacgtatccgtaggtaaccaacaacgaaacccgtcggacccaacgggcccttaccccgaaccgggcccccccttacgaacttccgttaagttcgggttcgaccgtaacttaccccaaaccggacggggccctaacgttcgggacctacgtccccagccccgtaggtttcaggtcggacgtaggttaggggtacgtggggaactacggtacctttacaccgttcctaccgacctatccgaactccgaacgcccgttagggaccgtcccgttagggaacgggtacgtttggtttacgaccgtttaaggttttaactttacgtacgttaacctaaaccgtacgttacccggtacggtacggttccggggtacccccgggttacccgggggttaccccttacccgggttttaccccgggaccccggttacggggtaaaccccgttaaaacggggttcggtaaaccgttaacgtaacccggtaaaaaccggttaacggtcgggttaccgggtaaccgtcggtacccgtaaccttaacgttccgtttacgttcccgtttacgttaacccccg

SEQ ID NO: 76621 - DNA, 715 bp, Homo sapiens
  misc_feature: GYAE6OF01BJOBL.8.34.D01.1.454.CMB.1.raw
  modified_base (246)..(246): a, c, t, g, unknown or other
  misc_feature (246)..(246): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccaccggagagattgtgttagacacaatctccagccaccctgtcttcgtctccgaggggaaagcgccacctctcctgcagggccagtcagatgttggcnctacgtatccgtagtaccaacgacgaaaccgtggaccacggcctccacggcccctactagtctagtggtcgacactaccaacgacgggccacgtgggcctacgtcccagccgaggttccaggtcggacaggtgggagttacgggactacgtacttcacgtctacaacctactactacgtctaacgcgtacggtacgtaccgtagggtaacgtagttcggtacgtacgtttaacgttttacttaaccgttacgtactaaccgtacggttaccggtaaccgggtaacgttaccggggtaccccgggttcccgggggtaaccccgttacccggttttacccgggtacccggttaccggggaacccgttaagggggttaccgaaacggttaacgtaaccggtaaaaccgtagtcgggttacggtacccgagtaccccgtaccgtactttacgtcgttcccgttcttaccccgg

SEQ ID NO: 76622 - DNA, 627 bp, Homo sapiens
  misc_feature: GYAE6OF01BAA03.8.34.D01.1.454.CMB.1.raw
  modified_base (155)..(155): a, c, t, g, unknown or other
  misc_feature (155)..(155): n is a, c, g, or t
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
  modified_base (316)..(316): a, c, t, g, unknown or other
  misc_feature (316)..(316): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttccncgttgctcttttaagaggtgtccagtgtcaagtgcaactggtggagtcgtgggggagcgtagtccagccgtgggagtcacagagactctcctgtgcagcctgtggtcaccttnagtgctacgnatgcacgtcgggtccaccaaactccgaggcgaagggtnttgggagtggggtagctagtttcgttacagtcgtggagggtctaggttgtacaagttggtatgctggacggccgtaggaacgggtccgtattcacctatcctaccagacgaacaactaccgaagaacacgtaatagtacgttacggactacgaacgtacgtacctaacggtactacgaacggtaccgtaacgggtgtaacgtacgtacgtacgtaacggggtaacgggaacgggggtaaccaggggtaccgggtacggttaaccgaacgttaccgtaccgtttaggaccggttcggtccggggtaacccgg

SEQ ID NO: 76623 - DNA, 579 bp, Homo sapiens
  misc_feature: GYAE6OF01B7CB6.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcgagtgcaactggtggagtcgtgggggagcgtggtccagcctgggaggtcacagagactctcgtgtgcagcctctgggttcaccttcagtaactacggcatgcacgtgggtccacaagctccgaggacaagggattgggagtgggtggctaggttgtttcatcgtggagggctaggtgttcaagtggtatgacagactccggtagaacgggccgtattcaccatctaccagacgacaacttaccaaggaacaacaagtgttagtttggagtacgtagaacgacgaccgtaagtccgtagacggacgacggacgtacgtactacgtagtacggaagggaggggaacgacggacgggtacgttaccgaacgtacttacgttacgcggtcggtacgggg

SEQ ID NO: 76624 - DNA, 698 bp, Homo sapiens
  misc_feature: GYAE6OF01BU733.8.34.D01.1.454.CMB.1.raw
  modified_base (210)..(210): a, c, t, g, unknown or other
  misc_feature (210)..(210): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagcccaccctctcctgcagggccagtcagaatgttggcgcctagtatcctggtaccaacacgaaacctggaccacggcctcccgacggccccctcatctatggtgcactccaacgacgggacccacgtcggcactcccgagcctaggttcaggtggacaggtggtagtgggacagtactcactctcaccatcatcgacgtccgtggacgccgtaggtaacggtacgttggttacgtacgttttaacggttttaactttaccgttacggttaacctaaacgttacgttaccggtaaccggtacggttaccggggtccccgggtccccggggggtacccttacccgggttttcccgggacccggtaccgggtaaacccgtaaagggttacggtaaacgtaacgtaaccgaaaaccggttacgttacgggttacggaccgttaccggaccgtaaccgtacttaccgttcggtttcccttacgttaaccccg

SEQ ID NO: 76625 - DNA, 822 bp, Homo sapiens
  misc_feature: GYAE6OF01BY1S4.8.34.D01.1.454.CMB.1.raw
tcagctcgcgtgtccacgaccggtgctcgatttagatcgtctgtgttgggtttgggggaggaactgctcagttacggacccaggagggaaccagtggaacgcccagctcagcttctcttcctcctgctactcgtggcctccgtagtttcagactaccgacggagagtattgtgtgacacaatctcacgccacctgtcttcgtctaccgaagggaacgcgccaccctctcctgcgacggccagtcaagtagtggttcggccgtccgtacgttactccgtacggtaaccaaacgaacgtaaaccgtcggaccgacggtccctacccggaccggtcccctacacttctaggtcggtcacctaacgtacccgaacggacgggaccctaacgtccgggactaacccgtaccccgaaggtcccgttaacgggtacgtacgggtcggacgttaaggggttaggggttacggtacggggaaactacggttaaccttccgtaaccgtttccgaaacccgtaaacccgtacgttaacctaacttaccggaccggttacccggttacggggaaccgtacccggttagggtaacggttacgtttcgggttacgttacgtttaacgttttacgtttacgtacggtaacctaacgtacgttaacccggtacgtacgggtccggtaccccgggtcccggggtacctttaaccggttcccgggacccggttaacgggaacccgttaaggtcggtaaaccttacgaaaccgtaaacggtacgtacgggtcgccgttaccgaccgtaccgtattcccgttcgttcccgttactaccccgg

SEQ ID NO: 76626 - DNA, 782 bp, Homo sapiens
  misc_feature: GYAE6OF01AE9KR.8.34.D01.1.454.CMB.1.raw
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaagacgcccacctctcctgcagggccagtcagatggttggcncctacgtatcctggtaccaacagaaacctggaccaggcctcccacggccccctnactctagtggtgcataccaacacggggcccacgtggccactccccagcctaagggttcaggtcggcagggttgggtagtcggggaacacggtacttcgaacttcctacaccatacactcacgccgtacggggacgtcccgtagggtaacggtagtttacgggtttacggtacgtttaaggtttttaacgttttaaccgtacggtttaaccgtaaaccggttacgtttaacccgggttaaccccgggttacggggttccccggggtaccccgggggtttcccccggggggttaccccgtttaaccggggtttttcccccggggtaccccggtttaacgggggaaaaccccgttaaagggggttacggaaacccggtttaaacgtaacccggtaaaaaccggtacggttagggttaccgggtaccgttacccgggaccttaaccgttacgttaccgtttccggttcgtttacccgttacccg

SEQ ID NO: 76627 - DNA, 891 bp, Homo sapiens
  misc_feature: GYAE6OF01D3CSH.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagcgcccaccctctcctgcgacgggccagtcaagaatggttcggccgtcctacgtactccgtacggtaaccaacgaacgaaaccgtcggacccacggtccctacccgacggtccccctacgtactacgttagtcggtcgacctaactacccgaacggaccgggaccctacgtacgggacctaccgtaccccgacggtacccgtacggtttcgaacgggttcggaccggtaggggttacggggttaacggtacggggtaaccgtaacggtaaccgtttacccgtaaccgtttacccgtacccaaacccgttaactttacccgaaccgttacccggtaaccgtaccccgggttaggggtacccgtacccgggttaggaacgggtttaacgtttcgggtttaacggaccgttttaaggtttttaacctttaccgttacggttaacctaaacggttacgttaccggttaacccgggtagggttccccggtaccccggggttacccgggggtacccgtttacccggtttccccgggtaccccgggtaacggggtaaaccggtaaacgggttacggtaaaccgttaacggttaaaccccgtaaaacgggtcggtttacggggtacgtacccgtaaccggacccgtaaacccgttgttacccgtttccgttaccgtttccgttaaccccg

SEQ ID NO: 76628 - DNA, 788 bp, Homo sapiens
  misc_feature: GYAE6OF01C3737.8.34.D01.1.454.CMB.1.raw
  modified_base (159)..(159): a, c, t, g, unknown or other
  misc_feature (159)..(159): n is a, c, g, or t
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (226)..(226): a, c, t, g, unknown or other
  misc_feature (226)..(226): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagactaccaccgganagtattgtgttgacacaatctccagcctaccctgtcttcgctacgagggaacncgcccncctctccngcgaggaccagtcaacgattcggtcgccgtactacgtactccgtaggtaacccaacgaacgtaaccgtcggccgaacggtccctacccgacggtcccctacacgttctacgttcggacgacctacgtaccgaacgaccgggacctacgtcggacaccgtacccgagaccgtaggtcgaaggtcggacgtagggtagggagttcgggaactacggtactctactccgtacaacactacagtaccgacgttaccggacggacgtaccgtaggtaacggtcgttacgttacggtacgtttaagttttaacgttaccgtacgttaaccgtaaacgttcggtaacccggttaccgggtaacggttcccggggtaccccggttacccgggggtaccctttaacccgggttccccgggaaacccggttacgggtaaaacccgttaaggggttccggaaacgtttaaccgtaaacccggtaaaccgggttccgttaaccggggttgaacccgttacccggaaaccttacccggtagtttacccgttcgtttacccgccttttaccccggg

SEQ ID NO: 76629 - DNA, 710 bp, Homo sapiens
  misc_feature: GYAE6OF01CCRTT.8.34.D01.1.454.CMB.1.raw
  modified_base (213)..(213): a, c, t, g, unknown or other
  misc_feature (213)..(213): n is a, c, g, or t
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (314)..(314): a, c, t, g, unknown or other
  misc_feature (314)..(314): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatcctccacgccaccctgtccttcgtctccgaggggaaancgccacctctccngcgnggccagtcagatgtggctccgtacgtctccgtggtaaccaacgaacgtaaaccgtcggaccgacggcctcccgaccggcccctnacttactagtggtcgactactaccgaacgacgggccctagcggccaccgtcccacgaccgtaggtcaggtcggacgtagggtacgggtagtacgggactacgtacctttcgaccttcgacctaccgataccgtatccgtaacggtccgtgggtaccgtccgtagacgggtattacggtcgtaactttaggtttacttacgtacgttaccaacgttacgttaccggtaacggtacggttccgggtaccccggtccgggggtaccctttacgggttcccggacccggtaacggaaccgttaacgggtgggtaaaccttacgtaaaccggtaaacggtccgttaggtcgtacctacgacccgtaacttccgttagtttccttcccgtaacgttaccccg

SEQ ID NO: 76630 - DNA, 659 bp, Homo sapiens
  misc_feature: GYAE6OF01D3J51.8.34.D01.1.454.CMB.1.raw
  modified_base (208)..(208): a, c, t, g, unknown or other
  misc_feature (208)..(208): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccaggggaaangccaccctctcctgcagggccagtcagatgttgcgcctacgtatcctggtaccaacagaacctggccaggcctccgacggcccctnactctagtggtcncactccaacgtacgggccacgtggccactcccagccaggttcaggtgcaggtgggtatgggacagtactcactctacaccatacatcacgtcctaggacgtccgtaggacggtattggttagtcgtagttttactaccgttggtacctaacgtacgtaccgtaaccggtaggttccgggtcccggttacccggggggtaccctttaccggtttcccggggacccggttacgggggtaaccgtaaacgggggtacggtaacggtacgttaaacccggtaaaaccggtaaccggttgggtaccggtcctacgggacccctaccgtacttaccgtttacgttccgttactacccg

SEQ ID NO: 76631 - DNA, 701 bp, Homo sapiens
  misc_feature: GYAE6OF01CO8A6.8.34.D01.1.454.CMB.1.raw
  modified_base (168)..(168): a, c, t, g, unknown or other
  misc_feature (168)..(168): n is a, c, g, or t
  modified_base (172)..(172): a, c, t, g, unknown or other
  misc_feature (172)..(172): n is a, c, g, or t
  modified_base (271)..(271): a, c, t, g, unknown or other
  misc_feature (271)..(271): n is a, c, g, or t
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcacatggagtttggctgaacttgggtttcctgttgcttctttaagnggtntccagtgtcaagtgcaactggtggagtcgtgggggagcgtggtccaggccgtgggagtcacaggagacctctggtgtgcagcctcgtgggttccacttnaagtaactacggctagtgcacgtggggtccncaagctcgaggacaagggtnttgggacgtgggtcggctaggtttcgtttcattccgtaggacggctaagtcgttacaaagtgtaatcgacgagtaccgtcgtaggaaggtccgtattcgacctatcgtacgagtacgaactaaacgttccgaaggtaacaacgtaagttaggttaagttttacgggaacaccgttagtaaaccgtacggtaaccgttaaacggtacccggtaggtaaaccgggacgtaccggggtacgttaaacgttaacccgttaacgtaacgggttaaacgggaaaacgggggtaagggggaacccggtaaagggtacccggggttaacgttaccgtaaacggttacccgtttaccgttttacgggacgttccgggttaaccggggg

SEQ ID NO: 76632 - DNA, 631 bp, Homo sapiens
  misc_feature: GYAE6OF01A8LQD.8.34.D01.1.454.CMB.1.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
  modified_base (396)..(396): a, c, t, g, unknown or other
  misc_feature (396)..(396): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaangccaccctctcctgcagggccagtcagatgttggcncctacgtatcctggtaccaacagaaacctggccaggcctcccacggccccctcatctagtggtgcatccaaacgacgggcccacgtggaccactccccagccaggttcaggtggcaggtgggtagtgggacagtacttcactctccaccntcatcacgccgtggacgtccgtagaggtattggttgtcgttagtttacttacgtgtactaactacgttccgtaccggtacgtcgggtcccggttcccgggggtccctaccggtttcccgggacccgttaccgggaaccgtaaggtacggtaacgttaacgtaccgtaaacggtaacgttagggtcggtacgtcggtaccgtacccgtacttaccgttcgttccgtttccgtaccg

SEQ ID NO: 76633 - DNA, 624 bp, Homo sapiens
  misc_feature: GYAE6OF01ASQY5.8.34.D01.1.454.CMB.1.raw
  modified_base (414)..(414): a, c, t, g, unknown or other
  misc_feature (414)..(414): n is a, c, g, or t
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
  modified_base (532)..(532): a, c, t, g, unknown or other
  misc_feature (532)..(532): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggaggcggtggtccaggccgtggggaggtcacgagacgactcgtcggtgtgcagcctgtcgggttccaccttcgagtaactacggcatcgccgtacgtcgggtcccaccgaacgcctaccgaggaccgaaggggtacttgggacggttggggtgcgtaggtttgtttcagttcgtaggagggtctaggtgttacgaagtgtagngcagtcgtccgaggacggcctatcacngtcnccgagtacactaatcgaacgactatagttagtagttggagtacgtacgaactacgtaccgtaacgtccgtaggaccgacggtacggngttaactacgtaccgtagggaacggacggggtaacgggacgaacgggccgggtaacttaccgtacgttacttacgttacggcgtcgggtcgg

SEQ ID NO: 76634 - DNA, 820 bp, Homo sapiens
  misc_feature: GYAE6OF01CK8LR.8.34.D01.1.454.CMB.1.raw
  modified_base (251)..(251): a, c, t, g, unknown or other
  misc_feature (251)..(251): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaagggaaagcgccacctctcctgcacggccagtcagatgtgcgcctacgtntccgtagtaccaacacgaaacctggaccaggccctcccgacggccccctcgtatccgtagttgggtcgactacgtacccgaaacggacgggacccgtaacgtcgggacctaccgttacccccacggtacccgttacgggttaccgtacgggttacgggaccgtaaggggtttcgggggtaacgtacgggggaacctaacggttaccctttaccgtaccgttaccgtaacccgtaacccgtaactacctaaccgtaccgacggtacccggtacgggaaccgtcccggttaagggacgttagttcggttacgtaacgttttaacggttttaacttacgtacgtacctaaacgttcgttaccgggtaacgtacgggtaccgggtccccgggttacccggggttacccgttaccgtttcccggggaccccggtaacggggtaaacccctaagggttacgtaaaccgtaacgtaaaacccggaaacggttacggttcgggttacccgggccgttaacccggttacctaacccgttaccgttaccgttttacccgttccgttccgtttaaccccg

SEQ ID NO: 76635 - DNA, 827 bp, Homo sapiens
  misc_feature: GYAE6OF01EL2EB.8.34.D01.1.454.CMB.1.raw
  modified_base (210)..(210): a, c, t, g, unknown or other
  misc_feature (210)..(210): n is a, c, g, or t
tcagctcgcgtgtccacgaccggtgctcgatttagatcgtctgtgttgggtttgggggaggaactgctcagttaggacccagagggaaccatggaacgccccagctcagcttctcttcctcctgctactctggctccagtttcagactaccgaccggagagattgtgttgacacatcctccagcctacctgtcttcgtctccgagggaancgccacctctctcgcgagggcctagtcaagtagttggttcggccgtccgttaacgtacttccgtacggtaaccaaacgaacgtaaaccgtcggaccgacggccctacccgacggtcccctacgacttccgtaagttcggcgtacaaccgtacccaaacggaccgggacctaccggtcgtaccgacctaccccgacggtaccgtaacggttacgacgggtacggaccggtagggttaggggttacggtacgggaccgtaacggtaccttacgtacccgttacctacccgaacccgttaactaccgtaaccgttaccgaccggttacccggtacgggtaccgtcccggttagggtaacgggttacggtacgtttaccgggttactttaggttttaactttaaccggtcgtaaccttaaacggtaccggttaccggtaaccggtccgggtttaccgggtaccccggggtcccggggttaccgttacccgggttccggtaacccgggtacgggaaccgtaaacggtacggttaactaacgtaaccggtaaacggttacgtacggtcggtacgtaccgaaccttccgtaacgtttcgttaacccgttgttacccgttacccg

SEQ ID NO: 76636 - DNA, 692 bp, Homo sapiens
  misc_feature: GYAE6OF01BZVGA.8.34.D01.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaangcccacctctcctgcagggccagtcagatgttgcncctacgtatccgtgtaaccaacacgaaacctggccaggcctcccgaggccccctgactctagtggtcgacactacccaacgacggggccctaacgtcggacaccgtccccgaacgccgtaggttccaggtcggccgagggttggggtaagtcggggaactacggtacctttcaaccttccgtcaaccgtatccgaatccgacggtccgtagggaccgtccgtagacggtatggttagtacgtttaaggttttacttacgttacgttaactaacgttaacgtaccggtaaccggtggtacccgggtaccggttccccggggggtacccttaccgggtttcccggacccggttacgggaaaccgtaacgggtaggtaacttaacgtaacgtaaaccggtacgtaggttccggactcgaccgtactacgttcgtcgttccttcgtaacccg

SEQ ID NO: 76637 - DNA, 685 bp, Homo sapiens
  misc_feature: GYAE6OF01DNZ4E.8.34.D01.1.454.CMB.1.raw
  modified_base (171)..(171): a, c, t, g, unknown or other
  misc_feature (171)..(171): n is a, c, g, or t
  modified_base (240)..(240): a, c, t, g, unknown or other
  misc_feature (240)..(240): n is a, c, g, or t
  modified_base (353)..(353): a, c, t, g, unknown or other
  misc_feature (353)..(353): n is a, c, g, or t
  modified_base (401)..(401): a, c, t, g, unknown or other
  misc_feature (401)..(401): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaactgggttttcctcgttgcttcttttaagngtgtccagtgtcaagtgcaacgtggtggagtcgtgggggaggcggtggtccagccgtggggaggtacanaggagactctcggtgtgcacggtccttcgttcgggttcctaacccgttctaagtaaaccgtcggctagtcgacctacggtcgggtccaccgaagcctccgaggacgaagggtnttgggcgtgggtgcttagttgttcagtcgtggaggtctaggtcgttanaagttcgaattcggactacgaccgttcggtaggaacgggtcctaacttccgaaccgtacttaccgctaaacggaacgtaaccgtaacggttacccggaaacctagttaaagttcggtttaaggttcggaagtaccgtaagtaacgagttacccgttaacgttccgtaggaacgggtacacggggttataacgtacttaagcgggtaaagaacgggggtacgggaacgaggtccggtaagttacccgaacttccgttacgttggaaccgttgggacgggtacccg

SEQ ID NO: 76638 - DNA, 770 bp, Homo sapiens
  misc_feature: GYAE6OF01BR32N.8.34.D01.1.454.CMB.1.raw
  modified_base (172)..(172): a, c, t, g, unknown or other
  misc_feature (172)..(172): n is a, c, g, or t
  modified_base (254)..(254): a, c, t, g, unknown or other
  misc_feature (254)..(254): n is a, c, g, or t
  modified_base (277)..(277): a, c, t, g, unknown or other
  misc_feature (277)..(277): n is a, c, g, or t
  modified_base (349)..(349): a, c, t, g, unknown or other
  misc_feature (349)..(349): n is a, c, g, or t
  modified_base (409)..(409): a, c, t, g, unknown or other
  misc_feature (409)..(409): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctgttgcttcttttaagnggtgtccagtgtcaagtgcaactggtggagtcgtgggggagcggtggtccaggtccgtggggagtcacgagagactctgtgngcagcctcgtgggttccaccttnacgttaacgtacggctagtcgccaacgtcgggggtcccaccgaaggccctaccggagggacgtaaaggggtnttggggaggttcggggtgacgttagggttttcgtttaccgagttccggtgggaacgggtntaacggttggtttacaaaggttgggtaactgaccgtaaaggtaccgttccggtaggaaaccgggtccgtattaccgacctacgttccacgaagaacgactaaacgttacccaaaggtaacctaactaagttacgttaggtttacgaacggtaccgtaacggtaaaccgaaccggttaccttaaacggtacccggttaaggtaacgggtaacccggacgggttactaaacggttaaccgtaacgttacgggtaaacgggaacggggttaaacgggggaacccgtaacggggaaccgggttaacgttaacccgtaaacggtttacccgttacggttttacgggaccggttcccggtacggggg

SEQ ID NO: 76639 - DNA, 647 bp, Homo sapiens
  misc_feature: GYAE6OF01AUWAW.8.34.D01.1.454.CMB.1.raw
  modified_base (327)..(327): a, c, t, g, unknown or other
  misc_feature (327)..(327): n is a, c, g, or t
  modified_base (361)..(361): a, c, t, g, unknown or other
  misc_feature (361)..(361): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtggtccagccgtgggaggtcacagagactctcgtgtgcagcctctggtcaccttcagtaactacggcatgcacgtcgggtcccgccaacgcctaccgaggaccgaaggggtnttagggaggtgggtggctagttcgtttcattcgnggagggctaggttgttacgaagttggtactgactacggtaccgtcggtaggaacgggtcccgtacttaccgaacctactcccgtaccgaagtaacgaacctaacttaccgaaggtaaacctaactaagttacggttaagtttacggaacgtacgtacgaacacgtaccgtaagtccgtaggacggaacgacgggtactagtacttacgaggtaacggaaggggacggggaaccgaggaccgggtaagtaccgtaacggttacctaccgttgacggtcggtacgggg

SEQ ID NO: 76640 - DNA, 880 bp, Homo sapiens
  misc_feature: GYAE6OF01CSCPZ.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaaggggaancgcccaccctctcctgcgaggccagtcagatgtcggctcctagtctccgtaggtaaccaacgaacgtaaacccgtcggacccgacggaccctaccccgaaccggtcccccctacgtaaccttccgtaacgttcggggtccgaccctaacgtaacccccgtaaaccggacggggtccctaacggtccgggaccctaacccgtaccccgaacggtaccccggttaacgggtttacccgaaggggttccggaaccggtaaggggtttcgggggtaacgtacgggggtaacctacggtaacccttttccgaacctttacccgtaccaaccctctaccgtactccgaacgtcccgtacgggacgtcccgtaggtacgttacgttcggttacgtaccgttaagtttttaacttaccgtacgttaacctaaacgtaccgttacccgggtaaccgggtacggttacccggggtacccccgggttacccgggggtaccccgtttacccgggtttaccccgggtaccccgggttaccggggtaaacccgttaaacggggtacggtaaaccgttaaccggtaaacccgtaaaaccggttacgttacgggtaccggttaccgtaccggaccccgtaaaccgttacgttaccggtttaccgttaccgtttacccgttaaccccg

SEQ ID NO: 76641 - DNA, 677 bp, Homo sapiens
  misc_feature: GYAE6OF01ENJNE.8.34.D01.1.454.CMB.1.raw
  modified_base (210)..(210): a, c, t, g, unknown or other
  misc_feature (210)..(210): n is a, c, g, or t
  modified_base (657)..(657): a, c, t, g, unknown or other
  misc_feature (657)..(657): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagataccaccggagagtattgtgttgacacaatctccagccaccctgtcttcgtctccgagggaancgccaccctctcctgcgagggccagtcaagtatggtgcgcctacgtactccgtaggtaccaacgaacgaaacctcggaccacggcctacccgacggcccctcacttccttagtcggtcgacctacgttacccgaaaccggtacgggaccctaacggtcgggacctaccgtcccgaaggcccgtaggttcgaggtcggcgtagggtgggtagcgggactacggtaccttcgacctctaccaacctatacctatacacggtccgtgggaccgtacgtaggaaggtactggttcgtacttaggttttactactcgtaacaagttacgtacgtaccggtaggtccggtacccggtccggggtacccttacgttcccgggaccgtacgggtaacctaagggtcgtaacgtaacgtaaaccgaacgtagtcggtagccctacgactaaccgtnttacttcgttctcgtacccg

SEQ ID NO: 76642 - DNA, 747 bp, Homo sapiens
  misc_feature: GYAE6OF01DB5GV.8.34.D01.1.454.CMB.1.raw
  modified_base (213)..(213): a, c, t, g, unknown or other
  misc_feature (213)..(213): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccacgccaccctgtcttcgtctaccgaggggaaaancgcccaccctctcctgcagggccagtcagatggttcggcgcctacgtactccgtaggtaaccaacaacgaaaccgtggacccagggtccctacccgacggaccccctacactccgttaagtcgggtcacctacgtacccgaaacggacggggccctaacggtcggactacaccccgacgacccgtaggttccaggtcggactagggttaggggagtcggggaactagtaccttacgacgttcctacaacctatcactacgacgcgtacgggcgtaccgtggtacggtattcggttacgtacgtttaacgttttacgttaaccgtacggttaacctaaacgtacgttaccgggttaaccggtaagggttcccgggaccccgggtaccgggggttcccttaaccgggtttcccggggacccggttacggggaaacccgtaaagggtaggtaaccttaacggtaaccgtaaaacggtacgttacggtaccggacgtaccgaaccgtacctaacttcgttacgttcttacggtaaccc

SEQ ID NO: 76643 - DNA, 807 bp, Homo sapiens
  misc_feature: GYAE6OF01AQUEF.8.34.D01.1.454.CMB.1.raw
  modified_base (347)..(347): a, c, t, g, unknown or other
  misc_feature (347)..(347): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtgggggagcgtggtccagcctgggaggtcacagagactctcgtgtgcagcctctgggttcaccttcagtaactacggcatgccacgtgggtcccgccaaggcctccgaggcaagggattgggagtggggtgctagttgtttnagttctggagggtcaggttgttacaagttgggtaatgacaggtaccgttccggtaggaacgggcccgtagttcctaacccgactacgttacccaagaacggtaacctaaaccgtttacccgaaacgggtaaaccgtaaacctaaacgtttacggttaacgtttttacgggaacggtacccgtttaacggaaaccgtaacggtaacccgtttaaccggttacccgttacgggtaaaccgggtaaccggtaacccggggtaaccggttaaccgttaaaccgttaaccggttaacgggttaaaaccggggaaacgggggtaaaccggggggggtaaaacccggtaaaccggggtaaccggggggttaacgggtttaaccccgggttaaaacgggtttaaccccggttttaccccggtttttaacgggtaaccccggggtttaccgggtttaacccgggggggg

SEQ ID NO: 76644 - DNA, 676 bp, Homo sapiens
  misc_feature: GYAE6OF01DZCFI.8.34.D01.1.454.CMB.1.raw
  modified_base (207)..(207): a, c, t, g, unknown or other
  misc_feature (207)..(207): n is a, c, g, or t
  modified_base (293)..(293): a, c, t, g, unknown or other
  misc_feature (293)..(293): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccaccggagagattgtgttgacacaatctccagccacctgtcttcgtctccgagggaaanagccaccctctcctgcagggccagtcagaatgttggcgcctagtatcctggtaccaacagaaacctggccaggctccaggcccctnatctatggtgcactaccaaacggcggacctagtcgactacctaccgacgtaccgtagtacgtacggtcgacgtagggttaggtacggtacgggaactaacggtaccttacaccttaccgtaccaaccttactaacgtactacgaccgtccggtaggaccgtaccgtaggacgtacgttggtacgtacgtttaacgttttaactacgttacgtaacctaacgttacgttaccggtacggtacggtaccgggtccccgggttaccggggacctttaccgggtttcccggaccggtacgggaaccgtaaaggtcgtaactaccgtaaccggaaaacgtagtcggtacgtcgtacgaccctacgtattcgttacgttctctaacccg

SEQ ID NO: 76645 - DNA, 767 bp, Homo sapiens
  misc_feature: GYAE6OF01CMENU.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccgacggagagattgtgttgacacaatctccagccacctgtcttcgtctccgaaggggaaagacgccaccctctcctcgcgacgggccagtcaagtaagtggttggccgtaccgtacgtactccgtaggtaaccaaacgaacgaaaccgtcggaccaggcctacccgaccggcccctacgactctacgtgggtacactactaccgaaaacgcgggaccacggtcggacctacgtccccgagtacccgtacggttcgacggtcggacgtaggggttacgggggtagtacggggaaacgtacggttaccgtttacgtacccttacgtacccaaaccctagtaccgactaccgtacggtaccgtacgggacgttccggtaggtaacgggtagttcggttagtacgtttaaggttttactttaccgtattaccgaaactttacgttaccggttaaccggtacggttccggggtacccgggttaccccgggggtacccttaccgggttttccccggaccgggttaccgggaaccgttaagggtcggtaaacttaccgtaaaccgaacgtacgttacgggtgtaccgtgtaccgtaacctacgttcgttcgttacctcgttacccg

SEQ ID NO: 76646 - DNA, 866 bp, Homo sapiens
  misc_feature: GYAE6OF01B8ENZ.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagtattgtgttagacaactaatcctcacgcccacctgtcttcgtctcggaagggaagcgccacctctctgcgacggcctagtacaagtaagttggttcggccgtaccgttacgtactccgtacggtaaccaaacgaacgtaaaccgtcggaccgacggccctacccgaccggtcccctactacttacgtagttgggtacgacctaccgtaccgaaacgggccgggtaccctacggtcggacctaccgtacccgacgtccgtacggttcgaggtcggtacgtagggttagggtaggtacgggactacggtacttaccgtaccgttcctaaccgtaacctacgttacctaacgtacccgtaacgtccggtagggaccgtaccggttagggaacggttagtttcggtacgttaacttttaacgggttttaactacgttcgtaaccctaacggttaccgttaaccgggtaccggtaggggttcccgggtacccccggggttacccgggggttacccttttaccggggtttaccccgggaccggggttaaccggtaaaccggttaaacgggtacggtttaaacgtaaacccggttaaaaccgggtaaaaacccggtttaccgggttaggggttcccggtaaccgttaccccgacccggttaaacccttacccggtttaacgtttcccggttttacccttaccggtttacccccg

SEQ ID NO: 76647 - DNA, 793 bp, Homo sapiens
  misc_feature: GYAE6OF01BLW7F.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtgtccagcctgggagtcacgagagacctcgtcgtgtgcacgccttcgtcgggttccacctttcgaagttaaaccgtacggctaagtcgccgtacgtcggggtaccccaccaaggcctaccgaggaccgaaggggtatttgggaggttcggggtgacttaggttttgtttacacgttcgtaggagggtctaggtttcgttagtaaaggttggttatcgacgtaacggtaccgtccggtaagggaaccgggtcccgtaacttcccgtaaccctacgttccgtaccgaagtaacgtaacctaaacgttacccgaacggtaaacctaacgtaagtttacggttaactttgggaacgtaccgtaagaaaccgtaacggtaccccgttaaggttacccgtacgggaaccgggtaaccggtaccgggtaccgttaaacgtaaccgttaacggtaaccggggttaaaccgggaaacgggggtaacggggggaaccgtaccgggggtaccgggtaacgtttaaacccgtaacggttaacccgtttcccggtttaacggtacccggttccggggttaacccggggg

SEQ ID NO: 76648 - DNA, 593 bp, Homo sapiens
  misc_feature: GYAE6OF01DRC1L.8.34.D01.1.454.CMB.1.raw
  modified_base (296)..(296): a, c, t, g, unknown or other
  misc_feature (296)..(296): n is a, c, g, or t
  modified_base (379)..(379): a, c, t, g, unknown or other
  misc_feature (379)..(379): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagcccaccctctcctgcagggccagtcagaatgttggcgcctacgtatcctggtaccaacagaacctggccaggctccaggcccctnatctatggtgcatccaacgacgggccacgtggacactcccagccaggttcagtggcaggtgggtatgggacagacttcactcncaccatcatcagcctaggatccgtggaggattgttgacgtagttttacttacgtagtacaactactacggtaccgaaggtcggacccggttccggggggacccttaccggtttcccggccccgttacggggaaccctaaaggtcggacttacgtaccgaaaacggtacttggtcggcgttagaccctaccgtattccgtcgtccttctaacccg

SEQ ID NO: 76649 - DNA, 680 bp, Homo sapiens
  misc_feature: GYAE6OF01BNIV2.8.34.D01.1.454.CMB.1.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaancgcccacctctcctgcaggccagtcagatgtcgcncctagtntccgtgtaccaacacgaacctcggacctaggcctccgaggcccctgactctatggtgccatccgaaacgacgggacccacgtacggcactcccgacgccgtacggtcaggtcggacgagggttacgggtagtacgggaacgtaggtaacttctaccgtctacaaccgtactctaactacgaccgtccttagggacgtccgtaggacggtagttcgttacggtaccttaagttttaaccttagttacgttaccgtaaacgtacgttaccgttaacgggtacggtaccgggtccccgggtacccggggggtacccttacccgggtttacccggtcccggtacgggaaaccgtaaggtacgtacgtaacgtaccgaaaccggtagtacggtcggactcgaccgtacgacttcgttacgtcccttgtacccg

SEQ ID NO: 76650 - DNA, 866 bp, Homo sapiens
  misc_feature: GYAE6OF01CIK4Q.8.34.D01.1.454.CMB.1.raw
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccaccggagagattgtgttgacacaatctccagccacctgtcttcgtctccgaggggaaancgccaccctctcctgcagggccagtcagatgttgcncctagtntccgtgtaccaacagaaacctggaccaggcctcccaggccccctcactctagtcggtgaccactccaaacgtacgggcccaacgtcggacctactaccccaggcccctaagggtttccgaaggttcggaccgtaagggttcgggggtaagttacgggggaactacggtaaccgtttccgaaccgtttcctaccaaccccgtattacccaacgttccgtaacggtcccgttacggggacgtacccggtacggtaacgggtaactttcgggtttacggtacgtttaacggtttttaacgtttaccgtttacggttaaccgtaaaccgttaacggttacccgggttaacccggtacgggttacccggggtacccccgggttaccccgggggggttacccctttaaccccgggtttttaccccggggacccccgggttttaaccggggtaaaccccggttaaaacggggttaccggggttaaaccgtttaaaccgttaaaaccccgggtaaaacccgggttaaacccggtttaccgggtacgggttacccgttaccggtaacccgtaacccttaacggtttacccgtttaccggttacccgtttacccggttaaccccg

SEQ ID NO: 76651 - DNA, 633 bp, Homo sapiens
  misc_feature: GYAE6OF01BZYY0.8.34.D01.1.454.CMB.1.raw
  modified_base (320)..(320): a, c, t, g, unknown or other
  misc_feature (320)..(320): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctcgtgtgcagcctcgtgggttcaccttcagtaactcggcatgcacgtcgggtcccgccaagcctcgaggcaagggnttggagtgggtgctaggttgtttcagttcgtggagggtcaggttcgttacaagtggtatggacagtacctccggtaggaacgggtccgtattccgaacctacttcctaccaggaacgaacgtaacttacccgaaggtaaccaacgtaattacgttagtttacgggagtcgtagaacgacgtaccctaagtccctaggacggacgacgggtacgtaacgtactacgtaggtaacggaaggggaacggggaacccgtgggaccgggtaacgtaccgtaagttacccgttacgtttcggaccggtcggtaccgggg

SEQ ID NO: 76652 - DNA, 740 bp, Homo sapiens
  misc_feature: GYAE6OF01C987H.8.34.D01.1.454.CMB.1.raw
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
  modified_base (331)..(331): a, c, t, g, unknown or other
  misc_feature (331)..(331): n is a, c, g, or t
tcagctcgcgtgtccacgaccggtgctcgatttagatcgtctgtgttgggtttgggggaagaggaagactgacggtcctgccacaggtggtgtttccattcggtgatcagcactgaacacagaggactcaccatggagtttgggctgaacttgggttttcctcgttgcttcttttaagaggtgtccagtgtcaagtgacaacgtgggtggagtcgtgggggagcgtggtccagcctgggagtcanagagctctcgtgngcagcctctggttcaccttnagtaactcggcatgcacgtcgggtccaccaagtcctccgaggaccgaaagggntttgggaggtggggtgctaggtttgttcatcgtggacgggctaggttgtacgaagttcggtatcggcgtaacgtaccgtccgggtagggaaccggggtccgtaatttacccgaaccgtacttaccgtaccgaaagtacgaactaaacgttcccgaaagggtaacctaacgtaaattacggtttaacgtttacggtaacccttaggaaaccgtacgtaacccgtaacgttcccgtaggaacggttacgtaacgggttcgtaacgttaaccgttacggtaacggtaacggggaaagggggtaaaccggggggtaaccaacggggtccgggttaaccggttaacccgtaaacggttttacccgttaccggttttacgggacccgggttcgggtaccgggggtaacccccggg

SEQ ID NO: 76653 - DNA, 849 bp, Homo sapiens
  misc_feature: GYAE6OF01A0KU6.8.34.D01.1.454.CMB.1.raw
  modified_base (173)..(173): a, c, t, g, unknown or other
  misc_feature (173)..(173): n is a, c, g, or t
  modified_base (199)..(199): a, c, t, g, unknown or other
  misc_feature (199)..(199): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagnggtgtccagtgtcaagtgcaactggnggagtcgtgggggagcgtggtccagccgtgggagtcacagagacctctcgtgtgcacgtcctcgtcgggttccaccttcaagtaaccgtcggctagtcgactacggtcgggtcccaccgaagcctaccgaggacgaaggggtattgggacggttgggtggcttaggttttcgtttacacgttcgtaggacggggtactaggttcgttacgaagttgggttactcggactacggtacccggttaccggtagggtaaccgggtaccgtactttacccgaacccttaccgttaccgttaccgaaaggtaaaccgtaaccgttaaaccgttaacccggaaagggtaaaccctaaacggttaacgtttagggtttaacggtttacgggaacgtacccggttaacgaaacccgtaaccgttaaccccgtttaaacgggtcccggttaacgggaacgggtacccggtaacggggttacccttaaacggttaaccgttaacgggtttaaccggggtaaaaccggggaaacgggggggtaaacccgggggaaaccggtaaccggggtaaccggggttaaccggtttaaaccccggtaaacgtttacccgggtttaacccgttttccggggtaaccgggttcccggggtaacccgggggg

SEQ ID NO: 76654 - DNA, 788 bp, Homo sapiens
  misc_feature: GYAE6OF01D3OAO.8.34.D01.1.454.CMB.1.raw
  modified_base (145)..(145): a, c, t, g, unknown or other
  misc_feature (145)..(145): n is a, c, g, or t
  modified_base (160)..(160): a, c, t, g, unknown or other
  misc_feature (160)..(160): n is a, c, g, or t
  modified_base (187)..(187): a, c, t, g, unknown or other
  misc_feature (187)..(187): n is a, c, g, or t
  modified_base (425)..(425): a, c, t, g, unknown or other
  misc_feature (425)..(425): n is a, c, g, or t
  modified_base (625)..(625): a, c, t, g, unknown or other
  misc_feature (625)..(625): n is a, c, g, or t
tcagctcgcgtgtccacgaccggtgctcgatttagatcgtctgtgttgggtttgggggaggaactgctcagttaggacccagagggaaccatggaacgccccagctcagcttctcttcctcctgctactctggctcccagtttcngactaccgaccgganagtattgtgttagacactactcctacncgcctacctgtcttcgtcgacgaagggaacacgccctctcctcgtgcgacggccagtcagtagtcggttcggccgtaccgttaacgtacgttccgtaacggaccaaaacgtaacgtaaccgtcgggaccgtaaccggtccgtaccccgaccggtacccctcgtaacttacggtttaacggttcggaccgaactttacccgaaaccgaaggggttccccaaacgttccgggacctaacnccccgtaaaggcccgttaaggttccggaacgtgggtaccgaaggttggggtaaactcggggaactccggttaacttccgaacgtttacccgtactaacccgtaactacctacgtaaccgtacggtaccgtcgggtaaccgtacggtacggtaacggtacggttacgttcgtacgttaacgtttacgttacgttaccgttnaccgtaacgtacgtaccggtacggtaccgggtccggtcccgggtaccgggtaccgttaccggttaccgtaccggtacggtaacgtacggtaacgtaacgtacgtaccgtaacgtacgtacggtcgtacgtcgtacgtacgtactacgtcgttccgtacgtccg

SEQ ID NO: 76655 - DNA, 566 bp, Homo sapiens
  misc_feature: GYAE6OF01ASCYP.8.34.D01.1.454.CMB.1.raw
  modified_base (419)..(419): a, c, t, g, unknown or other
  misc_feature (419)..(419): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggaggtcacagagactctcctgtgcagcctcgtgggttccaccttcagtagcctacggcatgccacgtcgggtccccaccaaaactccaggcaagggtattgggaggtgggtgctaggtttgttcatcgtggagggctagtcgttacaagttggtatgacgtgaccgccgtggaacgggccgtattccacctntcctaccgaagacgacaactccaaggaaccagaatgtacgttggactagaacacgacctaagtccgtagagacgtacggtatactacgtataggtacgaagggacggggacaggtcggagtccaagtctacgttgcgtgtcggaccg

SEQ ID NO: 76656 - DNA, 755 bp, Homo sapiens
  misc_feature: GYAE6OF01C7SLO.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaaangcccaccctctctgcagggccagtcagaatgttggcgcctagtactccgtgtaccaacagaaacctggcccaggcctacccacggccccctcactctagtggtcgcactccgaacgacgggccacgtggacactcccacgccgtaggttcaggtggaccgtaggtaggggtactggggaacaacggtccttacgccttacgtctacccatacctatcgacgtcccgtagggacgtcccgtaggagggttagttcggttcggtacgttagttttaactttaacgtcggttaacctaaaccgacgtttacccggtaaccgggttacgggtacccgggttccccgggtaccccggggggttacccttaccccgggttttacccgggtaacccccggttaccgggggtaaacccgtaaaacggggtaccgggttaaacgtaaccgttaaacccgaaaaaccgggttaacccggtttcggtaaccgggttaccgtaaccggtcccgaaaccgttaacgttccgtttacgttacccgtttccgttaaccccg

SEQ ID NO: 76657 - DNA, 811 bp, Homo sapiens
  misc_feature: GYAE6OF01B7899.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccagtggagtttgggctgaactgggttttcctcgttgcttcttttaagaggtgtccagtgtcaagtgcaactggtggagtcgtgggggagcgtggtccagccgtgggagtcacgagagactcgtcgtagtgcacgccttcgtcgggttccaccgtttcgaacggttaaaccgtacgggacctagtggccgtaaccggttcgggggtaccccgacccgtaaacgcccgttacccgaaggacgtaaaggggtagtttaggggaaggttgggggtcggtcgttaaggttttcggtttaccgaagttccgtagggaacggggtctaagggttcgttaacgtaaaggttgggttaatcggtaccgaaacggtacccggttaccgggtagggaaaccgggtcccgttaacgttacccgaacccgtacttaccgtaaccgtaaggaacgtaaccgtaaacgtttacccgaaacgggtaaacctaaacgtaaagtttaggttaacgtttacgggaacgtaccgttaacgaaaccgtaacggtacccgttaaacgttcccgtaaggaacggtacgacgggtactaacgtaacgttacgtacgggtaacgggaaacggggtacggggaaccgtacgggaccgggtacgttaccgtaacggttaccttaccggttacggtccggttcggtaccggggg

SEQ ID NO: 76658 - DNA, 974 bp, Homo sapiens
  misc_feature: GYAE6OF01CSBBD.8.34.D01.1.454.CMB.1.raw
  modified_base (252)..(252): a, c, t, g, unknown or other
  misc_feature (252)..(252): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcacatggagttggctgacttggttttcctgttgcttctttaagaggtgtccagtgtcaagtgacaactggtgagtcgtgggggagcgtggtccaggccgtgggagtcaacgaggacgaccttcgtcgtgngaccacgtccttcgttcgggtttacctaacccgtttcgaaacgttaaaccgttaccgggacctaagttcggaccctacggttccggggggttaccccaccccgtaaaacggtcccgttaccccgggaaggggtacccgtaaaaggggggtcgtttttagggggaacggtttggggggtacgggtaccgtttaagggtttttcggttttacccgaagtttcccggttagggtaacggggtaccttaagggtttacggtttaacgaaaggttttgggtaacgttcggaccgttaaacggttaaccccgttaccgggttaaaggggaaccggggtcccgttaaaccgtttaccccgaaccctttaaccgttaccccgttaaccgaaaggtaaacccgtaaaccgttaaaaccgtttaccccgggaaacgggtaaacccttaaaccggttaaagtttaacgggttttaacgttttaaggggaaccgtttccgtaaacggtaaaccgtaaccggttaacccggttaaacggttacccggtagggaaccgggtaaccggtacgggttaccgttaaaccttaccggtaacggttaacgggtaaaacggggaacggggggtaaacggggaaacccgtaaacggggtacccgggtttaaacgttaacccggtaaccggtttaaccgtttacccggtttaacgggtccgggtttacggggtaaccccggggg

SEQ ID NO: 76659 - DNA, 824 bp, Homo sapiens
  misc_feature: GYAE6OF01BDEYV.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccaggccgtggggaggtcacagagactctcgtgtgcagcctcgtgggttcaccttcagtaactacggcatgcacgtgggtcccgccaacgcccccagggccgaaaggggtatttgggaaggttggggtacggctaaggtttggtttaccaagtccgtaggagggctaggttcggttacaagttcgggtaatcggaccgtaggtacccgttacccggtagggaaaccgggtcccgtaagtttacccaaaccccgttattacccgttaccccgaaaggtaacggtaaacccgttaaacgtttaccccgaaaacggggtaaaccctaaaccgtaaacgtttacggtttaaagttttacggggtaacgtaccgttaacgggaaccgtaacgtaacccgttaaacggttcccgttaacgggaacgggtaaccgaaccgggggttaccgttaagttacccgttaaacgttaccgggtaaaccgggaaacgggggggtaaccggggggaaacccgtaagggggaccggggttaaccgttaccccggaaacggttacccggtacccgtttacccgggtttacgggtaacccgggttcggggtaacccgggggg

SEQ ID NO: 76660 - DNA, 903 bp, Homo sapiens
  misc_feature: GYAE6OF01ETA1R.8.34.D01.1.454.CMB.1.raw
  modified_base (615)..(615): a, c, t, g, unknown or other
  misc_feature (615)..(615): n is a, c, g, or t
  modified_base (692)..(692): a, c, t, g, unknown or other
  misc_feature (692)..(692): n is a, c, g, or t
tcagctcgcgtgtccacgaccggtgctcgatttagatcgtctgtgttgggtttgggggaggaactgctcagttaggacccagagggaaccatggagccccagctcagcttctcttcctctgctactctggcctccctagtttcagactacccgaccgggagagtattgtgttgaccacaaactcctaccacgacccctacccttcggtcctttccgtccgtaaccggaagggggaaacgccgaccctaccccttctcccgtgggaccgaacggggccaacgtactacggtaagttcgggttacggacccgtaccttaaccgttaccgttaccgtaaccggtaaccgaaaccgtaaccgtaaccggtaccggaccggacccggtacccgtacccggaccccggtacccctaccgctttaccaagttacggtacgtaccgtggacggtaacccgggaacccgaaaccgggtcccggtaaccgtacggtaccccgaaccgtacccccgcaacgggtttcccaacggggtttacggaccggtagggtcggggtaacgttcgggggggtaaacctacgggggaacccttacggaaccctttacctaccgtaccctacctnacccacttaccacgtccgtacgggtacccggtaccgggtacggtaccggttaacggtacgggttacgttacgtttancggtttaactttacgtttaacgttaaccgtaacgtaccgtaaccggtaaccggtaccgggtacccgggtacccgggtacccgggtacccggttacccgggttacccggttacccggttacccgggacccgttaaacgggttaccggtacgttaacggaacgtaacgtaccgtaacggtaccgtcggtacggaccgtaccgtcctccgtacg

SEQ ID NO: 76661 - DNA, 711 bp, Homo sapiens
  misc_feature: GYAE6OF01A4EYT.8.34.D01.1.454.CMB.1.raw
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaancgccaccctctcctgcagggccagtcagaatgttggcncctacgtatccgtggtaccaacagaaacctggaccaggcctcccacggcccctacactctagtcggtcgcactaccaacgacgggccacgtggccactcccacgcctaggttccaggtcggacgtaggtagggtagtcggggacagtaccttcgacctcctacgacctatacgactaccgacgtcccgtaggaccgtccgtaggaacggtagttcggttagtacgttaagttttaacttacgttacgtaactaacgttacgtaccgttaaccggtacggtaccgggtacccgggttcccgggggtacccttacccggtttacccgggacccggttaccgggtaacccgtaaagggtaccggtaacgttaaaccggtaaccgtaaaacccgtaaggttacggtccggtacgtaccgtaccgtaacccgttagttacccttacgtttcccgttacgttaaccccg

SEQ ID NO: 76662 - DNA, 846 bp, Homo sapiens
  misc_feature: GYAE6OF01EC26U.8.34.D01.1.454.CMB.1.raw
  modified_base (179)..(179): a, c, t, g, unknown or other
  misc_feature (179)..(179): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggtagtttgggctgtaacgttgggttttcctcgttgtcttacgttttaagngttgtccagtgtacaagtgcaacgtggtggagtcggtgggggagcggtggtccaggtccgtgggagtcacgagacgtctcgtcgtgtcgcacgtcctcgttcggttaccacctttcgaacgttaaccgtacggactatcggtaccacggttccgggcccgaaccgaagtcccgtacccggaagggcggaaagggtgttggggagggttcgggttgacgtttaggttttcgttaccgagttccggtaggacggtcgttaagggttcgtttaaccgaaaggtttggttaacgtcgacgtaaacgggtaccggttaccgggtacggggtaacccgggttacttaacgttacccaacccgttagtccccgtaacgacgtaacgtaaccgtaacgttacccgaaaggtaacctaacgtaacggtttagttaacgtacggtaacgtaccggtaaagaacccgttaaccggtaacccgttagggtaccgtaacggtaccgggaacggttaccgggttaactaacgttaacccgttacgggaaacggggtaaaccggggaaagggggtaaacccggggtaacgtaaaccggggggtacgtttaaaccggttaaccggttaacgggttttaccccgttaccggtttacggtcccgggttcgggtaaaccccggggg

SEQ ID NO: 76663 - DNA, 893 bp, Homo sapiens
  misc_feature: GYAE6OF01DONG1.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagatttgtgttgacacaatctccagcccacctgtcttcgtctccgaaggggaaagcgcccaccctctcctcgacgacgggcctaaggtacaagtaaagttggttcggccgtaccgttaacggttacttccccgttacgggtaaacccaaacgtaaaccggtaaaacccgtcgggacccgtaaaccggggtcccttacccccggaaccggggtacccccccttacgtaaccgtttaccgttaacggttacggggtacgtacccgtaaccttaaccccggaaacggtaacccggggaccctaacggttcgggacctaccgttaccccgacggtaccgtaggttaccgaaggttcggacgtaggggtgggttaacgtacgggtaacgtaacgttaccttaccgacttaccgtaccaaccgtatacctacgtccgtaacggtcccgtagggtacgtaccgtagggtaggtacgtttcggttacgtacctttaagttttacttaacgtcgtaaaccgtaacttacggtttacccgtaaccgggtacgggtttcccggggtaccccggttaccccggggggttacccttacccggggtttcccgggggaaccccggttaacggggaaaccggttaaaacgggttcggtaaaccgttaaccggtaaaccgtaaaccggtaacgttcggggacgtacgtaccgtaacctacgttacgtttaccgtcgttccctttccgtacccg

SEQ ID NO: 76664 - DNA, 831 bp, Homo sapiens
  misc_feature: GYAE6OF01BHQVZ.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccagtggagtttgggctgaacgttgggttttcctcgttgtcttacgttttaaggaggtgtccagttgtacgaagtgctaacgtgggtggaggtcggtgggggaggtcggtcggtccacggccgtgggacggtcaacgagagtctcgtcggtgtcgcagtccgttcggttcggttcctaccgtttcgaaaggttaaccgtaccggtacacgttcggaccgtaccggttcggggtaccccgaccgtaaacggtcccgtaaccggaacgggacggtaaaggggttgtttaggggtaacgggttggggtacggtacgtttaggttttcgtttacgacgttccggtagggaggtactaggttacgttaacgtaaggttcggtagttcgaccgtaacggtaccgttccgggtaagggtaacccggtacctaacgttacccgaacgttacgtacccgtaacgaaacggtaactaaacgttaccgtaacgaacgtaaacgtaacgtaacgttaggttagttacggacgtaccgttaacgaaccgtaccggtaactaccggtacgtaacggacggtaaccggtcggttaaaccgtataaccggtacgtaacggggtaaacggtaacgggggaccgggtaacggtacggtaaccgggttaacttacccggtaacgttaccggtttaccgtcgggtacccgggttcgggtaacccggg

SEQ ID NO: 76665 - DNA, 875 bp, Homo sapiens
  misc_feature: GYAE6OF01ER0SE.8.34.D01.1.454.CMB.1.raw
  modified_base (336)..(336): a, c, t, g, unknown or other
  misc_feature (336)..(336): n is a, c, g, or t
tcagctcgcgtgtccacgaccggtgctcgatttagatcgtctgtgttgggtctgggagaggagcccagcactagaagtcggcggtgttccattcggtgatcagcactgaacacagaggactcaccatggagtttgggctgacttgggttttcctcgttgcttcgttttaagaggtgtccagtgtacaagtgctaagtggtggagtcggtgggggagtcggtacgtccgaggtccgtaggggacggtacacgaggacgtacctcctaccgtggtcgcctaggtcccttcggttcgggtttaccctacccgttacgtaacggtacgtccgtaacgggntacgtcggaccgtaccggttccgggtacccgaaccctaaacgtccggaagggacgtaacgggggtagttcggggaaggttcgggggtcggtacttacggttttcgttacgtaacgttcggtaggggtaggtaccgtaggttcgtttaacgagttgggttactgggtaccgtacggtaaccggtccgggtaagggaccgggttacctagttcccaacgtactaccgaccgaacgtacgaaccgtaacctacggaaacgtaacgtactaagtttacgttaacgtttacggaaccttacggaacgtaccgttaaccggttaacgtccggtaagggtaccgtaacgggttacggttacgttaacgtaccggttaaacggttaacggggaaacccgggggtaacggggggtaaacccggggtaaccgggtaacgggttacccggggttaaaccgtttaacccggttaaaccgggttttaccccgtttacggggttaacccgggttaccgggtttaccgggggtacccgggggtttaaccccggg

SEQ ID NO: 76666 - DNA, 675 bp, Homo sapiens
  misc_feature: GYAE6OF01AVCNC.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgcccaccctctcctgcgacgggccagtcagaatggttggcgcctacgtatccgtggtaccaacacgaaacctggaccaggcctcccgacggcccctcactctagtggtcgcactaccaacgacgggcccacgtcggaccacgtcccgacgcccgtaaggttacaggtcggccgaaggggttcgggggttaagtacggggaactaacggtaccgtttacgaccttcctaccaaccgtacttacactcacgtccgtgggacgccgtaggacggtattggttcgacttaagttttatacgtagtactaacgtacgttaccggtacgacggttccgggtcccggtccgggggtacccttaccggtttaccgggaccccgtacgggaaccgtaacggtcggtaactaacgtaccgtaaacgtacgtggtcgacgtcgacctaacctactcgttcgttctacgtacccg

SEQ ID NO: 76667 - DNA, 747 bp, Homo sapiens
  misc_feature: GYAE6OF01DYGHC.8.34.D01.1.454.CMB.1.raw
  modified_base (313)..(313): a, c, t, g, unknown or other
  misc_feature (313)..(313): n is a, c, g, or t
  modified_base (362)..(362): a, c, t, g, unknown or other
  misc_feature (362)..(362): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagaatgttggcgcctacgtatccgtacggtaccaacaacgaaacctcggaccgacggcctcccgacggccccctanactccttagtcggtcgacactaccaacggacgggccacgtcggactacncccgacgccgtagtcgaggtggccgtagggtcgggtaggtacgggaactacggtacttccgacgtctaccgaccacttacacctcgaacgtcccggtagggaccgtaccgtagggaacgttaagttggtttacggtcgtttaagtttttaaccttacgttacggttacctaaaccgtacggtttaccggtaccggtacgggttaccggtccccgggttaccccgggggtcccttacccgggtttcccggggacccgtaccgggggtaaaacctaacggggttacgtaacggttaaacctaaccgggaaaaccggttacggttagggtaccggtactaccgggaaccttaccgaacgtttccgttacgttcttcccggttaacccc

SEQ ID NO: 76668 - DNA, 728 bp, Homo sapiens
  misc_feature: GYAE6OF01BM2ID.8.34.D01.1.454.CMB.1.raw
  modified_base (208)..(208): a, c, t, g, unknown or other
  misc_feature (208)..(208): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaanagccaccctctcctgcagggccagtcagaatgttggcgcctacgtatcctggtaccaacacgaaacctggaccaggctcccgacggcccctcactctatcggtgcatccaacgacgggccacgtcggcatccccgagcctaggttcaggtcggcaggtgggtagtagggacagtacttcactcgtaccacctatacactcgacgtccgtcgggacgtccgttaggaaggtacgttacggtttcggtacgtttaagtttttacgttaacgtttacggtaaccttaaaccgtaacgttcccgttaacccggtacgggttaaccgggtccccgggttacccccgggggggtacccttaacccgggttttccccggggtaccccgggttaccggggtaaacccgtaaacgggttacgggtaaacgttaaccgtaaccgaaaaccggttaaccgtacgggttacgggtacccgtaggtacccgaacccttacgtacccgtttcggtttacccgttccgttacccg

SEQ ID NO: 76669 - DNA, 853 bp, Homo sapiens
  misc_feature: GYAE6OF01A8JUJ.8.34.D01.1.454.CMB.1.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaancgccaccctctcctgcagggccagtcagatgttgcncctagtatccgtggtaccaacacgaaacctggccaggcctcccgacggccccctcacttctagtcggtcgactacgtacccaacgacggggaccctaacgtcgggacccaaccgttacccccgaacggtcccgtaacggggtttaccaacggggttcgggaccgtaaggggtttacgggggttaaacgttacggggggaaaccctaaggttaacccgtttaccgtaacccgtttccgttaacccgaaacccgtacgttaccctaacgttcccgaaccggttcccgtaggggtaaccgtccccggttaagggtaacgggtaacttttcgggttaacgtaccgtttaaggtttttaacgttaaccgtttacggttaaccctaaacgttacggtttacccggttaaccgggtaccgggtttacccggggaccccgggtttaccccgggggggtaccccctttacccgggtttttacccggggaccccggttaccgggggtaaacccgtaagggttaccggtaacgtaacggttaaccgaaacgttacggtacggtcggtaccgtacgtacctaaccgttacttaccgttacggtttcctaccgttacccg

SEQ ID NO: 76670 - DNA, 748 bp, Homo sapiens
  misc_feature: GYAE6OF01CT7I3.8.34.D01.1.454.CMB.1.raw
  modified_base (206)..(206): a, c, t, g, unknown or other
  misc_feature (206)..(206): n is a, c, g, or t
  modified_base (344)..(344): a, c, t, g, unknown or other
  misc_feature (344)..(344): n is a, c, g, or t
  modified_base (724)..(724): a, c, t, g, unknown or other
  misc_feature (724)..(724): n is a, c, g, or t
  modified_base (741)..(741): a, c, t, g, unknown or other
  misc_feature (741)..(741): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctccagtttcagactaccacggagagtattgtgttgacacatctcagccacctgtcttcgtctccgagggaanacgccacctctctgacgacgggtccagtacagtaagtggttcggcgtacctacgtagttcccgtaggtaacccaacgaacgaaaccgtcggaccgaggcccttacccgcggaccccctatacttaccgtaggtcggtnacctactaccgaacgacgggaccaacggtcgacctacgtcccgaacgtccgtacgggtttacaccggggtagggaccgtaaggggttacggggtacggtacgggggaaacctaacggtaccgtttacctaaaccgttcttaaccccgaactacgttaccgaacttccggacgtaccggtacgggaacgttccgtaagggacgttacgttacggttagtactttagtttaactacggtactacaagtacgttaccggacgttaggcccgggtcccgggtacccgggtaccttaccgggttccggaccggtaagggttaccaaggtcggtaaacttaccggtaaaccgaacggtattggccgggtacaccggacctacggtnttacggttcgtaccttntaccccg

SEQ ID NO: 76671 - DNA, 841 bp, Homo sapiens
  misc_feature: GYAE6OF01ACX0A.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagataccaccggagagattgtgttgacacaatctccagccaccctgttcttgtctccgaaggggaaacacgccaccctctcctgcgacgggccagtcagagtctaccaccctagttacgcctagtaacctaacaacaaccgtggccgacggtacctcccgacggtcccctacctagttacccttttgaacgttcgtacctaactcccgtaaccgtacggtaccggggtaccctaaccgttaccgggtaccctacccgttacccccgacgggtaccccgttaacgggtttaccgaacggttacgggcggtaaggggtttcgggtaccggttaacggggaacctacggtacctttaccggacccttcgtaaccctaaccgtactcgtaaccgtaccgtacgtacccggtaacgacgtacccggtaacgtaacgtttcgtttacgtacgttagtttacgtttaacgttaccgaactaacgttacccgtacgggttaacccgtgggttaacccgggtcccgggttaccccggggtacccgtttaacccggttccgggttacccgggaaccggggttaactaaaccgggtttcgaacgtaacccgtaaaccgtaacggttaaccggtcgggttaggcccgttaaccaacccgtaccgtaacgttacccgttaccgttaccggttaccctccgttaacccccg

SEQ ID NO: 76672 - DNA, 670 bp, Homo sapiens
  misc_feature: GYAE6OF01ALVUC.8.34.D01.1.454.CMB.1.raw
  modified_base (170)..(170): a, c, t, g, unknown or other
  misc_feature (170)..(170): n is a, c, g, or t
  modified_base (456)..(456): a, c, t, g, unknown or other
  misc_feature (456)..(456): n is a, c, g, or t
  modified_base (550)..(550): a, c, t, g, unknown or other
  misc_feature (550)..(550): n is a, c, g, or t
  modified_base (562)..(562): a, c, t, g, unknown or other
  misc_feature (562)..(562): n is a, c, g, or t
  modified_base (598)..(598): a, c, t, g, unknown or other
  misc_feature (598)..(598): n is a, c, g, or t
tcagctcgcgtgtccacgaccggtgctcgatttagatcgtctgtgttgggtcgtgggagaggagcccagcactagaagtcggcggtgtttccattcggtgatcagcactgaacacagaggactcaccatggagtttgggctgactggttttcctcgttgcttctttaagnggtgtccagtgtcaagtgcaactggtcggagtcggtgggggagcgtcggtccagccgtggggacgtcacagagtctcgtcggtgtagcacgccttcgtggttctaccttcgaagttaacctacgggcagtcggacctacgtcggggtacccaccaaagtcctaccgagggaccgtaaaggggtactttggggacgggttacggggttcgtccgtaagggttttttacgttcgaccgttacggttgggaacgggtccgtaaggttcgtttacgaaggttaggttacncggacgtacgtacggttccgggaggtacggggtacccgtagttacacccgtagttccgtaccgagtacgactaagttcccaagacaactacgtnttacgtaggacngtacactacgaactgtacgtgacggtcgagtcgtanactcgaagtacggagggacggaagtacggacggttacgtacgaacgtcgttagtcgaaccgtgtaccggggg

SEQ ID NO: 76673 - DNA, 676 bp, Homo sapiens
  misc_feature: GYAE6OF01ATW4X.8.34.D01.1.454.CMB.1.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (648)..(648): a, c, t, g, unknown or other
  misc_feature (648)..(648): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanacgccacctctcctgcagggccagtcagatgtgcnctacgtatccgtgtaccaacagaaccgtggccaggcctcccgacggccccctgactctagtcgggtacgctactccgaaacgacgggccacgtcggcctaacgtccccgaacgccgtaggttccaggtcggacgtagggtgggtacgtcggggaacctaggtaccttctaccgtcctaccaacctacgttaccacttccgaacggttcccgtagggtaccgtcccggttagggaacggttacgttcggttacgaccgtttagttttaaccttacgtacgtacctaaacgtcgttaccggtacggtcggtaccgggtccccggtaccggggtcctacggtttaccgggacccgtacgggaactaaggtcgtaactacgtaacgtaacgtacgtggcgtcgtacncctacgtactacgttcgttcctcgtacc

SEQ ID NO: 76674 - DNA, 728 bp, Homo sapiens
  misc_feature: GYAE6OF01BC0ZL.8.34.D01.1.454.CMB.1.raw
  modified_base (208)..(208): a, c, t, g, unknown or other
  misc_feature (208)..(208): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccgaccggagagattgtgttcgacacaatctccagccacctgtcttcgtctcgagggaanacgccaccctctcctcgcgacgggccagtcagaatggttcggctcctacgtactcctaggtaccaacacgaaccgtggccaggcctccgacggtcccctcactctagtcggtcgacactaccaacggacgggacccacgtacgggacactcccgacggacctaggttcgaggtcggacgagggtaggtagacgggacacggtaccttctacgtcacctaccgtatacctactacgtaccgtccgaggtacgaccgttaggacgttagttaggttcgtacgtttaagttttacgttacgtacgtaccttaacgtaccgttaccggttacggacgggttaccggtcccgggtacccggggtcccgttaccggtttaccccgggaccgggtacgggtaaaccccgtaaaggggtccggttaaagaaccggttaaaccggaaaccggttaacgtcggggtacccgtacggttacccggacccttaaccgtacgtttaccgttaccttccgttcccggttaaccc

SEQ ID NO: 76675 - DNA, 886 bp, Homo sapiens
  misc_feature: GYAE6OF01BZBG3.8.34.D01.1.454.CMB.1.raw
  modified_base (458)..(458): a, c, t, g, unknown or other
  misc_feature (458)..(458): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacgttgggttttcctcgttgcttcttttaagaggtgtccagtgtcaagtgcaacgtggtggagtcgtgggggagcggtggtccaggccgtggggaggtcacgagagaccttcgtcgtgtgcagtccttcgttgggttaccaccgtttacaagttaaccgtacggactagttcggacctacggttcggggtccccaccgaaggtcccgtaccgagggaccgaaaggggtagtttggggaggttggggtggacgttaggttttcgtttacagttccggtaggacggggtctaaggttcgttactaaggttcggttaancggactaacggtaccgttaccgggaagggtaacgggtcccttaacgttcccgaacccttacgttacccgtacccgaaggtaaaccgtaaccgttaaaccgttacccgaaacggggtaaaccctaacgttaaagtttagggtttaacggttttacgggaacgttaacgttaacggaaaccgtaaccgggttaccccgttaaacgtcccggtaacgggtaacgggtaacccggtaacggggttaacgttaaccgtttaaacccgttaccggttaaacggggtaaacccgggggtaaaacggggggtaaccggggggtaaacccggtaacggggtaccggggttaaacccgtttaacccgggtaaacggtttaccccggtttacccgggttttaacgggacccggggtttccggggttaaaccccgggggg

SEQ ID NO: 76676 - DNA, 703 bp, Homo sapiens
  misc_feature: GYAE6OF01A42ZO.8.34.D01.1.454.CMB.1.raw
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
  modified_base (372)..(372): a, c, t, g, unknown or other
  misc_feature (372)..(372): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctcgtgggttccaccttcaagtaacgtacggctatgcacgtgggtcccncaagctccgaggcgaagggntgggaggtgggtgctagtttgttcagttcgtaggagggctagttgttanaagtggtatgcgtaagtactccggtaggaacgggtccgtacttcgacctactcctaccgaagacgaactaacgttaccgaacggtaaacctaacgtaagttacggttacgtttagggacgtacgtaacgtaaacgtaacggtaacccgttaaacggttcccgttaagggaacggtaaccggtaccggggtacgttaacgttacgttaaccggtagggtaaaccgggaacgggggtaacggggggaaacccgacggggtaccgggtaacgttaacccggtaaacggtttacccgttaccggtttacgggtaccggttccgggtacccggggg

SEQ ID NO: 76677 - DNA, 702 bp, Homo sapiens
  misc_feature: GYAE6OF01DARF1.8.34.D01.1.454.CMB.1.raw
  modified_base (210)..(210): a, c, t, g, unknown or other
  misc_feature (210)..(210): n is a, c, g, or t
  modified_base (254)..(254): a, c, t, g, unknown or other
  misc_feature (254)..(254): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaaaancgcccaccctctcctgacgacgggccagtcagaatggttggccncctacgtatccgtaggtaaccaacgaacgaaacctggccacggcctcccgacggcccctnactctagtggtnacactaccaacgacgggccacgtcggacactcccgacgccgtacggttcaggttcggacgagggttaggggtacgtacggggaactacggtaaccgtttacgacctttacacccaaccttaacgtcctaactccgaaccgccgttagggaccgtccgttaggacggtaattggttacgtacttagttttaacttaccgtagtacctaacgtacgtaccgtaccggtaggttcccgggtaccccgggttcccggggtaccttaccggggtttcccggacccggttacgggaacgtaaggtacggaacttacgtaacgaaaccgtacgttcggtaccggcgtacgacctacgttacttcgttctcgttccgttacccg

SEQ ID NO: 76678 - DNA, 705 bp, Homo sapiens
  misc_feature: GYAE6OF01BBVT8.8.34.D01.1.454.CMB.1.raw
  modified_base (208)..(208): a, c, t, g, unknown or other
  misc_feature (208)..(208): n is a, c, g, or t
  modified_base (242)..(242): a, c, t, g, unknown or other
  misc_feature (242)..(242): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaancgccaccctctcctgcaggccagtcagatgtgcncctacgtatccgtggtaaccaacgacgaaaccgtcggcccagggcctacccgacggtccccctcgactccttagtcggtcgaccactccaacgcgggcccacgtcggacactcccgagaccgtaggtcaggtcggacgtagggttggggtagcggggtaacaggtacttccgactcctacgacctacttacacgtcaccggtccgtacgggacgtcccgtaggtacggtattcgggttcgacgtttaagttttaacttaccgttgtaacctaaacgtcgttacggtaacccggtaggttcccgggtacccgggtacccggggtcccttacggtttcccggacccggttacggggaaacccgtaaggtcggtaaacttaccgtaaccggtaaaaccggtacgttacgggttacgggacctcggaaccctaccgttaagttcccgtcgtttaccgtcctacccgg

SEQ ID NO: 76679 - DNA, 818 bp, Homo sapiens
  misc_feature: GYAE6OF01BLDSH.8.34.D01.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (300)..(300): a, c, t, g, unknown or other
  misc_feature (300)..(300): n is a, c, g, or t
tcagctcgcgtgtccacgaccggtgctcgatttagatcgtctgtggttgggtttgggggaggaactgctcagttaggacccagagggaaccatggaagccccagctcagcttctcttcctcctgctactctggctccagtttcagataccacggagagattgtgttgacacaatctccagacaccctgtcttcgtctccgaggggaancgccaccctctcctgcagggccagtcagatgttggcncctacgtatcctggtaccacagaacctcggaccaggcctcccgacggtccccctnactctagtggtcgcctactacccgaacgacggggcccaacgtcggaccacgttaccccgagtcccgtaagggttccaggttcgggccgtaggttcgggggtaacaggggactacggtaccgtttcaccgttcctactaacccgattacccgaacgttaccgtaacggtccccggttagggtaccgtacccgttaaggtaaacggtagtttacggtttacggtaccgttttaacggttttaacttaaccggtttacggtaacccttaaaccgttaacggtttaccccggttaacgggtaaccgggttccgggtacccccgggttcccggggggtacccctttaacccgggtttcccggggacccccgggttaacgggggtaaccccggtaaacgggggttacgggtaaccggttaaccgtaaacccgggtaaaaccggtaccggttacggggtaccgggtacgttaccggaacccgtaccgttacggttaccgttacggtttccctttacgttaccccg

SEQ ID NO: 76680 - DNA, 694 bp, Homo sapiens
  misc_feature: GYAE6OF01AJDTF.8.34.D01.1.454.CMB.1.raw
  modified_base (351)..(351): a, c, t, g, unknown or other
  misc_feature (351)..(351): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtggggacggtcacgagagactctcgtgtgccagtccctcgtgggttccaccttcaagtaacgtacggcatgcctacgtcgggtcccaccaagcctaccgaggcgaagggtgttgggaggtgggngcgtagtttcgtttcacttcgtggacgggctaggtgttacaagttggtagtgacgagtaccgtaccggtagggaacggaccgtattaccacctactcctaccgagacgactaacttaccgaaggaacaactaagtgttagtttacggactacgtaacgaactacggtacccttaacggtaccgtacggaacggtacccggacgggtaccgttaacgtacccgttaaacggtagggtaaaccgggtaagggggaaccgggggaaccggacggggtaccgggtaacggttacccgtaaacggttaccgttacccggtttacgtaccggggttcggtacccggggg

SEQ ID NO: 76681 - DNA, 720 bp, Homo sapiens
  misc_feature: GYAE6OF01B621G.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtggggagtcacagagactctcgtgtgcagcctcgtgggttccaccttcaagtaactacggcatcgcacgtcgggcccacctaacgcctaccgaggaccgaagggtcgttgggaggttggggtcggtcctaggtttcgtttaccgagttcgtggacgggctaggttgttacaagttggtatcgacgacgtacgttccggtaggaacgggtccgtacttaccgtacctagtcctaccgaagaacgtaaccgtaacgttaccgaacggtaaactaaccgtaaagttgttaagtttacggaacgtacgttaacgaacgtaacgtaccgttaaacggtccggtaaggacgggtaaccgacgggtacgtttaacgtaaccgttaacggtaacgggtaaacgggaaagggggaaccggggggtaaaccgacggggtacggggtaacgtttaacccggaacgtttacccgttacggtttcggaaccggttcggtaaccggggg

SEQ ID NO: 76682 - DNA, 724 bp, Homo sapiens
  misc_feature: GYAE6OF01CJDKC.8.34.D01.1.454.CMB.1.raw
  modified_base (363)..(363): a, c, t, g, unknown or other
  misc_feature (363)..(363): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggaggcggtggtccagccgtgggaggtcacagacgactctcgtgtgcagccttcgtggttccaccttcgaagtaactacggcatgcacgtggtcccgacgaagctaccaggcgaaggtagtggaggtgggtgcgtagttgttacgattccgnggagggtactaggttcgtacgtaagttggtaatgtacgaaggtaccgttcccggtaggaaccgggtccgtacttaccgacctaacgtcctaccgaaggtaacgtaactaaaccgttaccgtaacggaaacctaacgtaaagttagtttaacgtttacggaaccgtacgaaactaccgtaaccgttaacgtccgtacggaaacggtaccgttagggtactaagttaaccgtacggtaacggttaaacggggaaacggggtaaccggggggaaactacggggtacgggttaacccggttaacgtaaaccggtttaccgtttaccggtttacggacccgggttccggtcggggggtaaccccgg

SEQ ID NO: 76683 - DNA, 713 bp, Homo sapiens
  misc_feature: GYAE6OF01D1SMB.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaacgacgccaccctctcctgcgacgggccagtcagaatggttcggcgcctacgtactccgtaggtaacccaacgaacgaaaccgtggaccacggcctcccgacggcccctcactctagtggtcgacatccaacgacgggccacgtcggcctacgtcccagacctaggttcaggtcggcgaggttcggggtaagtcggggaacacggtacctttacgaccttctacctactatccactcgacgtccgtaggacgtcccgtaggaggtacgtggttagtacgttaagttttacttacgttagtacctaactacgtaccgtaacggtcggtaccgggtcccgggttacccgggggtcccgttaccggttttcccgggacccgtacgggtaaacccgtaaagggtacggtaaaccgtaacggttaaaccgtaaaaccggtaaggttacgggtcggtacccgtacggtaaccctacgtaccttacggttaccgttcccgttccttaccccg

SEQ ID NO: 76684 - DNA, 589 bp, Homo sapiens
  misc_feature: GYAE6OF01B96LI.8.34.D01.1.454.CMB.1.raw
  modified_base (210)..(210): a, c, t, g, unknown or other
  misc_feature (210)..(210): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
  modified_base (475)..(475): a, c, t, g, unknown or other
  misc_feature (475)..(475): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaancgcccaccctctcctgcagggccagtcagatggtgctcttcgagctagtaccaacacaaccgtggccaggcctccacggcccctnatctatggngacntaccaacgngggcccacgtcggcactccccgagccgtaggttacaggtggcgtaggtggggtaagtcgggacacggtacttcaccttcacacctatcatcacgtccgtagggacnctaagaagtnttagttgacttagttttactctagtacaacgtactacgacgnggtccggtcccggtccggggcccttacggttcccggccgtacggggaacgtagggttcgacgtaacgtcgaaaacgtagtcggtgtcgcgacctctatccgttcttctcgtccg

SEQ ID NO: 76685 - DNA, 697 bp, Homo sapiens
  misc_feature: GYAE6OF01D2LXF.8.34.D01.1.454.CMB.1.raw
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
  modified_base (320)..(320): a, c, t, g, unknown or other
  misc_feature (320)..(320): n is a, c, g, or t
  modified_base (568)..(568): a, c, t, g, unknown or other
  misc_feature (568)..(568): n is a, c, g, or t
  modified_base (628)..(628): a, c, t, g, unknown or other
  misc_feature (628)..(628): n is a, c, g, or t
  modified_base (638)..(638): a, c, t, g, unknown or other
  misc_feature (638)..(638): n is a, c, g, or t
  modified_base (691)..(691): a, c, t, g, unknown or other
  misc_feature (691)..(691): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccaccggagagattgtcgttgacacaatctccagcctaccctgtcttcgtctccgagggaanacgcccaccctctccngcgacggccagcagaacgtgttcggccgaccttacgtactccgtaggtaaccaacgaacgaaaccgtggaccaacggcctcccgacggcccctanactctagtggtacgacacgtaccaacgacgggaccacgtgacctactcccgagaccccgtaggttcgaggtcggtaaccgtgggtacgggtacggtcgggaaacgacgttaccgttacaccgtttcaccaaccgttactacctagttccgaaccgtccggtacggggtactaccggttaggaggttacgtttggtcgttacggtttaattttgtacgtacttaaccgaacgttcgtacggttaccggngttaccggggtcccgggtaccggggtccctttacggttcccgggacccggtacgggtaanaaccgggttnaacgttacaacgtaacgtaggttgcgtacgtcacgtctactgttctaccgttntacccg

SEQ ID NO: 76686 - DNA, 967 bp, Homo sapiens
  misc_feature: GYAE6OF01DBJQ8.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgacaacgtggtggacgtcgtgggggagcggtggtccagccgtgggacgtcacagacgactctcgtgtcgcacgccttcgttgggttacctaccgttcaacggttaaaccgtacgggactaagttcggacctaacggtccggggttaccccgaccgtaaacgtccttacccggaagggacccggtaaaggggtggttttacggggaacgggtttcgggggttacggtaccgtttagggttttaccgttttaccgaaggtttccggttaggggtaacggggtaccttaacgggtttcggtttaacctaaaagggttttcggggttaacttcggggaccgttaaacgggtaccgtttacccgggttaagggaaacccgggggtcccgttaacgtttaccccgaacccgttaacgttaccccgtacccggtaaaggtaaccggtaaacccgttaaacggtttaccccggaaaacgggtaaacccgtaaaccgttaaacggtttacgggttttaaacgtttacggggtaaccgtaccgttaacgggaaaacccgttacggtaaaccccgtttaaacggggttaccctaacggggtaaccgggtaacccgggtaccgggttaaaccggttaaaccgtttaaccggtaaacgggttacgggtaaaaccggggtaacgggggtaaacgggggtaacccgtacggggtaaccgggtaaaccgttacccggtaaacggtttacccgttaccggttttaacgggaccgggttccgggtaacccgggggg

SEQ ID NO: 76687 - DNA, 697 bp, Homo sapiens
  misc_feature: GYAE6OF01AEGJE.8.34.D01.1.454.CMB.1.raw
  modified_base (303)..(303): a, c, t, g, unknown or other
  misc_feature (303)..(303): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttctttaagaggtgtccagtgtcaagtgcaacgtggtggagtcggtgggggagcgtggtccagccgtggggaggtcacgagagactcgtcgtggtcgcacgtccgttcgtcgggttccaacctttgaagttaaagtccggntagtcgcctaggtcgggtcccgaccgtaagccctaccgagggacgaagggtgtgggaggtgggtcggcttaggtttgtttcagtcgtaggacggtctaggtgttacaagttggtaacttgaccgtagtacccgtacggtagggacggtacgtacttaccgacctagtacctacgaagacgtaactaacgttaccgaaggtaacaagtagtagttagttgatacgtagaactacgtactaacgtcgtaggacggtaacggacggtacgtaacgtacgtacggtaaccggtaacggggaaacggggtacggggaaaccgtcggggtaccgggtaacgtttaaccggtaacggttaccgtttaccggttacgggtacggttccgggttacccggggg

SEQ ID NO: 76688 - DNA, 748 bp, Homo sapiens
  misc_feature: GYAE6OF01B56QR.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttacttttaagaggtgtccagtgtcaagtgcaacgtggtggagtcgtgggggaggcgtggtccagccgtgggaggtcaacgagagactctcgtgtgcagtcctcgtggttccaccttcaagtaacctacggcagtgcctacgtcgggtccgccaacggcctaccgagggacgaagggtagtttggggaggttggggtggtacgttaggttttcgtttccagttccggtaggtacggggtctaaggtttgttaacgtaaagttcgggtaatggtacgacgtacgtcccggtaaggaacgggtcccgtaacttccgaccgtacgtccttaccgaagaacgaactaacgttacccgaaacgtaaacgaaactaaagttcggttaagtttacggaagtacctaacggaaaccgacgtaccgttaaccggtacccgtagggaacggtaaccgtaccgggtacgttaacgtaaccgttaacgtaacgggtaacgggaaacgggggaaacggggaacccggaagggtacccggggtaacgttaccgtaacggttaccttaacccggtttcggacccggttaccgggtacggggg

SEQ ID NO: 76689 - DNA, 938 bp, Homo sapiens
  misc_feature: GYAE6OF01EUCHL.8.34.D01.1.454.CMB.1.raw
  modified_base (208)..(208): a, c, t, g, unknown or other
  misc_feature (208)..(208): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgagggaaancgcccaccctctcctgccgagggccagtcaagaattggttcggccgtccttacgtactccgtacggtaaccaaacgaacggtaaacccgtcgggacccgaacgggtaccctaccccgaaccgggtcccccccttacgtaacttaccgttaacgttcgggtacggtaccctaaccgttaccccgaaaacggtaccgggggacccctaaccggttaccgggacctaacccgttccccccgaaggtaccccggttaacggggtttaccaaggggttcggaccggtaaggggttacgggggttaaggtaacggggtaccgtaaacggtaccctttaccgtaacccgtttacccgtaccctaaaccctaattacccgtaacgttacccgaacggtccccggtttaaggggaccgtacccggttaggggtaaaacgggttcgttttcggtttacggaacttttaacggttttttaaaccgttacgttaccggttaacctaaaacgttccggtttacccgggtaaaccgtacggggtttcccggtaccccccgggggttcccggggtacccgttttacccgggtttccccgggtacccgggttaacggggaaacccttaaaaggggttccggttaaacttaaaccccgtaaacggtaaaaccgttagggttccggtaacgggtcccttacgggaaacccaccgttacttaccggtaccgtttccttccgttaacccg

SEQ ID NO: 76690 - DNA, 560 bp, Homo sapiens
  misc_feature: GYAE6OF01DBTSB.8.34.D01.1.454.CMB.1.raw
  modified_base (208)..(208): a, c, t, g, unknown or other
  misc_feature (208)..(208): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccaggggaaangccaccctctcctagcagggccagtcagaatgttggcgctagtatcctggtaccacagaacctggccaggcctccaggccccctnactctatgggtncatccaacgagggccactggcatcccagcctaggttcagtcggcagtgggtatgggacagcttcacttcgcaccatcatcacgcctggagcctgacggtatgtgctagtttacttacgtgtacaacagttaccgtaccgagtcgggacccgttccgggggtccttaccgtttccggcccgttagggaacctaaggttggaactagtaccgaaacgtagtcggtcggctcgcctaactactcgtcgttctctaccg

SEQ ID NO: 76691 - DNA, 845 bp, Homo sapiens
  misc_feature: GYAE6OF01AY0F9.8.34.D01.1.454.CMB.1.raw
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccaccggagagattgtgttgacacaatctccagccacctgtcttcgtctccgaggggaaancgccacctctctgcagggccagtcagaactggttggcnccgtacgtactccgtggtaaccaacgaacggaaacctcgggaccacgggcctacccgacggtccccctcgtaacgttcctaagttcgggtacgactaaccgtacccaaaacggtacggggtccctaacggtcgggacctaacgttacccccgaacggtaccccgtaagggtttaccgaacggggtttcggaaccgttaagggggttcgggggttaaacgtacggggggtaaacctacggggtttaaaccctttaccggtaacccttacccggttaccaaacccgttaagttaccctaaacgtacccgtacggtacccgtagggacgtacccgttagggaagtacggttggtttaccgtacgttaacgttttaacttacgttacgtaaccgaaacgttacgttaccggtaaccggtacgggttaccgggtccccgggttacccggggggtacccttaccgggtttcccgggtaaccccggttaggggtaaacccgtaacgggttcggtaaacgttaacgtaaaccggtaaaccggtacgttacgggtacgtaccgtaggacccctaaaccggtacttaccgtacgttcctacgtaccccg

SEQ ID NO: 76692 - DNA, 748 bp, Homo sapiens
  misc_feature: GYAE6OF01AT3ZE.8.34.D01.1.454.CMB.1.raw
  modified_base (275)..(275): a, c, t, g, unknown or other
  misc_feature (275)..(275): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggtttcctcgttgctctttaagaggtgtccagtgtcaagtgcaactggtggagtcgtgggggagcgtggtccagccgtggggaggtacacagacgactcgtcgtgtgcagcctcgtgggttccaccttnagtaactacggctagtcgcacgtcgggtcccaccaacggcctacccgaggacgaaggggtacttgggaggttggggtgacgtaggttttcgtttacacgttcgtggaaggggtctaaggttcgttacgaagttcggtagtacgacgaacgtaccgttaccggtagggtaacggccgtacgttaccgaccgtacgtacctacgtagaacgaactaacgttaccgaaggaaacccccaagtaaacgttacgttaagttacgggtaacgtacgtaacgtaacgtaaccggtaccgtaaacggttaccgtacggtaacggtaacggaccgggtacgttaacgtaaccgtaaccgttaacggtaaaccgggtaaacggggtaaccgggggtaaacccggtacgggtaccgggtaacgggttacccgtaacggttaaccgttacccggtttacggtaccgggtccgggtaacccggggg

SEQ ID NO: 76693 - DNA, 731 bp, Homo sapiens
  misc_feature: GYAE6OF01BDJGE.8.34.D01.1.454.CMB.1.raw
tcagctcgcgtgtccacgaccggtgctcgatttagatcgtctgtgttgggttgggggaagaggaagactgacggtcctgccacaggtggtgtttccattcggtgatcagcactgaacacagaggactcaccagtggagtttgggctgaacgttgggttttcctcgttgcttacttttaaggaggtgtccagtgtcaagtgacaagtggtggagtcggtgggggagtcgtggtccagccgtgggagtcacgagagctctcgtgtcgcagcctcgttcggttacctacctttcaagttaaccgcggctatcgccgtacgtcgggtcccaccgaagtccgtaccgaggacgaagggtcgtttagggagggttagggtcggacgttaggttttcgtttagtacgtttggagggtcgtagttcggttataagtggtatcgacgagtaccgtcggtaaggacgggtcctacttaccgaccgtacgttcccacgaagtaacgaaccgttaacgttaccgaaagtaacgactaaggttagtttagttacggacgtactaacggtaacgacgtaccgttaaggtaccgtaggaacggtccgaacgggtacttaacgtaccgtaacggttacggtaacggggaaacggggggtaaccgggtaacgtacgggtaccgggtaacgttaacccggaacggtttccgttaccggttaggacccggtgggtccggggtaaccccgg

SEQ ID NO: 76694 - DNA, 931 bp, Homo sapiens
  misc_feature: GYAE6OF01CWRHF.8.34.D01.1.454.CMB.1.raw
  modified_base (212)..(212): a, c, t, g, unknown or other
  misc_feature (212)..(212): n is a, c, g, or t
  modified_base (229)..(229): a, c, t, g, unknown or other
  misc_feature (229)..(229): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctccagtttcagataccgaccggagagattgtgttgacacaatctccacgccaccctgtcttcgtctccgaaggggaanacgcccaccctctccgngcgacgggtcagtacaagtaagtggttcggaccgaccttacgtactccgtacggtaccaaacgaacgtaaccgtcggaccacggccctacccgaccggtcccctacacgtcttaggtcgggtacaccgtaactacccgaaacggaccgggtacccaacggtccggaccttaaccgcccggtaacgacccggttacggttacgaacggggtcgtacggtaaggggttaggggttacggaggggtaaaccgtacggtaacccgtttccgtaaaccgttcccttaacccgaaacccgtacttaccggaaactttcccggaaccggttacccgggtacggtaccggtttaacggaaacggttaaaggtcgtttaagggtttaccgtaacgtttttaacgttttaactaaccggtttccgtaacgttaaaccgtttacgggaaccccgggtttttaacccgggtccgggtaaccccgggggtttcccccgggtaaccccgggggggttaaccctttaacccgggggtttcccggaaccccggggttacggggtaaacccggtaaggggttccgggtaaaaacgacccggttaaaccgggtaaaaaccgttcgggtttccgggtacgggtaaacctttcccggaaaccccggacctttttaaccggttcccgtttacgttaaaccccgttcggtttttaaaccccccg

SEQ ID NO: 76695 - DNA, 773 bp, Homo sapiens
  misc_feature: GYAE6OF01CX3YC.8.34.D01.1.454.CMB.1.raw
  modified_base (233)..(233): a, c, t, g, unknown or other
  misc_feature (233)..(233): n is a, c, g, or t
  modified_base (525)..(525): a, c, t, g, unknown or other
  misc_feature (525)..(525): n is a, c, g, or t
  modified_base (572)..(572): a, c, t, g, unknown or other
  misc_feature (572)..(572): n is a, c, g, or t
  modified_base (734)..(734): a, c, t, g, unknown or other
  misc_feature (734)..(734): n is a, c, g, or t
  modified_base (742)..(742): a, c, t, g, unknown or other
  misc_feature (742)..(742): n is a, c, g, or t
  modified_base (749)..(749): a, c, t, g, unknown or other
  misc_feature (749)..(749): n is a, c, g, or t
tcagctcgcgtgtccacgaccggtgctcgatttagatcgtctgtgttgggtttgggggagaactgctcagttaggacccagagggaaccatggaagccccagctcagcttctcttcctcctgcctactctggcctccctagtttcagactaccgaccggagagtattgtgttagacaactaattcctccacgccctaccctgttcctttcgtccgtaccggaaggggaaaacncgaccctaccctcctccgtgacgacgggcctaggtacaagtaagttggttacggcctaccgtacgttctccgtacggtaaccaacgaacgtaaccgtcggacccgacgggtccctacccgaccgtccccctactacgttctagtcggtacaccacgtaccgaaccgaccgggccctacggttccggacctaccgttacccgacgtaccggtacggttacgacggtcggacgtagggttcgggtacgacgggtactacggtaccttaccgaccgttactaacccgacttaccnctacgtacctaccggtcgtaaggtacccgtacgttagggtaacgttnttcggttacgttaacgtttagttttaacctacgtacgtaaccgtaacttacccggttacggaccggttacggtacccgggggtaccccggtaccggggttacccttacggttcccggaccggtaggaaaccggttaggtacgtactaagtaaccgaacgttntcggtacncgtaccnctactgtcctacttcctagtaccc

SEQ ID NO: 76696 - DNA, 879 bp, Homo sapiens
  misc_feature: GYAE6OF01D2D44.8.34.D01.1.454.CMB.1.raw
  modified_base (181)..(181): a, c, t, g, unknown or other
  misc_feature (181)..(181): n is a, c, g, or t
  modified_base (379)..(379): a, c, t, g, unknown or other
  misc_feature (379)..(379): n is a, c, g, or t
tcagctcgcgtgtccacgaccggtgctcgatttagatcgtctgtgttgggtttggggggaagaggaagactgacggtcctgccacaggtggtgtttccattcggtgatcagcactgaacacagaggactcaccatggagtttgggctgaacttgggttttcctcgttgcttcttttaaggnggtcgtccagtgtcaagtgacaacgtgggtggacgtcggtggggggagtcggtggtccagccgtggggagtcaacgagagacttcgtcgtagtgacctacggtccttcgttcgggttacctacccgtttacgaagttaaccgtacggctagtcgcgtacgtcgggtcccgacaagccgtacgacgggacggaagggtnttgggacggttggggtcgtacgttaggttttgttacaagttccgtagggtagggtcgttaggttacgttacgtaaggttggttaactcggtacgtaacggttacccgttacccggggtaaggaaccgggggtacccttaacgtttaccccgaaccttaaccgttaccccgttaccgaaaacggtaaccggtaaccgttaaccgtaacccgggtaaaccgggtaaacccttaacgtaaaggttttaccggtttaagtttaacgggaacgttaccgttaaacggaacgtaacccgttaccggttaacggttacccgttaacgggaaccggtaacggtaccgggttaacgttaaaccgttaccggttaacggtaaccggggtaaacggggaacgggggtaaaccggggtaaccgtaaggggtacccgggttaaaggtttaacccgtaaacggtttacccgtttacggtttacgggaacccgggttcggggtaaaccccggggg

SEQ ID NO: 76697 - DNA, 706 bp, Homo sapiens
  misc_feature: GYAE6OF01C7LVB.8.34.D01.1.454.CMB.1.raw
  modified_base (250)..(250): a, c, t, g, unknown or other
  misc_feature (250)..(250): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcacatggagttgggctgacttgggttttcctcgttgcttcttttaagaggtgtccagtgtcaagtgcaacgtggtggagtcgtgggggagcgtggtccagccgtgggagtcacgagagactctcgtgngcagccttcgtggttacctaccttcgaacgtaactacggactagtcgtacgtcgggtccgacaacgcctaccgaggccgaaggggtattgggtaggtggggtggtacgttaggtttgtttaccagtcgtaggacgggtctaggttcggttactaaggttggtaatgacgtaggtaccgtccggtaggaacggtccgtattaccacctacttccgtaccgaagtaacgaactaacgttaaccgaacggtaaacctaacgtaacttagttagtttacggagtacctaacgaacgtacgtaaccgtaacgtaccgtacggacggtaaccgtacgggtacttaacgtacgttaacggtaggtaaccgggaaacggggaacgggggtaagacgggtacgggtaccgttaccgtaacggttacccgttacgttaccggtacggtccgggtcgggtaccccgg

SEQ ID NO: 76698 - DNA, 699 bp, Homo sapiens
  misc_feature: GYAE6OF01EM8NP.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaagacgcccaccctctcctgcgagggccagtcagatgttggcgcctacgtactcctggtaccaacacgaaacctggccaggcctcccgacggccccctcatcctagtggtcgtaccacgtccgaacgacgggtacccacgtcggacaccgttccccgacgtcccgtaaggtttccgaggttcggaccgtaaggggttagggttaacggtcggggaacctaacggtacctttaccaaccctttcctaccgaaaccctataccctaagttcccgaaccgtcccgttgggaaccgtcccgttagggaggtattgggttacaccgtttagttttacttcgttacgtacctaaagtccgttaccggtaacgtcggtcggtaccccggtcccggggtccttaccggtttcccggccgttacggaaccgtaaggtcgggtatacgttaccgaaacgtagtggtcgacgtacgcctaaccttatccttgtcttcgtacccg

SEQ ID NO: 76699 - DNA, 887 bp, Homo sapiens
  misc_feature: GYAE6OF01B08IZ.8.34.D01.1.454.CMB.1.raw
  modified_base (440)..(440): a, c, t, g, unknown or other
  misc_feature (440)..(440): n is a, c, g, or t
  modified_base (498)..(498): a, c, t, g, unknown or other
  misc_feature (498)..(498): n is a, c, g, or t
tcagctcgcgtgtccacgaccggtgctcgatttagatcgtctgtgttgggtctgggagaggagccagcactagaagtcggcggtgtttccattcggtgatcagcactgaacacagaggactcaccatggagtttgggctgtaacgttcgggttttcctcgttgcttacgttttaagaggtgtccagtcgtcaagtcgacaacgtgggtggagtcggtgggggagtcggtggtccaggccgtgggaggtcacgaggacgctcgtcggtgtcggactcgtccgttcgttcgggtttaaccctacccgtttagaaacgtaaccgttaccggactaagttggacctaccggtcgggggtaccccacgtaaccggcctaccgacgggtaccgaaagggtaggtttacgggacgggttggggtagtcgttaggttttggtttaccnggtttaccggtggaacgggtacgtaaggttcggtttaaccaaagggtttgggttaacngggtaaccgtacgttaaccggtcccgggtaaagggtacgggtacccgttaacgttaccgtaacccgtacttacccggttaaccgaaacggtaacggtaaaccctaaacgttaacccggaaaacggtaaaccggtaaactaaacgggtttacgtttaacgggttaaccggtaagttaaccggtaacgtaaacggtaacccgtaaccccggttaaggttccccgtaaagggacgggtaaaccggtacgggtacgttaacgtaacggtaaccgttaaggggaaccggggaaagggtaaaccgggggaaccggtacggaccggggttaacgttaaccccggaacggtttaacgttaccggtttaccggtaaaccggtccggggttaaccgggg

SEQ ID NO: 76700 - DNA, 774 bp, Homo sapiens
  misc_feature: GYAE6OF01AK98F.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgacaacgtggtggagttcgtgggggagcggtggtccagccgtagggacggtcacgagagacctcgtcgtgtgcacgtccctcgttcgggttcctaccttacgaacggttaaccgtacggctatcggacctaccggttcgggtaccccgaccgaacggtcccttacccggaaggggaccggtaaaggggtagtttggggaacgggttcgggggtacgtacgttacggttttgtttaccgacgtttacggtagggacgggtacgttaaggttcgttacgtaaaggttggttaactcggtacgtaacggtacccgttacccgggtaaggaaccggggttcctactttaccgacccgtagttccgtaccgaaggtacgtaactaacgttaccgaagtaacctaataagttcgttaagtacggatacgtaacgaacctacgtaccttacggtacgtacgggacgtaaccggacgggtactaacgtacgtacggtaacgggaacgggaaacgggggtacggaaccgtgggtaacggtaccgttacgtaaccggtttaccgttaccggttacggtccgggtcggtaacggg

SEQ ID NO: 76701 - DNA, 738 bp, Homo sapiens
  misc_feature: GYAE6OF01DUOYG.8.34.D01.1.454.CMB.1.raw
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (289)..(289): a, c, t, g, unknown or other
  misc_feature (289)..(289): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtccttcgtctccgagggaagacgccaccctctcctgcagggccagtcagaatgtggcgctacgtntcngtacacagaaccngccaggctaccaggcccctnatctagtggtacgcactaccaacgacgggcccacgtcggacacgtccccgacgtaccgacggttcacggtggcctaggtgggtataggggacacggtactttcgacgttccctacaacctacgtactacgtacgtacgtacccgtacgggtaccgacccggtacggtacggtaacgtttcggttacgtacgtttaacgttttaacgtttaaccgttacgttaaccgttaaaccgtcgttaaaaaaaccgtccggtaacggttccgggtaccccggttacccgggggtacccgttaccggtttccccggtacccggtaccgggtaaacccggtaacggttacgggtaaccgttaacgtaacccgtaaaccgggtaacgtaccgggttacggtaccggttacgaccccgtaacctaaccgttaccgttaccggttccgtttcgttaacccg

SEQ ID NO: 76702 - DNA, 869 bp, Homo sapiens
  misc_feature: GYAE6OF01BGV6O.8.34.D01.1.454.CMB.1.raw
  modified_base (793)..(793): a, c, t, g, unknown or other
  misc_feature (793)..(793): n is a, c, g, or t
  modified_base (805)..(805): a, c, t, g, unknown or other
  misc_feature (805)..(805): n is a, c, g, or t
tcagctcgcgtgtccacgaccggtgctcgatttagatcgtctgtgttgggtttgggggaggaactgctcagttaggacccagagggaaccatggaacgccccagctcagcttctcttcctcctgctactctggcctcctagtttcagactaccgacggagagtattggtgttgacactaatcctaccacgccctacccttgttccttccgtccgtaccggaaggggaaacgccgaccctacccgttcctccgtaggccggaacgggccctaggtaccgtaaaggtacttcgggttcggacccgtccgttaaccgtaccttccggtaacggaacccaaacgtaaccggtaaaccgtcggaccgtacgggccctacccgacccggtcccctacgtacttacgtaacggttggtaccggtacctaccgtaaccccggaaaacggccggggtaccctacggtaccggacttacccgccccgagtacccggtaaggttaccgcggggtaacgtcggtacggggttggtaacggtgggaaccgtacgtctaccgttactccctacgtactataccataccggtccgtccgtagggactaccgggtagtaacggttcgttaagttccgtaacttttacgttcgtttaacgcttaaccgtacgtttacggttccgggtaacggcgggttcccggggttaccccgggtccgggttacccttacggggtttccccggaccggtaacgggttaaacccggtaaggttacttaaccggtaaaccgttaacggtaaaccgggttanccggggttaacncccgttaacggaacccttaacggtcctttacgtttacccgtttaaccgttcccgtttaccccgg

SEQ ID NO: 76703 - DNA, 1015 bp, Homo sapiens
  misc_feature: GYAE6OF01D6FW9.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcacatggagtttgggctgaacttgggttttcctcgttgcttacttttaaggagttgtccagtgtacaagtgacaacgtggtggagtcgtgggggagcgtcggtccagtccgtgggagtcagagacgacctctcgtagtgcacggtcccttcggttcggttccctaacctttcgaacgttaaccgtaccgggtactagtcggaccctacggttcccggggtaccccgtaaccgtaaaggtccccgttaaccggaacggggtaaccgggtaaaaggggggttcgttttaaggggggaacgggttttcggggggtacggttacccggttaaggttttttaccgggtttaacccaggtttaccggggttaggggaaccggggttaccgtaaagggttttccggttaaacggtaaacggttttacgggtaacgtttccgggtacccgttaaccggggtaaccccgggttacccggggtaacggggtaaaccccgggggttaccgttaaccgttaccccgaaaccgttaaccgttacccgtaaaccggtaaacggtaaaacccggtaacccgttaaaccccgtaaacccgggtaaaccgaaaaccgttaaaccgtaaacgttttcggtttaaaccggttttccggggaaacccttaaggtaaacccgtaaccggttaaccggttaacgggtcccgtaaagggtaaccggttaaccgttaacgggtttataacggtttaaaccgttaccgggtaaaggggttaaaccggggaaacgggggggaaccggggtaacgacccggggttaaacggggttaacccgttaacccgggttaaaccgtttccgtttaaccccggggtttacggtaccgggttccggggtaccggggtaacccccgggg

SEQ ID NO: 76704 - DNA, 599 bp, Homo sapiens
  misc_feature: GYAE6OF01CZB6E.8.34.D01.1.454.CMB.1.raw
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (280)..(281): a, c, t, g, unknown or other
  misc_feature (280)..(281): n is a, c, g, or t
  modified_base (287)..(287): a, c, t, g, unknown or other
  misc_feature (287)..(287): n is a, c, g, or t
  modified_base (289)..(290): a, c, t, g, unknown or other
  misc_feature (289)..(290): n is a, c, g, or t
  modified_base (295)..(295): a, c, t, g, unknown or other
  misc_feature (295)..(295): n is a, c, g, or t
  modified_base (298)..(299): a, c, t, g, unknown or other
  misc_feature (298)..(299): n is a, c, g, or t
  modified_base (302)..(303): a, c, t, g, unknown or other
  misc_feature (302)..(303): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (316)..(317): a, c, t, g, unknown or other
  misc_feature (316)..(317): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (332)..(332): a, c, t, g, unknown or other
  misc_feature (332)..(332): n is a, c, g, or t
  modified_base (341)..(341): a, c, t, g, unknown or other
  misc_feature (341)..(341): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagactaccgaccggagagtattgtgttgacacaatctccagccacctgtcttcgtctccgagggaaancgcccaccctctcctgcaggccagtcagatgtgcnctagtntcngtacacanacngcngcnccngcctnntcatgncnncacgngcnngcnnccngcngtngtgnngtgngtgananctcnctctcacancacgtcacgtccgagacgacgtggtacggtattggtactcgtttaagtttaacgttacgtacgtactaacgtaacgttacccggtaacggtaacggtcccgggtaccccgggttcccgggggtccctttaccgggtttccccgggacccggtagggtaaacccgtaagggtagtaaccgtaacgtaaccgtaaaacggtagtcccggtaggcccttacgccgtaacctacgtttacgttcgttccgttccgtaacccg

SEQ ID NO: 76705 - DNA, 820 bp, Homo sapiens
  misc_feature: GYAE6OF01C4K6L.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccagtggtagttggctagtaacgttgggttttcctcgttgtcttacgttttaaggcggtcgtccgagttgtacaaggtcgactaacggttgggtaggtacggtcggggtggggggaggtccggtcggtacccgaggtccggtaggggacggtcaacgaggacgtaccgttcgtacggtgtacgccgtacggtcccgttcggttcggttaccctaccgttacgtaaacggtaaccgtacggctacgtcgtaccgtacggtccgggtacccaaccgacgtcccgtacggaaggacggtaagggtagttcgggagggttgggtacgtagtttcggtttacgttacgagttccgggtaggacggttacgttaggttacgtttaagtaaggttaggtactacggtacggtaaccggtacggttacgggtaacggaccgggttcctaacgttaacccgacctccgttaaccgacgtaaaggtacctaacgtaacgtaccgaaagtaacctacgttaggttcgtttaagtccggaatacgaaacggtactacgttacccgtacgttcggaaggtacggacccggtagtacttaaccggtgaaacgggacgggaacggggtaaacggggaaccggtagcggggttaaccgttaccgttaacgaccgtttacgtaggttaccgggccgggttccgggtaccgggg

SEQ ID NO: 76706 - DNA, 902 bp, Homo sapiens
  misc_feature: GYAE6OF01B0ZP7.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactccaccagtggtaggtttgggctagtaacgttgggtttttccctcggtttgtctttacgtttttaaaggaggttcgtacccaaggttcggtacctaaaggtcgaccgtaacgttggggtagggtaggttccgggtagggggggacggtccggtcgggttacccgacgggtccggttagggggacggttccgaacgaaggaacggtaccttcgttcggtggtacgcctacggtccgttcggttcggggtttacctaccgtttacgaacggttaaccgtaccgggctaagtcggaccgtaccggttcggggtcccgaaccaacggtcccgtaccggaagggacggaaacggggtagtttggggagggttggggttcgggtacgtttaggttttacgtttcgaagttccgggtagggacgggtaccgttaggttcgtttacgaaaggttggttagtacggacctaacggtaccgtttaccgggagggtaaccgggtacccttaacggtttaccaacccgtaccgttaccgtaaccggtaaggtaaccggtaaaccgttaaaccgttaacccggaaacgggtaaacctaaccgttaaggtttacggtttaacgttaacggacgtaaccgtaacggtaaaccgtaccgtaaccgttaaccgggtccgttacgggaaccgggtaccgagggtaaccttacgttaacgtaggtaacggaacgggaggggacgggaaccagggcggtaacgtaccgtacggtacttacggtcggtcgtcgggtaccggg

SEQ ID NO: 76707 - DNA, 850 bp, Homo sapiens
  misc_feature: GYAE6OF01CQ5QR.8.34.D01.1.454.CMB.1.raw
  modified_base (216)..(216): a, c, t, g, unknown or other
  misc_feature (216)..(216): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagactaccaccggagagattgtgttagacacaatctccagccacctgtcttcgtcctaccgaaggggaaaacncgcccaaccctcctccgtgccgagggccagttcgaagtaagtcggtttcggcgtacctaacggtactccgtaggtaacccaaacgaaacgtaacccgtggaaccgacggaccctacccgaccggtaccccctacgaacttccgttaagtgggtaccgacctaccgaaccgaaaccgaacgggacctaaccgtcggacctaacgtaccccgaacgtccgtaacggttctaacggtacggacgttaagggtacggggtaacgtaggggaaactacggttaacctttaccgacctttaccggacctaaacgtactaccgataccgtaacgcccgttagggaacctcgggtaagtaacggtacgtttacggttacgtaacgttttaaggttttaaccgttcgttaaacgttaccgtaaccgtaaccggtttacggtaaacccgggtaacgggttcccgggggtaccccggggttacccgggtccgttaacccggtttcccgggaacccgttacggggaaacctaaacgggttaacggaacgttaaacgtaacccggaaaaacggttaccggtaggttaccggtccgtacgtacccgtaaacttacgtttaccgaccgttttccgtaacgtttaccccg

SEQ ID NO: 76708 - DNA, 878 bp, Homo sapiens
  misc_feature: GYAE6OF01CVPOX.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccagtggtaggtttgggcttagtaacttgggtttttcctcgtttgtcttacgttttaaggaggttcgtccagtgtacaagtgactaacgtgggtggtaggtcggtgggggagtcggtcggtccaggccgtggggacgtcaacgtagagacttcgtcgtagtgctacgccgttcgtcggttacctaccttacgtaaacgtaaaccgtacgactagtcgaccgacggttccggacccacgaacgtcctaccggaggacgtaagggtcgttgggaggtgggtgacgtttagttcgtttacagttcggtaggacgggtacttaggttgttaactaaggttggttaacgtcgtacgtaacgggttaacccgttaccgggtaagggaaccggtacccgttaatacccgtaaccgttcttacccgtaacggaacgtaacttaaaccgtacttaacccggaagttaaaccgtaaagtttaacggttagtttaacgggtttacgggtaaacgtaccgttaaacggtaaaccgtaacccgtttaaccggttaaaccgtccgggtaaaacgggacggttaaacccggtacgggtaactttaaaccgtaaccggtttacggaaaacggggtaaaccggggtaaaaaggggggtacccgggtaaacccggtaacgggggtaaacgggttacccgttaaaacccgttacgggttttacccgtttacccgggttaaggttaccccgggttacggggtaacccccggggg

SEQ ID NO: 76709 - DNA, 826 bp, Homo sapiens
  misc_feature: GYAE6OF01E5J1V.8.34.D01.1.454.CMB.1.raw
  modified_base (176)..(176): a, c, t, g, unknown or other
  misc_feature (176)..(176): n is a, c, g, or t
  modified_base (181)..(181): a, c, t, g, unknown or other
  misc_feature (181)..(181): n is a, c, g, or t
  modified_base (317)..(317): a, c, t, g, unknown or other
  misc_feature (317)..(317): n is a, c, g, or t
  modified_base (342)..(342): a, c, t, g, unknown or other
  misc_feature (342)..(342): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcacagtggtagtttggctgtaacttcgggttttcctcgttgcttacgtttaagnggttntccagtgtacaagtcgactacgtggtcggtagtcggtggggagcggtcgccaggccggtagggacgtcacgagactacttcgtcggtgtcgctacggtccttggtcggttacctaccttacgaacgttaaccgcgntactcggacgtacggtccggacccncgaacgctaccggaggtacggtaaggtcgttaggagggttcgggtcggtagttgtttacgttacgtacgtcggtacgggtcggtaacttcggttacgtaacgttaggtgtaacgtcgaccgtacgtccggtggaacgggtacgttacctaacgtccctaacgtctacccgacgtaagtaactacgtaaacgttccgaaacgtaaacttacgaagtttagtaccgttacggtaacacgtaactaaccggtaaccgttacgtaaccggttacggtaaccggggattaacccgggtaaggttaaacccgttccggtttaaaccggtaacgggtaaaccggggtaaaacgggggtaaccggggggtaaccggggttaaaccgggtcgggtttaaaccccgggttaaaccggttaacgtttaacccggggttaccccgttttaccgggtttaaccgggtaaacccgggtcccgggtttaaacccggggg

SEQ ID NO: 76710 - DNA, 828 bp, Homo sapiens
  misc_feature: GYAE6OF01DT865.8.34.D01.1.454.CMB.1.raw
  modified_base (247)..(247): a, c, t, g, unknown or other
  misc_feature (247)..(247): n is a, c, g, or t
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgacaacgtgggtggagtcgtggggggagcgtcggtccaggcctggggagtcacaganactctcgtgtgcacgcctcgtgggttccacccttcaagtaacctacggnatcgcacgtcggggtcccnccaacgcctaccgagggacgaaggggtacttgggaggttggggtggtacgtagttttgtttcgattcgtggagggtctaggttcgttacgaagttgggttatcgtacgtacggtaccgtcccggttaagggaaaccggggtcccgtaactttacccgaacccgtaacttacccgtacccgtaaacggaaccgtaaacgtaaacctttaccccgaaagggtaaaccctaaaccgtaaagtttacggtttaaggtttacgggtaacgttaccggtaacggaaacgtaccgtaaccccggtttaaacggttcccgtaaggaacgggtaaccgtaccgggggtaaccttaacggtaaccgttaaaccggttaaggtaaaccggggaaacggggggtaaaccgggggggtaaacccgggtaacggggaacccggggttaacggttaaacccgttaaacggtttaacccggtttacccggttttaacgggtacccgggtttccgggtaaccccgggggg

SEQ ID NO: 76711 - DNA, 713 bp, Homo sapiens
  misc_feature: GYAE6OF01DELBT.8.34.D01.1.454.CMB.1.raw
  modified_base (443)..(443): a, c, t, g, unknown or other
  misc_feature (443)..(443): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccagtggagtttggctgtaacttgggttttcctcgttgtcttacgttttaagaggttgtccagttcgtacaaggtcgactaacgtgggtggagttcggtgggggagcgtagtccgagccggtagggagtacacgaggacgtacctccgttccgtggtcgccacgtcccgttcgttacggttactaccgttcgaagtacgcgtacggcagtcgactacggtcggtacccaacctaacctccgaaggacgaagggttgtagggcgtagggtgtcgttagttgtttccagtcgtaggaggtctagtgttacaggttggtacngtcgtaggaccggtcgaggtaccgggtactactccaaccgtactccgtacgaaacgtacgaacctaccgtacgaacgaactaacgttagttacgtttacgttacggaacctagaaacctcgtaacttaccgtccgtaaggacggaccgttaaggtcgtaaagtaccgttaaggacgggtaaacgggaacgggggaaacgggtcccggaaggtacccgggtaacgttacaaccggtttccttacggtagcggttacgggccgggtaacccg

SEQ ID NO: 76712 - DNA, 858 bp, Homo sapiens
  misc_feature: GYAE6OF01DGHS0.8.34.D01.1.454.CMB.1.raw
  modified_base (472)..(472): a, c, t, g, unknown or other
  misc_feature (472)..(472): n is a, c, g, or t
  modified_base (524)..(524): a, c, t, g, unknown or other
  misc_feature (524)..(524): n is a, c, g, or t
tcagctcgcgtgtccacgaccggtgctcgatttagatcgtctgtgttgggtcgtgggagaggagcccagcactagaagtcggcggtgtttccattcggtgatcagcactgaaccacaggagactcaccagtggtagtttgggctgaacgttgggttttcctgttgcttacgttttaagaggtcgtcctaggtgtacaagtgacaacgtgggtggagtcgtgggggagtcgtcgtccagccgtagggagtcacgagactactcgtcggtgtcgctacgtccgtcgttacgggtacctacccgttacgaaacggttaacccgtacggactacgtcgtaccgtaacccggttccggggttaccccgaacccgtaaacggtcccgttaacccgggaagggggtacccggtaaaaggggtttacgtttcgggggaacgggttgggggtacgtaccgtttaggttttcggtttaaccncgttacggagggtaacggggtctaaggtttggttaactaaaggttgggtaanccggtacgtaaacggtcccgtttaccggggacggtaaaccggggtccctaactttaccccgacccgttaacgttacccgtaaccgaagtaaccgaaacgttaaccgtacccgaaacggtaaacaccgttaagttggttaaggttacgacgtacgaacggtaaaccgtacgtaacccgttacggtccgaacggacggtaccgtacggttaccgtaacgttaccgtaacgtacgggtaacgggaaacgggtaccgggaaccggtacgggtaccggttacccgtaaaccgttaaccgttaccgttaccggtttaccgggcgttcggggtaacccggg

SEQ ID NO: 76713 - DNA, 771 bp, Homo sapiens
  misc_feature: GYAE6OF01CK7UZ.8.34.D01.1.454.CMB.1.raw
  modified_base (213)..(213): a, c, t, g, unknown or other
  misc_feature (213)..(213): n is a, c, g, or t
tcagctcgcgtgtccacgaccggtgctcgatttagatcgtctgtgttgggtttgggggaggaactgctcagttaggacccagagggaaccatggaagccccagctcagcttctcttcctctgctactctggcctccagtttcagactaccgacggagagtattgtgttgacacaatctccagccacctgtcttacgtctaccgaaggggaaancgcccaccctctcctgcacgggccagtcaagtaatggttcggcctacctacgtattcccgtaggtaacccaaacgaacggtaaaccgtcggaccgtacggacccttcccgaaccggcccccttacacttaccgtagttcggtacgtacctaacgtaaccgaaacggacgggacccctaaggtcgggtacctaccgtcccgaacggccgttaggttccgagtcggacgtagggtaggtagtcgggaacctagtaccttacactccacgtaaccctatactacgtcgacgtaccggttgaaccgtccgttaggaacggtttagttggttaacgagttttaacgttttacttacgtacgttaaccaaccgtacggttaaccggttacgggacggtttacccgggtaccccggggtcccgggggttacctttaccggggtttccccgggaccggttaacggtaaacccggtaacgggttacggaatttaaccggaaaccgtaacggtaaccgtggtaccgcgttaaccgctaacctagttcccgttcgttccttccgtaccg

SEQ ID NO: 76714 - DNA, 800 bp, Homo sapiens
  misc_feature: GYAE6OF01EFSZI.8.34.D01.1.454.CMB.1.raw
  modified_base (172)..(172): a, c, t, g, unknown or other
  misc_feature (172)..(172): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccctagtttcagataccacggagagattgtgttgacanaatcctccacgccacccttgtccttcgtcctaccgaaggggaaaagcgcccaacccttctcctggaccgaacggggccctaagtcgaagtaacgttggttcggaccgccgttaacgtttaacgtccccgttaagggttaaacccaaaacgtaacggtaaaaaccccgttcgggacccgtaaccgggtccctaaccccgaaccgggtaccccccttacgaattaccgttaagtcggtagacctaaccgtacccgaaacgacggggccccaggtaccgactactacccgagaccctaggttcaaggtcggacgtagggtggttagacgggtacagtacctcgaaccgtctaccactatacctagtaccaacgtccgtacggtagtccgtaggagtaacgttgtagacttttaacggtttacttagaccgttacaaactacggttaccgtaacggtacgggttccgtcccggacccgggggttacctaccggttttacccgggacccgttaccggggaaaccgttaaagggtccggttaaataaacccgtaaacggtaaaccgttaagtccggttacggtacctaacggtaccgaaacttacgtacgtttccggtatttcccgtaacccgg

SEQ ID NO: 76715 - DNA, 746 bp, Homo sapiens
  misc_feature: GYAE6OF01ALIIL.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaactgggttttcctcgttgcttcttttaagaggtgtccagtgtcaagtgcaactggtggagtcgtgggggagcgtagtccagccgtgggagtcacagagactctcctgtcgcagtcctcgtcgggttccaccttcgagttagcctacggcagtcgcacgtcgggtcccgaccaactccgaggacgaagggtagttgggaggttgggtggacgttagtttcgtttacagttcgtggacggtctaggttcgttacaagttggtactcggtcgtacgggaccgtccggtagggaaccgggtccgtacgttaccaccctacgtcccgtaccgaagtaccgaaccgtaaccgtaccgaacgggtaaacctaacgtaagtttacgttaacgtttaccggaaccgttacgaacgtaccgtaccgttaaccggttccgtaaggaaccggtacggtaaccgggttagttaaccgttaccgtaaccggttacgggtaaaccggggaacgggggtaaccgggggtaaccgacggggtacccgggttacgtttaaccccgtaacggtttacccttaccggtttacggaccggtttccggggtccggggtaaccccggg

SEQ ID NO: 76716 - DNA, 1021 bp, Homo sapiens
  misc_feature: GYAE6OF01DQGRW.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcacatggagtttgggctgaactggttttcctcgttgcttctttaagaggtgtccagtgtcaagtgacaactggtggagtcgtgggggagcgtggtccagccgtggggacgtcaacgagacgactcgtcggtgtcgcacgccttcgtgggttcctaccctttcgaacgttaaaccgtacggcctaagttcggaccgtaaccggttccgggggtaccccgaccccgtaaaacgggtcccgttacccggaacggggtacccggtaaagggggttaggttttagggggaacggggtttgggggttcgggtaccgtttaagggttttcgttttaccgtaacgttaccggttacggggtaacggggtacgtaacgggtttacggttttaacaaaggtttggggtaaacttcggggtaaccgaaacgggttacccgtttacccggggttaacgggaaaccgggggttacccgttaacgttttaaccccgaacccgttaacgttaccccggttaacccgtaaacggtaaaccgttaaacccgttaaaccgtttaaccccggtaaaacgggtaaacccttaaaccgttaaacggtttaacggtttaacggttttacgggtaacggttaccgttaacgggtaaaacccgtaaccgggttaacccgtttaaccgggttaacccgttaacgggaaccgggtaacccggtaaccggggttaacccgtttaaacgtaacccggtttaaacgggttaaccgggttaaaaccgggggtaaaacggggggtaaaccggggggaaacccgtaacgggggtaacccggggttaaccgtttaaaccccggtaacggttttaaccccggtttaccggttttaacccgggtaaccggttcccgggggttaaccccgggggg

SEQ ID NO: 76717 - DNA, 689 bp, Homo sapiens
  misc_feature: GYAE6OF01EJ20S.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccgaggggaaagacgcccaccctctcctgcgagggccagtcagagtcgttacccaccgagttacgccgtaggtaaccaacgaaccaaaccgtcggaccacggccctcccgacggcccctactacttctttgatcgactactaccatcgacgggccacgtcggacactcccgacgccgtaggttcgaggtcggacgagggttgggtcgtaggggacctaggtccttacaccgtctaccaccatcgagacacgtaccgtagacgtcgtagtaagtacgtttgtacttagttttacttacgttacgtaacctaactacgtaccggtaaccgtcggtaccgggtacccgggtcccgggggtccttaccggtttcccgggtaccccggttacgggaaaccctaaagttaggaacgtacgtaaactaaacggtaccttagggtacggtcgtaccggacctaccgtacttaccgttacgtttccttacgtcgttccccg

SEQ ID NO: 76718 - DNA, 862 bp, Homo sapiens
  misc_feature: GYAE6OF01BSATD.8.34.D01.1.454.CMB.1.raw
tcagctcgcgtgtccacgaccggtgctcgatttagatcgtctgtgttgggttgggggaagaggaagactgacggtcctgccacaggtggtgtttccattcggtgatcagcactgaacacagaggactcaccatggagtttggctgaacttgggttttcctcgttgcttacttttaagaggtgtccagtgtcaacgtgacaacgttggtggacgtcggtgggggacggcgtggtccagccgttggggacgtcacgagagactcgtcgtgtgctacgtccgttcgttcgggttccaacccgttcaaacggttaaaccgtacggacaggttacggcctaacggtcggggtccctaaccaacggtccctaccggaggaccgtaaaggggtacttgggggacggtcggggtacgacgtttaagttcgtttaccaggtccgttagggaaggtccgtaggtttaccgtaagtacgttggttaaacgtcgtaaacgtaccggtaccggttcggacgggaaccggttctaacgttccccgaacttacctaccgtacggtaacgaacgtaacccgtaaactttacccggaaaggtaacctaataacggtttaggtaacgttttacgggaataccgttaaggaaccgtaacggttacccgttaacgggtttaccccgaaagggtaccgggtaaccggtaaccgggttaaccgttaaacgttcccgttaaacggttaacggggtaaacgggaaacggggggtaaacgggggtaaaccccgtggggtaaaccgggttaccccggtttaaacgtaaaccgggtttacccgtttaccgggtttaaccgtaccgggttccggggttaaaccccggggg

SEQ ID NO: 76719 - DNA, 718 bp, Homo sapiens
  misc_feature: GYAE6OF01DVKD0.8.34.D01.1.454.CMB.1.raw
  modified_base (174)..(174): a, c, t, g, unknown or other
  misc_feature (174)..(174): n is a, c, g, or t
  modified_base (349)..(349): a, c, t, g, unknown or other
  misc_feature (349)..(349): n is a, c, g, or t
tcagctcgcgtgtccacgaccggtgctcgatttagatcgtctgtgttgggtctgggagaggagcccagcactagaagtcggcggtgtttccattcggtgatcagcactgaacacagagactcaccatggagtttgggctgaacttgggttttcctcgttgcttcgttttaaagnggtgtccagtgtcaagtgcaagtggtggagtcgtgggggagtcgtggtccagccgtgggaggtcaacgagacgacttcgtcgtggtgccaggccttcgtgggtttaccaccttacgagtaacctacggctagtgctacgtcgggtcccacgaagcctccgaaggtcgaaagggtnttggacggtggtaggcgtagttcgttcatcgtggaggtctaggttcgttagaagttgtaacgtcgcacgtaccgtccgtaaggaaccggtccgtaacttaccgaacctacgttccgtacccgtaaggaacgtaaacctaaacgtttacccgaaacgggtaaacaaacgttaagttaggttaacgtttaggaacgtaccgttagaaaccgtaccgtaaccgtttaacgttacccgtaggacggtaaccgggacgggtacttaaaccgtacgtacgtacggttaaacgggaaaggggtacggggaacgacgggtaaccggtacgttaccggtaacgttaccttaccggtttagccggttggtaacccgggg

SEQ ID NO: 76720 - DNA, 715 bp, Homo sapiens
  misc_feature: GYAE6OF01BRPPQ.8.34.D01.1.454.CMB.1.raw
  modified_base (206)..(206): a, c, t, g, unknown or other
  misc_feature (206)..(206): n is a, c, g, or t
  modified_base (436)..(436): a, c, t, g, unknown or other
  misc_feature (436)..(436): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaactgggttttcctgttgcttacttttaagaggtgtccagtgtcaagtgcaacgtggtggagtcgngggggaggcgtggtccaggccgtgggacgtcacgagagtacctctcggtgtgcgacgccttcgttgggttcctaaccttcgagtaaaccgtacggccaatcggctaccgtcgggtcccaccgaacgccctaccgacggaccgtaaggggtacttggggaggtggggtggtacgtagttttcggttactagtccgttaggacgggtctaggttgttacgtaagttggtaancgactacggtacctccggtagaacggggtcctaacgttccgaacctcgtccctacgtaagacgtaactaacgtacccgaggtaaaccctacgtaaagttcgttaacgtttgggtaacctagtaacgaactaccgtaaccgttacgtaccgtaacggtacggaccggtaccggtaactacgttaacgtacgtagggtacgggtaaacgggacgggtaacggacggtacgggtaacgttaccgtaaacgttaccgttacgtcggtacgtcgggtacccggg

SEQ ID NO: 76721 - DNA, 753 bp, Homo sapiens
  misc_feature: GYAE6OF01BJ6DC.8.34.D01.1.454.CMB.1.raw
  modified_base (173)..(173): a, c, t, g, unknown or other
  misc_feature (173)..(173): n is a, c, g, or t
  modified_base (327)..(327): a, c, t, g, unknown or other
  misc_feature (327)..(327): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagnggtgtccagtgtcaagtgcaactggtggagtcgtgggggagcgtggtccagcctgggaggtcacagagactctcgtgtgcagccttgtgggttccaccttcagtaactacggcatgctacgtcggtcccgacaacgcctccgaggcgaagggtnttgggagtgggtgctagtttgttcatcgtggaggtctaggttgttacaagttgggtatgacaggtaccgttcggtaggaacgggtccgtaacttccgaacccgtacttaccgtaccgaagaacggtaacctaaacgttacccgaagggtaaacctaacgtaaagtttcggttaagttttacgggaacgtactaacggaaaccgtaacggtacccgttaaccggttaccggtaacgggtaacgggtaccggaccggggtaccgttaacgttacccggttaaccgtaacgggtaaaccggggtaaacggggggtaacccggggggtaaacccggtaacggggtaccgggggtaacgtttaacccggtaaacggttaccccgtttacccggttttacgggtaacccgggttccgggttaacccgggggg

SEQ ID NO: 76722 - DNA, 966 bp, Homo sapiens
  misc_feature: GYAE6OF01D75UD.8.34.D01.1.454.CMB.1.raw
tcagctcgcgtgtccacgaccggtgctcgatttagatcgtctgtgttgggttgggggaggaactgctcagttaggacccagagggaaccatgggaacgccccagcctcagccttctccttcctcctgtcctactcgtggcctcctagtttcacgtactacccgaccggagtagtagtttggttcgttacgaacctaactaaacttccctacccgacgtcccctaccccgtttcggttccctttccggttaccgaaccggggtaaaggggggaaaaactcccggtacccccttaaccccttccgtcccggtgggacccggaacggggtaccctaggtaccgtaaggtaagttcggggttccgacccgttaccgttacgttaccgtcccggtaacggtaacccaaaccgtaaaccggtaacccggtcgggtaccgaccggttcccgaacccggccggtccccctataccgttacgtacggtcgtccgacctaacgacccgaacggaccggtcccaagtccgacctaacctcccggagtaccggttagtcgaggtcggacggtaggttacgggacgtacggtaacgtaaccgttcttaaccgtacgacccttacgaaccttcgtaacccgcgttaaccgggccgtacggttaccggaccgttacgggtaacggtacggtttaacggtcgtttacggaacgtttttaaccgtttaaggtttaccgaacgtaacccttaacgggtaaccgttacccgggtaacggggtcccggttaacccgggggttcccccgggttaccccggggttacggtttacccccgggttacccggggaacccgttacgggggtaaacccgtaagggtaccgttaaaccgttaacgttaaaacccggtaacggtaccgggttcggtccggaaccgttccgaaccgtaccggtttgttcccgttaacttaccggtccttaccccgg

SEQ ID NO: 76723 - DNA, 795 bp, Homo sapiens
  misc_feature: GYAE6OF01ELI0J.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagtattgtgttgacacaatctccagccaccctgtcttcgtcctaccgaaggggaagacgcccaccctctcctgacgacgggccagtacagaattggttggccgccttacgtactccgtaggtaaccaacgaacgaaaccgtcggacccgacgggtccctaccccgaccggtccccctacgtacttaccgtagtcgggtcgaccaccgtacccgaacggaccgggcccacggtcggacctacctccccgacggtaccgtacggttacgaggttcggacggtaagggtggggtacgtacgggacgtacggtaccttacaccctcgtaccacctatactacgtacgacgttaccgtaggaccgtaccggtaggtaggtacgttaggttcggtacgtttaagttttacgtacgttcgtaaccacgttacgttaccggtaacggtcgggtaccgggtccccgggtacccggggtaccctttaccgggttaccccgggacccgggttaaccgggaaacccgttaagggttaccggtaaacgttaaaccgaacccgggttaaaacggtacgggtttacggtcgggacccgttaccggaaccctacgttaaccgtttcgttaccgttaccgttacccgttaccccg

SEQ ID NO: 76724 - DNA, 922 bp, Homo sapiens
  misc_feature: GYAE6OF01EIFNU.8.34.D01.1.454.CMB.1.raw
tcagctcgcgtgtccacgaccggtgctcgatttagatcgtctgtgttgggtctgggagaggacgcccagcactagaagtcggcggtgtttccattcggtgatcagcactgaacacagaggactcaccagtggtaggttgggctggtaacgttcgggttttccttcgttcgtcctttacgttttaaggagggttcgtacctaggtcgtacgaaggtgacgtaacgtgggtgggtaggttcgggtggggggacggtcgggtacgtacccgaggtccggtaggggacggtcacgagagactcgtcgtgtcgctacgccgttcgttcgggttacctaccgtttacgaacggttaaacccgtcggcctagtacggtacccgtacgggtttccgggggtacccccaacggtaacgtccccgttaacccggggaagggtaaccgggtaaaggggttacggttacgggggtagggtttcgggggtgttaaccgtttagggttttccggttacgtacgttaccggggtaggggaacggggtactttacgggtttaccgttaaacgtaaggggttacggggtttaacgtcggtaaacccggtaccgggttaaacgtttacccggggttaaacggggaacccgggttaccttacgtaacccccggtaacttacgttaccggtaacgaacgggtaaacgtaaaccgttaacgtacccggaaacgttaaactaacgttacgtttagtttacggaggttaccagtaaacgtccgtaacgacgttaccgtaacggacggtacggaccgtaccgggtaattccggtaacgttcggtaacgggaaacggtacgggggaacgggttaccgacgggttacgtaaacgttcggtaaacccgtttcgtttaccggggtacgtaccggggtacggttcccgggg

SEQ ID NO: 76725 - DNA, 903 bp, Homo sapiens
  misc_feature: GYAE6OF01EG4SY.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctctgctactctggcctcccagtttcagactaccgaccggagagtatttgtgttgacactaatcctaccacgccctacccttcgttcctttccgtccgtaccggaaggggaaacgccgcccctaccctcctccgtgcgacgggtccagtcaagtagttcggttcggccgtaccgttacgtacttccgtaacggtaacccaacgaacggtaaaccgtcggacccgacggtaccctacccgaccggtccccctactacgttaccgttacggtcggtcgtacctaaccgtacccgaacggtaccgggaccctacgggtccggtaacctacccgtaccccgacggtaccgttaacgggttacccaggggtacggaccggttagggttacggggtacgtacggggaacctacggttacccttcgtaccttacccgtacctaacgtacttaccgtagtaccggtacgtacccggtagggtaacgtcccggttaaggaggtttacgttacgttaggtaacgttttacgttttaagttaccgtaccgttaaactaccgttacggtacccggttaaccgggtccggttaccccgggggtccccggtaccccgggggttacctttacccggggttccccgggtaacccggtaaccgggggtaaacctaagggtaaaccggttaaccctaaccggttaacccggtaaaaccggttcggttaaccgggttcgggaacccctacggtaaccccgtacgtttacctttcccggttaacgtttccttaacttacccccggg

SEQ ID NO: 76726 - DNA, 752 bp, Homo sapiens
  misc_feature: GYAE6OF01EKXG1.8.34.D01.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (305)..(305): a, c, t, g, unknown or other
  misc_feature (305)..(305): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttcgacacaatctccagccacctgtcttcgtctccgaggggaancgccaccctctcctgcgaggccagtcagatcgtgcncctagtactccgtaggtaaccaacacgaaacctggaccaggcctacccgacggtcccctnactcgtagtggtcgacacgtaccaacggacgggccacgtcggaccacgtcccgagtacccgtaggtacaggtcgcgtaggtcgggttacgcgggaactacggtaccttaccgaccgttactaccgtaacctacgtacctacgtaccgacggtcccggtagggaccgtccgttaggacggttagtttcggttacgtacgttttaacgttttacgtaccgttacggtaaccgtaactacggttacccggtaacggtggttacccggccccggggtttaacccggggtacctttacccggtttcccggggacccgttaaccggggtaacctaagggtttaccggaccttaaaccgttaacccggaaaaccggtttcgggttaacgtcgggttaccgacggtaacccctaccgttacgtttacccgttacgtttccgttaaccgtacccgg

SEQ ID NO: 76727 - DNA, 764 bp, Homo sapiens
  misc_feature: GYAE6OF01A25G0.8.34.D01.1.454.CMB.1.raw
  modified_base (213)..(213): a, c, t, g, unknown or other
  misc_feature (213)..(213): n is a, c, g, or t
tcagctcgcgtgtccacgaccggtgctcgatttagatcgtctgtgttggggtttgggggaggaactgctcagttaggacccagagggaaccatggaagccccagatcagcttctcttcctcctgctactctggcctcccagtttcagataccaccggagagattgtgttgacacaatctccagccaccctgtcttcgtctccgagggaaacgngccaccctctcctgcagggtccagtcagtaatggtcgcgacctacgtactccgtggtaaccaacacgaaaccgtcggccacggcctcccaaggccccctctactcttagtcggtcgtaccgtactacccaaaccgtacggggaccctacgttacgggacctacgtacccccgagtccccgtacgggtttacccgaggttcggggacctaagggttgggggtaaccgttggggaacctaaggtacctttaccgacctttaccttacacccgtaattaccacgttcgaccgtccggttacggacgtcccgttagaagggtctttaggtttaccgagtttagttttaacgttaaccgttcgtaaccgtaactaccgttcggtaaccggtacgtccgggttccccgggttaaccggggtccccttaaccggtttcccggacccggtaacgggtaacccgtaaaggtcggtaaaccgttaaccgaaacgtaaaccggtaactgggtaccggtctacgtaccctacccgtattaccgttcttcccgttcgtaacccc

SEQ ID NO: 76728 - DNA, 770 bp, Homo sapiens
  misc_feature: GYAE6OF01CLSR1.8.34.D01.1.454.CMB.1.raw
  modified_base (221)..(221): a, c, t, g, unknown or other
  misc_feature (221)..(221): n is a, c, g, or t
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (356)..(356): a, c, t, g, unknown or other
  misc_feature (356)..(356): n is a, c, g, or t
  modified_base (744)..(744): a, c, t, g, unknown or other
  misc_feature (744)..(744): n is a, c, g, or t
tcagctcgcgtgtccacgaccggtgctcgatttagatcgtctgtgttgggtttgggggagaactgctcagttaggacccagagggaaccatggaacgccccagctcagcttctcttcctcctgctactctggctcccagtttcagactaccgaccggagtagtattgtgttagacaacaatctaccacgcctaccctgtcttcgtctaccgagggaaagcncccaccctctccncgcgaggccagtcagtatgtcgcnctacgtntccgagtacaacgacgaaccgtcggaccacggcctcccgcggtccccctctactccttagtggtactacgactaccgaacgcggcctacgngccacgtcccacgaccgtacggttacgtaggtcggtacggagggttacgggttaacggtacgggaaaccgtaccggtaaccgtttacccgtaccgtttcccaaccgtaaccctaaacggtccttaaacctccggttaccgacccggttacgggaacccggttcggttaaccggtaagggtcgtttaaaggtcgtttacgtttaaccgggttttattaacggtaccgttaagtacgttaccgttaccggaccgggttcggaacccgggtttccccgggtacccgggtccccgtttaaaccggttccccgggtacccgtacgggtaaaccgacgttagggtacctacggtaaccggaacgttaccgtggtacccggttacgacgtaaccncgttcgacgtttctacgtcgtacccg

SEQ ID NO: 76729 - DNA, 1128 bp, Homo sapiens
  misc_feature: GYAE6OF01DH7JS.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttactttaagaggtgtccagtgtacaagtgacaacgtggtggagtcggtggggggacggcgtggtccgagccgtggggaggtcgaacaggacgtactccgtcggtgtcgctacgccttcggttgggttacctaccgtttcgaaacgttaaccgtacggctaagtcgtccgtacgttcgggggtcccgaccgaacggtcccgtaccggaacgggacggtaaaggggtacgttaggggagggttggggttcggacgttaacggtttcgttttaccgacgtttacggtacgggtacggggtacgtttaagggtttacggtttaccgtaaaagggtttcggttaacgttaccgggtacggaacgggttaccccggtttacccggggttaaacgggggaaaccggggttccccgttaaccgtttaacccgtaaaccccgtacgttttaccccgtaacccgtaaagggtaaacccggtaaaaccgttaaaaccggttaccccggaaaaacggggttaaaaccccgtaaacgtttaaaacggggttttaacggtttttaacgggggtttaaaccggtaaccggttaaccgggttttaacccgggaaaacccggtaaccggtttaaacccccggtttaaaacccgggtacccggtttaaccgggggggtaaaacccgggttaaccccgggtaaacccggggggtttaacgtttaaaaccccggtttaaaaccccgggttttacccggggttaaaacccgggggggtttaaaaccggggggaaaaccggggggggggttaaaaaccccggggggggttaaccccggtaaaccggggggggtaaaccccggggggtttaaacccggttttaaacccccgggttaaaacggggttttaaccccccgttttaccccggggttttaaaccgggggtacccggggtttttaacccccgggggggttaacccccggggggg

SEQ ID NO: 76730 - DNA, 856 bp, Homo sapiens
  misc_feature: GYAE6OF01BQEGS.8.34.D01.1.454.CMB.1.raw
  modified_base (123)..(123): a, c, t, g, unknown or other
  misc_feature (123)..(123): n is a, c, g, or t
  modified_base (176)..(176): a, c, t, g, unknown or other
  misc_feature (176)..(176): n is a, c, g, or t
  modified_base (197)..(197): a, c, t, g, unknown or other
  misc_feature (197)..(197): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactnaccatggagtttgggctgaactgggttttcctcgttgcttcttttaagaggtntcagtgtcaagtgcaagtggnggagtcgtgggggagcggtggtccaggccgtgggaggtcaacgagagacctgtcgtgtcgcacgtcctcgtgggttaccaccgtttcgaagttaaccgtacggctaagtgaccgtacggtcggggtacccacgtaaacggcctaccggaagggtacggaaggggtacgttggggaaggttgggggtacgtcgtaaggttttcgtttaaccaggttaccgtggggacgggttacctaaagggtttcgttaacgaaaggttgggttaaatcggtaaccgtaacgggttacccgttaccggggaagggtaacggggtacccgttaattacccgaacccgtacgttaccgttaccgaaggaaacgtaactaaacggttaccgaaagggtaaacctaaacgtaagtttacggttaacgtttacgggaacgtaccgttaaggaaacccgtacggttaacccgttaaacggttaccgtaaagggttaccgggaaccggtaaacggggttcccgtaaagtttaaccccgttaaagggtaaccgggttaaaccgggggaaaggggttaaacccgggggaaccgtaaggggtaaaccccgggttagtaaccgtaaacggtttacccgttaccggttacgggttaaccggttccggggtaaacccggggg

SEQ ID NO: 76731 - DNA, 717 bp, Homo sapiens
  misc_feature: GYAE6OF01A9KCX.8.34.D01.1.454.CMB.1.raw
  modified_base (211)..(211): a, c, t, g, unknown or other
  misc_feature (211)..(211): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagcccaccctgtcttcgtctccgaggggaaanacgccaccctctcctgcagggccagtcagaatgttggcgcctacgtatcctggtaccaacaagaaaccgtggaccaggcctacccgacggccccctcactctagtcggtgctactaccaacgacgggacctacgtggaccactccccgagccgtaggttcgaggttcggacgtaggtagggtagtacgggacacggtacttcctactctacacctataccatacacgtccgtggaccgtccgtagggacggtagttcggttacgtacgttaacgtttttaacgttaccgtttacggtaaccctaaacgttacgttacccgggtaaccggtcgggtttaaccgggtcccccgggttacccggggggtccccttaaccgggtttccccgggaccccggtacgggtaacccgtaaggtacggtaataaccgttaaaccggaaaccggttacgtacgggtcggaccttacggaccctaacctacgttaccgttacgttccttccgtaccg

SEQ ID NO: 76732 - DNA, 951 bp, Homo sapiens
  misc_feature: GYAE6OF01EAP7S.8.34.D01.1.454.CMB.1.raw
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (934)..(934): a, c, t, g, unknown or other
  misc_feature (934)..(934): n is a, c, g, or t
tcagctcgcgtgtccacgaccggtgctcgatttagatcgtctgtgttggggtttgggggaggaactgctcagttaggacccagagggaaccatggaacgccccagctcagcttctcttcctcctgcctactctggccttccctagtttcacgactaccgaccggagagtagttgtacgttgacacaatcctccaacgccctccccttggttcccttcggtccctaccggaagggggaacnccgccctaacccgttcncccgtagggaccgacgggaccctaggtactaacgtagttcggttacggaccgttacctaacggttccttccgtaacggtaaccctaaacgaacggtaaacccgtcggaaccccgaggtaccccgtacccgacccgggttaccccctacgtaacgttaccccgtttaagggtacggttaccggaccccttaaacggtaaacccccgaaaccgggtcccgggggtaaccccctaaacgggggttgaacccccgtaaaccgtccccggtaaaacggttccgggtaaccgggtttaacggccggtaagggtaccgggttaaggggtacggggtaaccggtacggggtaacccttaaacgggttcccttaacaaaccccggttaccgttacccaaaccggttctaccgttaaccgaccggtacccggccgggttaacggtaccggtacgttaaacgggtaacggttacttcggggtttaaacctgttttaacgtttaccgttacgtaacgtacctaacgtacgggtaccggtcgtaacgggtccggtcccgggtaccggggtaccttaccgggttccgggaacctaccggggtaaacgtcggggtacgaccggtaagtaccccggtaaagttacggtacggtccggtaccgacgtcccggttaactacgttccggtttaacnccgttaccgttaccccg

SEQ ID NO: 76733 - DNA, 738 bp, Homo sapiens
  misc_feature: GYAE6OF01CEIIY.8.34.D01.1.454.CMB.1.raw
  modified_base (270)..(270): a, c, t, g, unknown or other
  misc_feature (270)..(270): n is a, c, g, or t
  modified_base (473)..(473): a, c, t, g, unknown or other
  misc_feature (473)..(473): n is a, c, g, or t
tcagctcgcgtgtccacgaccggtgctcgatttagatcgtctgtgttggggtttgggggaggaactgctcagttaggacccagagggaaccatggaagccccagctcagcttctcttcctcctgctactctcggctcccagtttcagataccacggagagattgtgttagacacatctacagccacctgttcttcgtctcgagggaagacgccaccctctcctcgcgaggtccagtcagtaagtggttcggccgtcctacgtacttccgnggtaacccaacgtacgaaaccggtcggaccgaacgggccctacccgtaccggcccccttacgaaccgttcgttaacgtggttccgaccgtaccgtacccgaaacggccgggtccaacggtcgacctacctcccggagtccaacggttcgaacggttcggcgtagggttaccggggtagtacggggaactacggtacctttacnccgtttcaactacctagtccttacaccgcgtaccggtggacgtacgtcgagtacggttgtcgtacttaagtttacgttactacgttaaccgtacacgttacgtaccggtacggtaccggtacccgggttacccgggtaccgttacccggttccggtaccgggtaccggaacggttacgtacggtaacgttaaacgtagaaacccggtaagttcggtcggaccgtacgtaccgttacgactttaccgtcgtttacctcggttaccc

SEQ ID NO: 76734 - DNA, 597 bp, Homo sapiens
  misc_feature: GYAE6OF01DPIO0.8.34.D01.1.454.CMB.1.raw
  modified_base (325)..(325): a, c, t, g, unknown or other
  misc_feature (325)..(325): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcacatggagtttgggctgaacttgggttttcctcgttgcttctttttaagaggtgtccagtgtcaagtgcaactgggtggagtcgtgggggagcgtggtccagccgtgggagtcacagagactctcgtgtgcagcctcgtgggttcaccttcaagtaactacggcatgcacgtcgggtccgccaagcctccgaggcgaagggnttgggagtgggtggctagtttgttcatcgtggaggctagtcgttcaagttggtatgcagtaccgtcggtagacgggtccgattcaccatctacagacgaactaacttaccgaacgaactaactaagttagttaagtttggagtcgtacgaaacagtaaccgtaacgtcctaggaacgacgacgggtacgtaacgtacgtacgtaggtaacggaaagggacggggaacgacggacggtagtacgtacgtacttcgttacgcgttcggtacggg

SEQ ID NO: 76735 - DNA, 574 bp, Homo sapiens
  misc_feature: GYAE6OF01CTXYB.8.34.D01.1.454.CMB.1.raw
  modified_base (167)..(167): a, c, t, g, unknown or other
  misc_feature (167)..(167): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (319)..(319): a, c, t, g, unknown or other
  misc_feature (319)..(319): n is a, c, g, or t
  modified_base (415)..(415): a, c, t, g, unknown or other
  misc_feature (415)..(415): n is a, c, g, or t
  modified_base (429)..(429): a, c, t, g, unknown or other
  misc_feature (429)..(429): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagttgggctgaactgggtttcctgttgctctttaagnggtgtccagtgtcaagtgcaacgtggtggagtcgtgggggagcggtggtccagccgtgggagtcacgagagactntcgtgngcagcctgtggtcaccttnagtaactcgcagtgcacgtgggtcccaccgaagcctccgaaggccgaagggnttgggacgtgggtgcgtaggttgttacatcgtaggacggctaggtgtacaagtggtatgacgagactccggagaaggcctatcacactctacaganacacgtaccgaganacatcgtattagganacgngtaacagtaccgtaagtcctaggacgtacgacggcgtaatacgtactaggtaacggacggggtaaggggaccgaggaccggggtataccgtaacgttacgtccgtttaggccgtcgggtaccgggg

SEQ ID NO: 76736 - DNA, 818 bp, Homo sapiens
  misc_feature: GYAE6OF01EX2LW.8.34.D01.1.454.CMB.1.raw
tcagctcgcgtgtccacgaccggtgctcgatttagatcgtctgtgttgggtttgggggaagaggaagactgacggtcctgccacaggtggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtgggagtcacagagactctcgtgtgcagtcctcgtcggttccaccttcgaagttaacctacggctatcgaccacggtcgggtcccgaccaacggcctacccggacgggtacgaaaggggtgtttcggggaagggttggggttacggacgttaggtttttcggttttaccgaacttcggtaggacgggggttcctaagggtttacgtttactaaggtttagggtaactacggtcccgaaacggttacccgttccgggtaacggtaaccggggtacccgttaactaccccgtaaccctaacgttaccccgtaaccggaacgtaaacgtaacccttaaccgttaacccgaagggtaaaccctaagttaaacgttggttaacgtttccgggaaacccgttaagaacgtaccgttacccgtaacggttcccgtagaaccgggtacgtaacgggttagtaacttaacgttacggtaacggaacgggtaacggggggaacgggtaacccggaagggtccggggtaacgttaacccggaaacgtttacccggttaccgtttaagggacccgttccgggtcggggtaaccccggg

SEQ ID NO: 76737 - DNA, 704 bp, Homo sapiens
  misc_feature: GYAE6OF01B2QH7.8.34.D01.1.454.CMB.1.raw
  modified_base (389)..(389): a, c, t, g, unknown or other
  misc_feature (389)..(389): n is a, c, g, or t
tcagctcgcgtgtccacgaccggtgctcgatttagatcgtctgtggttgggtctgggagaggagcccagcactagaagtcggcggtgtttccattcggtgatcagcactgaacacagaggactcaccatggagtttgggctggtaacttgggtttcctgttgcttcgttttaagaggttctccagtgtaccaagtgacaacgtggtaggagtcggtgggggacgtcgtggtccaggccgtgggacgtcaacgagacgtacttcgtcggtgtcgactacggtccttacggttcgggttccaaccgtttacgaacggtaaccgttacggcctaagtcgaccgaccggttcggggccccacgaacgcctacccggaaggaccgtaaagggtnttggggagttggggtcgtacgttaggtttctttcgagtttcggagggacggactaggttacgttagaagtggtctcgacgtacgtcggttaccgagggaaccggtcctagttccacgtacttaccgaccgaaggtaacaacgtaaacgttcgaaacggtaaactacgtaagtttagtacggttacggactacgtaacgaactacgtaccgttaagtcccgtaaggacgtacggtagacgtactacgaccggttaggaaccggagggaacgggactgggacgtagtacgaacgttcgtaccgtgcggtgtaccggg

SEQ ID NO: 76738 - DNA, 810 bp, Homo sapiens
  misc_feature: GYAE6OF01BYKS6.8.34.D01.1.454.CMB.1.raw
  modified_base (171)..(171): a, c, t, g, unknown or other
  misc_feature (171)..(171): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactgggtggagtcgtgggggagcgtggtccaggcctggggagtcacagagactcgtcgtgtcgcagtccttcgtgggttaccaccgttacaaggttaaccgtcggctagtcggacctacggtcggggtacccaccaacggtccgtcccgaagggaccgtaaaggggtagtttacggggaggttcgggggtcggtcgtaaggttttcgtttaccgaacgtttccggtagggaggggtaccttaagggtttacggttactaaaggtttcggtaagtcggaaccgtacggtaacccgtccgggtaacggtacggggtaccgtacttaccacccgtatccgtaccgaagtaaccgtaacctaaacgttcccgaagggtaacctaactaaacgttttaggttacgtttaacgggacgttacgtacggaaacgtaccggttaccccgtaaggttaccccgtaggggaacccggtaaccggtacgggtaccgtaacgtaacggttacgttaacgggtaaacggggaacggggggaacggggtaaccgtacgggggaccgggttaaccgtaccggttaaacgttccccgttaacggtttacgggtaaccggtcgggttacccggggg

SEQ ID NO: 76739 - DNA, 947 bp, Homo sapiens
  misc_feature: GYAE6OF01EZ5ZX.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaacttgggttttcctgttgcttacgttttaagaggtctccagtgtacaagtgacaagtgggtggtaggtcggtgggggagtcggtggtccaggtccgtggggacgtcaacgagacgtaccttcgtcggtcgtcgcctaccggtccttacggttcgggttaccctaaccgtttacgaacgttaacccgtacggactacgtcggaccgtaaccgggtccggggtaccccgacccgaaacggtcccgttaccggaggggtaaccggtaaaggggggttacgtttacggggggtaacggggtttgggggttaccggttacgttttagggttttccgtttacgtaacggtttacgggtaggggaaccgggttcgtacgggtttacggttaacgtaaggttcgggtttaacgtcgggtaccgtaaaccggttacccggtaccggggttaacgggaaccgggttaacccggttaacttaccccgtaaaccttcgtacccgttacccgaaaggtaaacccgtaaccgtaaccgtaacccggaaacggtaaccctaaacgttaacgggttttacgtacggttttaaacggacccgtttaacggaaccggtacccgttaaccggtttaacccgtcgggtaacgggtaaacggtcccggttaacgggttaactaacgttaaccggtacggttaaacggggtaaaccgggaaacgggggggtaccggaacggtagggtacccgggtttaaacggtaaacccgttaccgtttaccggttaccgggttaggtacccggttcgggtcccgggggtaacccgg

SEQ ID NO: 76740 - DNA, 904 bp, Homo sapiens
  misc_feature: GYAE6OF01BFRFM.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgtaacgttgggttttcctcgttgtcttactttttaaggaggttgtccaggttgtacaagtgcaacgttgggtaggagtcggtggggggagtcggtggtccaggtccgtggggacggtcacgagacgtactcgtcggtgtcgcagcctcgttggttcctaccttcgaagttaacctacggctatcgactacggtcgggtcccacgtaacgcctaccggaggacgaagggtctgggaggtgggtacggtcttagtttcttacgacgtcggtacggtacgggtctaagggtttcgttaacgtaggttggttactcgggaccgtaaggttacccggttaccgggtaagggtaaccggggtccgttaaccttaccggaacccgttacgttaccccggaaccggtaaaggtaaacccgtaaccgtttaaaccgtaacccgggtaaacgtaaaccttaaaccgtaaggttttacggtttacggtttacggaacgttaccgttaacggtaaacccgtaaccgttaacccggtaaccgggttacccggtacggtaaccggggtaaacggtacccgggttaaccgttaacggttaaccgttaaccggttaaacgggggtaaaccggggaaacgggggggtaaacccgggggtaacccggtagggggtttaaaccccggggaacccgttttaaaccgggttaacccggtttaccccggtttaacccgggttttaccggggtaaacccgggttttccgggggtaaacccccggggg

SEQ ID NO: 76741 - DNA, 1021 bp, Homo sapiens
  misc_feature: GYAE6OF01D7FXH.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaaaagacgcccaccctctcctgcgagggccagtcagatgttcggcgcctacgtactccgtaggtaaccaacgaacgaaaccgtcggacccgacgggtccctaccccgaacggtccccccttactaacttccgttaagttcggggtacgacctaacgtaccccgaaaaccggaccggggtaccctaacggttcgggaccctaaacccgttacccccgaacggtaccccgtaacgggttttacccgaaggggtttaccgggaccggttaaggggttacggggttaaagggttaccgggggaaaccgttaaacgggtaaccctttacccgtaacccgttacccgtttaacccaaccccgttaaattaccggaaccggaacccgtaacccggtaccccgttaaaacgggtacccggttacccggtttaaaggtaaacggttttaacgttttttacggtaacccggttttaacgtttttttaaacgttaaccgtttaccggttaaaccttaaacccgttaacgtttaacccccggggttaaccggtaacggggtttacccgggggtaccccccgggttaccccgggggggttaccccctttaaccggggttttccccggggtaaccccgggttaaccggggtaaaaccccttaaaaaggtttacgggaaaacggttaaccggttaaaacccgtaaaacccgggttaaaccggttcggggttaacccgggtaacccgttacccgggtaacccgttaaacccgttaacggtttacccggttacggttttaacccctttaccgtaacccgtttttaccccccgg

SEQ ID NO: 76742 - DNA, 688 bp, Homo sapiens
  misc_feature: GYAE6OF01BDMHP.8.34.D01.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
  modified_base (661)..(661): a, c, t, g, unknown or other
  misc_feature (661)..(661): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctaccgagggaanacgccaccctctcctgcacgggcagtcagatgtgcnctacgatccngtaccaanacgaactgcaggctccacggccctnacgtctagtggtcgctactaccgaaacgacgggcctaacgtcggaccaaccgttccccgaacgtaccgtaacgggtttcaagggttcggacgtaagggtttggggtaacgtgggggaactagtaccgttctacttaccgtacaacctactacctaatccgaacgtcccgttagggaaccgtccgttaggaggtaacttgttacggactttaagggttttacttacgtgtaccaacgtcgtaccgtaacggtgtaccggcccgggttacccggggtacttaccggtttccggacccgttagggaaccctaagggtcggtaaacttacgtaaccgaaaccggtacgttacgggtcgccgttacgacccgttaacncgtttacgtcttccgtttaaccgaccg

SEQ ID NO: 76743 - DNA, 850 bp, Homo sapiens
  misc_feature: GYAE6OF01C0WW5.8.34.D01.1.454.CMB.1.raw
tcagctcgcgtgtccacgaccggtgctcgatttagatcgtctgtgttgggtctgggagaggagcccagcactagaaggtcggcggtgtttccattcggtgatcagcactgaacacagaggactcaccagtggaggtttgggctagtaacgttggttttcctcgttgtacgttacgttttaaggaggttcgtccgaaggttcgtacgaaggtcgaccgtaacgttggggtcggaggttaccggtgggggggacggtcggttcggtcccgtaggtcccggtagggggtacggtaccaaagtacggaacgtccgttccgtcggtagtgccgtacgtccgtttcgttcgggttaccctacccgttacgtaacgttaaaccgtaccgggactagtcggtaccgtaacggttccggggacccctaccgaaacgtcccgtaaccggagggtacgtaaaggggtgtttggggagggttgggtacggtacttaggtttcggtttacagtttccggtgggtaaggtccttaaggttgttaacgtaaaggtgggtaacttcggacgacggtaccggtacgtacggaacgggtcgtaccgttacgaccttacgtaccgacgacggtaacgtaacgtaacgtaccgtaaaggaaccctaaagtaaagttaggttagtttacgggaatacccgtaagtaaacccgtagttaaccccgttaggtacccgttaacggacgggttaacccggtacgggtaacttaaccgtacgttaaccgggaacggtaacgggaaggggtaaccggggaaccgagggtacccgtagttaccgtaacggttccttacggtcggcggtcggtaccggg

SEQ ID NO: 76744 - DNA, 744 bp, Homo sapiens
  misc_feature: GYAE6OF01DZMKF.8.34.D01.1.454.CMB.1.raw
  modified_base (157)..(157): a, c, t, g, unknown or other
  misc_feature (157)..(157): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (286)..(286): a, c, t, g, unknown or other
  misc_feature (286)..(286): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccgganagattgtgttgacacaatctccagccacctgtcttcgtctccaggggaaangccacctctccngcaggccagtcagatgtgcnctagtatccngtaccaacagaaacctggccaggctccaggcccctnactctatggtgcactaccaacgacgggcctacgtcggacctactaccccgaagcccgtaagggtttccaaggttcgggcctaaggggtggggttaacgtggggaacctaacggtacctttacgaacccttcttaccaacccgtaatcgaatccgacgtccgtaggggactccgtaggacggtaacgttggttacggtacgtttaacggttttacttaacgttacggtaacctaaacgttaccgttaaccggttaccggtaacgggttaccgggtaccccggggtttacccgggggtaccctttaacccgggtttcccgggacccggttacggggaaaccccgttaaaagggtcggtaaaccgtttaacgtaacccggtaaaaaccgttacgtacgggtaccggacgttaaccggaccctaccggttaacttcgggtttacttccctttacgtaccccg

SEQ ID NO: 76745 - DNA, 774 bp, Homo sapiens
  misc_feature: GYAE6OF01DVNFN.8.34.D01.1.454.CMB.1.raw
  modified_base (208)..(208): a, c, t, g, unknown or other
  misc_feature (208)..(208): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgagggaaanacgccaccctctcctgcagggccagtcagtaatgttcggcgcctacgtatccgacggtaccaacagaaaccgtcggaccacggcctacccgacggccccctnactctagtcggtcncacgtaccaacggacgggccacgtcggaccactcccaggccgtaggttacgaggttcggacgaggtttggggtagtacgggaactacggtacgtttaccaccttaccgtaccgtaaccctagtaccgtaactccgaccggtacccgtagggtaccgtaccgtagggtaacgggtacgttcgggttacgttacgttaacggtttttaactttaaccgttcggttaacctaaaccgttacggttaccgtaaccgggtcgggttacccgggtccccgggttcccggggggtaccctttacccgggttttacccgggacccgggttacgggtaaacccgtaacggtttacgaaacgttaaccgttaacccggtaaaaccggtacgtttcggtacgggtacccctaggaacccttaacggtaccttacggttcctttaccgttaccgttaacccg

SEQ ID NO: 76746 - DNA, 830 bp, Homo sapiens
  misc_feature: GYAE6OF01BVH4T.8.34.D01.1.454.CMB.1.raw
  modified_base (276)..(276): a, c, t, g, unknown or other
  misc_feature (276)..(276): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagttgggctgaacttgggttttcctcgttgctcttttaagaggtgtccagtgtcaagtgcaacgtggtggagtcgtgggggaggcggtggtccagccgtggggaggtcacagagactctcgtgtgcagcctcgtggttccaccttnaacgtaacgtacggctagtcgctacgtcgggtcccgaccaacgcctaccgagggacgtaaggggtattgggaggtgggtgcgtagtttgttcagttcgtaggacgggtctaggttcgttacaagttggtactccgtacggaccggtccggtaggaacgggtcccgtattacccgaaccttacgttaccgtaccgaaagggtaaccgtaaacccgtaacccgtacccggtaaaacggtaaaccctaaacgttaaacggtttacgggtttaacgttttaaccgggtaaaccccgttagggaaaacccgtaaccggttaacccgttaaacggttccccggtagggtaaccgggttaacccggtaacggggtttactaacgttaaaccggttacgttaaccggggtaaacggggaaaacggggggtaaccggggggaaaccgtaagggggtacccgggggttaaccgtttaacccggtaaacgggttttaacccgttcgggttttaacccggtaccggggtttccgggtaccggggggtacccggttaaacccggggg

SEQ ID NO: 76747 - DNA, 888 bp, Homo sapiens
  misc_feature: GYAE6OF01B5NYU.8.34.D01.1.454.CMB.1.raw
  modified_base (206)..(206): a, c, t, g, unknown or other
  misc_feature (206)..(206): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccgaccggagagattgtgttgacacaatctcagccacctgtcttcgtctcgagggaanagccaccctctcctgcagggccagtcagaatcggttgcgacctacgtactcctggtaccaacacgaaaccgtcggaccgacggtcctacccgacggtccccctactactccgtaagtcgggttcgcctaacgtacccgaaccgacgggaccctacgtacggaccaaccgttccccgacggcccgtaacgggtttccgaacggtcggaccgtaaggggttcggggtaacggtaggggaacctaacgggtacctttaccgaccttaccgttaccaaccctaacttacctaacgttacgaccggttaccccggttaagggacccgtaccggtaagggtaacgggttactttgggttacggtaccgtttaaggtttttaacgttaccgttcgttaacccaaacgttaccggttaccgggttaacggtaccggggtttaccggggttccccccggggttacccgggggttaacccccgttttaccgggtttccccggggggtaaccccgttacgggggtaaaaccccgtttaaagggggttacccgtaaacgggtttaaacccgtaaacccggttaaaacccgggttaaaccgttcgggggttttcccggaaccgttacccggtaacccgggttaacccccttagttacccggttttccggttttacccttaacccgtttacccggg

SEQ ID NO: 76748 - DNA, 913 bp, Homo sapiens
  misc_feature: GYAE6OF01CSFWY.8.34.D01.1.454.CMB.1.raw
  modified_base (268)..(268): a, c, t, g, unknown or other
  misc_feature (268)..(268): n is a, c, g, or t
tcagctcgcgtgtccacgaccggtgctcgatttagatcgtctgtgttgggtctgggagaggagcccagcactagaagtcggcggtgtttccattcggtgatcagcactgaacacagagactcaccatggtagttggctgtaacgttgggttttcctcgttcgtcttacttttaaggaggttgtccagtcgtacaagtcgacaacgtggtaggacggtcggtggggggacggccggttcggtccacggtccggtggggagtaccaacgnggaagtaccttcgtcggtagtcgccgtacgtccgttacggttcgggttacctaacccgttacgtaaacggtaaacccggtaccggtactagtcggtacgtacccgggtccggggtaccccaaccggtaaccgccctaaccggacggacggtaaagggtacggttagggtaacgggtcggggtagtccgttaaggttttccgtaccttaggtcgttacggacggggtactaggtttcgttaataagttgtacgtacggtcgtaacggtaccggttcgggtaacgggtaccggtaccgtaacgtacccgtaccgtaccttcggacccgaaggtaccgtaacgtaaacgtaaccgtaacggaaccttaaaacggttagttacggtttaaggtttacggtaacgtacgtaaaccgacggtaccgttaacggttaaccggttcggaaacgggttaccggtaaacccgggtccgggtaaacgttaccggttaaaccggtacgggttaaagggaaacccgggggtaaggggggtaaaccccgggtaacccgggtaggggttaaaccccgggtaaacgttttacccgggtaaacggtttaccccgggttttaacccgttaccggggtccgggttccccgggtaacccgggggg

SEQ ID NO: 76749 - DNA, 873 bp, Homo sapiens
  misc_feature: GYAE6OF01ECCXS.8.34.D01.1.454.CMB.1.raw
  modified_base (123)..(123): a, c, t, g, unknown or other
  misc_feature (123)..(123): n is a, c, g, or t
  modified_base (827)..(827): a, c, t, g, unknown or other
  misc_feature (827)..(827): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctnctactctggctccctagtttcagataccgaccggagagtattgtgttgacacaatcctccacgcccacccttgttccttcgtccgtccggaagggggaaacgacgacccaccctctccgtgcgacgggcctagtacaagtagttggttcgcgtccttagtactccgtacggtaaccaacgtaacgtaaccgtcggacccacggtccctacccgaccggtcccctcgtaccttaccgttagtcggtaccgacctaaccgaccccggaacggacccggggtaccctacggttaccggacctaacccgtaccccgacggtaaccccggttacggttaccgtaaggggtcggtacggtaacggggttgggggttaacggtccgggtaaacgtaaccggttaccctttaaccgaccttaccctaacccgaaaccttcgttaaccgtaacgttccggaaccggtcccgggttacggaccggtaccgttagggtaacggttgtttacggttaccggttaagttttaccgtttacttaaccgttacggtaaccttacggtttacccggaacgggttacccgggttacgggtacccccggggttaccgggttacccggggttcccttaccggggtttcccgaacccgggtacggtaaacgtacggttacgttaaacgtaaccggtaaaccgtaacggttacggttcggtaacncggttaacgacccgtctacgtttacgttacgttccttaccgtaccc

SEQ ID NO: 76750 - DNA, 856 bp, Homo sapiens
  misc_feature: GYAE6OF01BYZGJ.8.34.D01.1.454.CMB.1.raw
tcagctcgcgtgtccacgaccggtgctcgatttagatcgtctgtgttgggtttgggggaggaactgctcagttaggacccagagggaaccatggaacgccccagctcagcttctcttcctcctgctactctggcctccgagtttcagactaccgaccggagagtattgtgttgacactaatcctccacgccctaccctgtcttcgtctaccggaaggggaaacgcgcccaccctcgtcctgcgacggccagtcaagatggttcgctaccgttacgtatcctacggtaaccaacgacgtaaaccgtcgaccgtacgccctacccgaccggcccctatacgtctaggtcgtcgacaccgtaaccgaacggtaccggccctacgtaccggaccctaccggtaccccgacggtaccgttacggtaccgagggttcggtaacgggtagggttacgggtaacggtcgggtaacgtaaccgttacttaccggcctaaccgtacccgaaacctacgtcccgtaaactccggtaaccgtccggtaaccggtaccggtacggtacgggtaacggtttaacgttcgggttaacccggtttaagtttacgttttttaaccgtacgttccgttaaaacctccggttaaccggtaccgggtttaacccggtcggggttaccccgggtaccccggggttacccggggggtaccctttaccggtttaaccccgggggacccgggtaaacggaaaccggggtttaacggaccgttaaaccgttaaccggtaaacggtaaacccgggtagttaccgggacgtccgtaaacccgctaccggttacttggtttaccccttcgtaaccctttcccgg

SEQ ID NO: 76751 - DNA, 856 bp, Homo sapiens
  misc_feature: GYAE6OF01CCPUK.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttctttttaagaggttgtccagttgtacaagtgacaacgtggtggagtcgtgggggagcggtggtccagccgtgggagtcacagagactcgtcgtgtgcacgtccgttcgttcgggttcctacccgtttcgaaacggttaacctaccgggtctaagttcggccgtaaccggttccggggtaccccgacccgaaacggccccgtaccccggaaggggaccgtaaagggggttagtttaggggagggttggggttcgggaccgtttagggttttcgtttaccgagttaccgttagggacggggtaccgttaaggtttacgttacgtaaaggttgggttaagtcggaccgtaacggtacccggttccgggtaagggtaaaccgggtcccgtaaccgttacccgtaacccgtaccgttacccgttaacccgaaacggttaaccgtaaccgttaaaccggttacccgggaaacctaaccgttaaacgttacggttagtttaacggactaccggtaaagaacccgtaaccggttaaccgttaaccggtccgtacggaaccggtaaccgacgggtaccgttaacgttaccgtacggttacgggaaacgggaacggggtaacgggggtaaccgtacgggacgggttacgttaccgtaacgttaccgttcgttacgggtaccgttcgggtccgggtacccggg

SEQ ID NO: 76752 - DNA, 707 bp, Homo sapiens
  misc_feature: GYAE6OF01CZK3R.8.34.D01.1.454.CMB.1.raw
  modified_base (249)..(249): a, c, t, g, unknown or other
  misc_feature (249)..(249): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
  modified_base (692)..(692): a, c, t, g, unknown or other
  misc_feature (692)..(692): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccagtggagtttgggctgaacgttgggttttcctcgttgcttcttttaagaggtgtccagtgtactaagtgcaacgtggtggagtcggtgggggagcggtggtccagccgtggggagtcagaganctctcgtgtgcacgccgtcgttgggttacctacgtaccgtaacgtaaccgtacggcctagtcgacctacggtcggggtcccacgaacgtcgtccgaaggacaaggggtatgggaggttgggnggtctaggttntttcgagtcgtagnggtctagtgttacgaagtggtataggtcacgtacgttcggtaagggacggtaccgtagttacccgaaccttactcctacgaacggtataaacgtaactaccggaaacggaacctaaacgtaagttaggtttaacgtttgggaaactccgtaacgaaaccgttacgaaccggttaacgtaccgttacggaacggtaaccgtacggggacctaacgttaaacgcgttaaggtacgggaaacggggtacgggacggtaacggtacgggtacgttaaccgtaacggtaccttcggtacgnggttccggtaccggg

SEQ ID NO: 76753 - DNA, 964 bp, Homo sapiens
  misc_feature: GYAE6OF01D0ZQS.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccagtggtagtttgggctgtaacgttcggggtttttccctcgttgtctttacgtttttaaaggaggttcgtcccaggttgtacaagttgacctaacgtgggtggtaggtcgggtggggggacggtccggttcggtacccgaggccggtggggacgtacaaccgaaggtacgtaccttccgtcggtggtcgtcgtacgtccctttcggttcgggtttaccctaaccgtttcgaaacgttaaccgtaccggctacgtcgaccgtaccggttcgggtcccaccgacgtcctaccggaggacggtaagggtagttacggggaggttggggtcgtacgttagggttttcgttacctaggttacggtgggtacgggtacgttaggtttacggttacgtaaagggtttcgggtacgtacggacgtaccggttacggttaccgggtaagggtaacccggggtaccctttaacttaccgaaccccgttattacccccgtaaccgggaaaggtaaaccgtaaacccctaccggttaaacccggaaacggtaaacttaaccgttaaacggttttaccggttaaaggtttacccggaactaaaccgggtaaaccgttaacccggtttaaccttaaccggggtccgtaacgggtaaaccgggtaccgttaacggggtttaattaaaccgtacccggtttaaaggttacgggggaaaaccggggtaagggggggaacccggggttaaccgcggggttaaacccgggtaactttaacccgggtaccggtttttaacccggttcccgggtttaaagggccccgggtttaggggtaccccgggggttaaacccccgg

SEQ ID NO: 76754 - DNA, 906 bp, Homo sapiens
  misc_feature: GYAE6OF01A59ND.8.34.D01.1.454.CMB.1.raw
  modified_base (153)..(153): a, c, t, g, unknown or other
  misc_feature (153)..(153): n is a, c, g, or t
  modified_base (169)..(169): a, c, t, g, unknown or other
  misc_feature (169)..(169): n is a, c, g, or t
  modified_base (173)..(173): a, c, t, g, unknown or other
  misc_feature (173)..(173): n is a, c, g, or t
  modified_base (186)..(186): a, c, t, g, unknown or other
  misc_feature (186)..(186): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgtacttggtttccngttgcttactttaagnggtntcagtgtcaagtnactacgtggtggagtcggtgggggagcggtggtccagtccggttgggacggtcacgagacgtacctcgtggttgtacgccgtacggtcccttcggttacgggttaccctacccgtttacgtaacgttaaaccgttaccggctagttccgaccgtaccgggtcggggtaccccgaccaagggtcccctaccgggacgggtacggaaaggggttgttaggggaggttggggtcggttacttagggtttttacgtttaccgacggtttccggtaggacggggtaccttagggtttaccggttaagtaagggtttcggggttaagttacccggaacccgggttaacggtaaccccgggtttaacccgggaaagggtaacccggggtaccctttaacttacccccggtaaccgtaccttacccgggtaccgaaacggtaaacccgtaaccttaaccggttaacccggaaaggtaaacccttagttaaacggtttgtttaaacggttagggaactaaccgttaacgggaaaccttaccggttaaccggttaaacgtcccggtaagggaccggttaacccgggaggttaacctagttaacgtacccggttaaaggggaaccgggtaaaggggggtaaccccggacggttacgggggaccgttaaccgttaacccggtaacggtttccccgtttaaggggtcgaccccggggtttcggaaccccgggg

SEQ ID NO: 76755 - DNA, 785 bp, Homo sapiens
  misc_feature: GYAE6OF01E4LZ4.8.34.D01.1.454.CMB.1.raw
  modified_base (255)..(255): a, c, t, g, unknown or other
  misc_feature (255)..(255): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaaagacgccaccccttctccctgcagggccagtcagaatggttggcncctacgtatcctggtaccaacagaaaccctggaccaggcctcccgacggccccctcactcctagtcggtcgcctactacccgaaacgaccggggtacccctacgttcggggaccctaaccgttaccccccgaaacggtccccgtaaggggttttacccaaggggtttaccgggtaccgtaaggggttcggggggttaaacgttcggggggaaaccgtacggtaacccttttaccgaacccttcccgttaccaaaccctacgtacctaacgtaccgaccggtccgtagggtacgcccgttaggaacggtagttggttacgtacgttagttttaacgttaccgttcgtaacctaacgtacgttacccgggtaaccgtagggtccgggtcccggtacccgggggtacccttaccgtttcccgggtcccgttacggggaaaccctaacgggttaggaacctaagttaaccgtaaaacggtacgtacgggtccggcgtaccgacctaccgtacttaccgtcgttcctcgtacccg

SEQ ID NO: 76756 - DNA, 741 bp, Homo sapiens
  misc_feature: GYAE6OF01AGGG7.8.34.D01.1.454.CMB.1.raw
  modified_base (216)..(216): a, c, t, g, unknown or other
  misc_feature (216)..(216): n is a, c, g, or t
  modified_base (428)..(428): a, c, t, g, unknown or other
  misc_feature (428)..(428): n is a, c, g, or t
  modified_base (458)..(458): a, c, t, g, unknown or other
  misc_feature (458)..(458): n is a, c, g, or t
  modified_base (492)..(492): a, c, t, g, unknown or other
  misc_feature (492)..(492): n is a, c, g, or t
  modified_base (503)..(503): a, c, t, g, unknown or other
  misc_feature (503)..(503): n is a, c, g, or t
  modified_base (527)..(527): a, c, t, g, unknown or other
  misc_feature (527)..(527): n is a, c, g, or t
  modified_base (680)..(680): a, c, t, g, unknown or other
  misc_feature (680)..(680): n is a, c, g, or t
tcagctcgcgtgtccacgaccggtgctcgatttagatcgtctgtgttgggtttgggggaggaactgctcagttaggacccagagggaaccatggaacgcccagctcagcttctcttcctcctgctactctgcctccctagtttcagactaccaccggagacgtatttgtgttacgacactaattcctccacgccctacccttgttccttccgttcnccgaaggggtaaaagccgtcccaccctcgtctcgaccgacgggtcctaggcaacgagttgttcgggtacaccttacgtagtccttacggtaacccaactaacggtaaacccgttcggacccgtacgggtccctacccgacggacccccttacggctccgttaacgtcgggtaccgatacccgtaccaaccggccgggcctacgtcgaccacncccgactccgtaaggttcacggcgtacggnggttacggtagacggtacgataccgtcacgtccncgtacctacgngtacacgtagccgtaagcgtacgngtaggtctggttcgtacgtcggtttaatcgtacttaccgtagtaccgtacgaacccggttggtcccggtacccgggtccgggttacccttaccggttacgggtcccgttaaggaaccgttcggtaaccgtagttaaaccgtcgtaaacccggngtttacccggaggttcctaacgacccgtacgtcgttaccgtttactccggtttaatacccg

SEQ ID NO: 76757 - DNA, 771 bp, Homo sapiens
  misc_feature: GYAE6OF01CLUV7.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccaccggagagattgtgtcgacacaatctaccagccacctgtcttcgtctaccgaaggggaagcgccacctctcctgcgacgggccagcaagtagtcggttggcctacctacgtctccgtaggtaacccaaacgaacgaaacctcgggacccagggtccctcccgacggcccctcgatcctagtcggtcgactaccaccgaacgcggacccacgtacggcctactccgacgcgtagttccgaggtcggacgtaggggtcggttacgacgggactcgtaccttaccgaccgttactacctaactacgtaactactaccgtacggtcccggttacgggccgtaccggtagggtaaggtctttgggttacgtctttaagtttacttaacggtacgtaacctaaacgtcggttaacccggtaacggttcggtcccggggtaccccgggttaccccggggtacctttacccgggggtttaccgggacccccgggttagggaaacccgtaagggttaccggggtaaacctaaaccggtaacccgtaaaaggtaccgggtttagccgggttcgtaacccgggtaccaaccggtttacttccggttaccgttacccgttccgtttaaccccg

SEQ ID NO: 76758 - DNA, 740 bp, Homo sapiens
  misc_feature: GYAE6OF01EE8RV.8.34.D01.1.454.CMB.1.raw
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (319)..(319): a, c, t, g, unknown or other
  misc_feature (319)..(319): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagactaccaccggagagattgtgttgacacaatctccacgccacccttgtcttcgtctccgagggaaagacgcccacctctcctgcgagggccagtcagatgtgcnctacgtntcctagtaccaacacgaaccgtggaccgaggcctacccgacggcccctcacgtctagtcggtcnctactacccaagcgggaccctacggtcggctaaccgtcccgagtaccgtacggttctacggtcggtacgtagggttgggtacgtggtacggaccgtaagtacctttaccaccgttacctaccctaaccgtacttactaccgtacgtaccggtaccgtgggaccgtccggtagggacggttagtttcggttagtaccgtttaggttttacttacgttacgtactaaaccgtgttaccggtacggttacgggtccggtacccggggttacccggggtccgtttacccggttccccgggaccggttaacgggaaacccgttaagggttacgaaccgttaaccgtaaaccggtaaaccggtacggttcggacggtaccgtaccgtaccgtaacccgtttatacgggtttcccttcgttaaccccg

SEQ ID NO: 76759 - DNA, 724 bp, Homo sapiens
  misc_feature: GYAE6OF01CVNY8.8.34.D01.1.454.CMB.1.raw
  modified_base (175)..(175): a, c, t, g, unknown or other
  misc_feature (175)..(175): n is a, c, g, or t
  modified_base (179)..(179): a, c, t, g, unknown or other
  misc_feature (179)..(179): n is a, c, g, or t
  modified_base (207)..(207): a, c, t, g, unknown or other
  misc_feature (207)..(207): n is a, c, g, or t
  modified_base (332)..(332): a, c, t, g, unknown or other
  misc_feature (332)..(332): n is a, c, g, or t
  modified_base (398)..(398): a, c, t, g, unknown or other
  misc_feature (398)..(398): n is a, c, g, or t
  modified_base (457)..(457): a, c, t, g, unknown or other
  misc_feature (457)..(457): n is a, c, g, or t
tcagctcgcgtgtccacgaccggtgctcgatttagatcgtctgtgttgggtctgggagaggagcccagcactagaagtcggcggtgtttccattcggtgatcagcactgaacacagagactcaccagtggtagtttgggctagaccttgggttttcctcgttgcttcttttaagnggtntccagtgtcaagtcgactaacgttgggnggacgtcggtgggggagtccgtggtccaggccgtggggacgtccacgagtacgaccttcgtcgtgtacgctacgtcccttgtttccggggttacctacccgtttcgaaacgttaaccgtaccggntagtccgtaccacggttccggggtacccaccaacggtcctaccggaagggtaccgtaaagggggtntttaggggtaggttcgggggtctaccgttaggtttccgttcagttcgtgggtaccgggnttagggttcttacaaaggtttcggtatcgacgtacgtaccgtccgtaagggcccgggtctacgttacccgactacgtcctaaccggagtaaccgtaactaacgtaccgaagtaaaccgtactagttgttagttcgacgtacctacgtaaaccagtaccccgttaagtccgtaacggcgaaccgtgggaaccttatacgtacggtaggtaccggaaggggacggacgtaggcggttacgtacgtactctacgttgaccggttgacggg

SEQ ID NO: 76760 - DNA, 698 bp, Homo sapiens
  misc_feature: GYAE6OF01B7K8A.8.34.D01.1.454.CMB.1.raw
  modified_base (176)..(176): a, c, t, g, unknown or other
  misc_feature (176)..(176): n is a, c, g, or t
  modified_base (482)..(482): a, c, t, g, unknown or other
  misc_feature (482)..(482): n is a, c, g, or t
  modified_base (635)..(635): a, c, t, g, unknown or other
  misc_feature (635)..(635): n is a, c, g, or t
  modified_base (688)..(688): a, c, t, g, unknown or other
  misc_feature (688)..(688): n is a, c, g, or t
tcagctcgcgtgtccacgaccggtgctcgatttagatcgtctgtgttgggtctgggagaggagcccagcactagaagtcggcggtgtttccattcggtgatccagcactgaacacagaggactcacagtggagtttggctgacttgggttttcctgttgcttacgtttaagaggtntccagtgtcaagtcgctaacgtggtggagtcgtgggggagcgtcggtccagccgtgggagtcacagacgactcgtgtgtcgcgtacgcctcgttcgggttccaaccttacgaacgtaacgtcggactgtacgccacgtcgggtacccgacacggcctaccgaggacgaagggtcgttgggaggttcgggaggtccgttaggttttcgttaccgaagttccggtaggaacgggtcttaagggttacgttacgtaacgttaggtacgcggtaccgacggtaccgtcggtaaacggtacggtaccgttnttaccgaccttacgtccgtaccgaaagtacgaacctaagtaccgaacggtaaacctacgtaaagttcggttaagttacggtacgaacgttacgaaaccgtacggtaaccgttaaacgtcccgtaaggacgaccgtacggtactacgtacgtanacgggtacgacgggtaggactaggtccgaaagttcctaaggtccctagttcgngtgtaccggg

SEQ ID NO: 76761 - DNA, 659 bp, Homo sapiens
  misc_feature: GYAE6OF01D6ZDG.8.34.D01.1.454.CMB.1.raw
  modified_base (335)..(335): a, c, t, g, unknown or other
  misc_feature (335)..(335): n is a, c, g, or t
tcagctcgcgtgtccacgaccggtgctcgatttagatcgtctgtgttgggtttggggggaagaggaagactgacggtcctgccacaggtggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctggggagtcacagagactctcgtgtgcagcctcgtgggttcaccttcagtaactacggcatcgcacgtcgggtcccgaccaagcctaccgaggacgaaggggtnttaggggaggtggggtggctagtttcgtttcattcgtggaggtcagtgttacaagtggtatcgacacgtacctcggtaggaacgggccgtattccaccatcctaccgaagacgaactaactaccgaagaacaacaattgttagtttggactcgtagaaaccacgtacctaacgtccgtaggacggtaacgaccgggtacttaactacgttacgacggtaaacgggaacgggggaacgggggaacccgtaggggaccgggtaacggtttaacccgtaaacggttaccgttacccggttttacggcccggttcgggtaaccggggg

SEQ ID NO: 76762 - DNA, 258 bp, Homo sapiens
  misc_feature: GYAE6OF01D2XSB.8.34.D01.1.454.CMB.1.raw
  modified_base (249)..(258): a, c, t, g, unknown or other
  misc_feature (249)..(258): n is a, c, g, or t
tcagctcgcgtgtccacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctcgagagcacagccggccctgggctgcctggtcaaggactactccgacacgcgagctggaggcgggctggacaaggcgacatagnnnnnnnnnn

SEQ ID NO: 76763 - DNA, 709 bp, Homo sapiens
  misc_feature: GYAE6OF01BI66N.8.34.D01.1.454.CMB.1.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagccaccctctcctgcaggccagtcagaatgtggcncctacgtatcctgtaccaacagaaacctggccaggcctacccgacggcccctcactctatggtgaccactccgaaacgcgggaccacgtcggaccactcccagcccgtaggttcaggtcggcgtagggtaggggtagtaggggactacggtaccttacgaccttactccaacctactacctacttccgaacggtcccgtagggaccgtacccggtaggaacgggtattcggttacgtaccgttaagtttttaacttaccgtttaggtacctaaacgttacgtaccggttaaccggacggttaccgggtccccgggttcccgggggtaaccctttaccgggtttccccgggtacccgggtacgggtaaacccgtaaaggttcggtaaacgttaacggtaaccgtaaacggtaacggttcggtacggtacgtacgaccgtacctattccgttctccgttctcccg

SEQ ID NO: 76764 - DNA, 871 bp, Homo sapiens
  misc_feature: GYAE6OF01CLCRF.8.34.D01.1.454.CMB.1.raw
  modified_base (212)..(212): a, c, t, g, unknown or other
  misc_feature (212)..(212): n is a, c, g, or t
  modified_base (254)..(254): a, c, t, g, unknown or other
  misc_feature (254)..(254): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccgaccggagagattgtgttgacacaatctccagccaccctgtcttcgtctccgaggggaaacncgccaccctctcctgcgacgggccagtcagtaatggttggcnccgtacgtatccttggtaccaacagaaccgtggaccacggcctacccgacggcccctcaacgtctaactgggtactccaacgtacccgaaacgacggggtaccccaacgtcgggacctaaccgtcccgaagtaccccgtaggtttaccgaggttcgggaccgtagggttacggggtaacgttacgggggaactaacgggtacctttaccggtacctttaacccgttccaaccctaacggtttacccaacgttaccgaaccgtccggtacgtaccggaccgttacggaacggttattcgggtttacgtaccgtttaagttttaaccgtttaccgtacgttaaccgtaaaccttaacggttacccggtaaaccggttcgggttacccgggtaacccggggttcccccgggggggtaaccctttaacccggggtttacccccgggttaccccgggttaaaccgggtaacccgttaaaacggggttaccgggtaaaccgtttaacggtaaacccggtaaaacgggttaaccggttacgggtacccggggttacctaacggggttacccaaccccgtttaagttacccggtttaaccgttcccgtttacccgtttaaccccg

SEQ ID NO: 76765 - DNA, 787 bp, Homo sapiens
  misc_feature: GYAE6OF01B1X6O.8.34.D01.1.454.CMB.1.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
tcagctcgcgtgtccacgaccggtgctcgatttagatcgtctgtgttgggtttgggggaggaactgctcagttaggacccaggagggaaccatggaagccccagctcagcttctcttcctcctgctactctggctccagtttcagataccacggagagattgtgttgacacaatctccacgcccacctgttcttcgtctaccgaggggaanacgccaccctctccngaccgacgggccagtcaagtagttggttcggccgtccgtaacgtactccgttacggaacccaacgaacgaaaccgtcggaccgacgggccctacccggaacccgcccctacacgtactacgtggtacgaccacctaccgaacggcggacccgtacgtcggactacctacccgacggaccgtaggtccgacggggttaggcgtaacggggtaggggttacgtaacgggaccgtacggtaccttcgtaacccttaccgtaccaacgtacttacaccgttaccgaccgttccggtacgggtacgtacccggtaggtacgggttaagttcggttacggttactttaaggttttaccttaacggtcgtaacctaacgttagttacccgggtacggttaccgggtccgggtaccccgggtacccgggggttacctaccccgggttttccgggacccgggttacggaaaccggttaaggtacgttacgtaaaccgacgttaaaccggtggttaccggacgttcggtaccgtaccctacggttaccttacgtctttaccgtcttccccg

SEQ ID NO: 76766 - DNA, 719 bp, Homo sapiens
  misc_feature: GYAE6OF01A6U95.8.34.D01.1.454.CMB.1.raw
  modified_base (251)..(251): a, c, t, g, unknown or other
  misc_feature (251)..(251): n is a, c, g, or t
  modified_base (362)..(362): a, c, t, g, unknown or other
  misc_feature (362)..(362): n is a, c, g, or t
tcagctcgcgtgtccacgaccggtgctcgatttagatcgtctgtgttgggtctgggagaggagcccagcactagaagtcggcggtgtttccattcggtgatcagcactgaacacagagactcaccatggagtttggctgaacgttgggttttcctcgttgcttcttttaagaggtgtccagtcgtcaagtgcaactggtaggagtcgtggggagtcgtggtccagccgtagggagtcacgagacgtcttcncggtgtagcgacgtccttgttacggttcctaaccgttcaacggttaacgtcggactagtcgacctacggtcggtacccgacaagtccgttaccgaaggaccgtaaagggtntttacgggcggtagggtgtacgtagttttcgttacaacgttcggtggacggtctaaggttgttacgaaagttggtacgtacgtcgacggttaaccgtcccgggtaaagacggttaaccgtacgttacgaccgcttactaccgtaagaacgtaactaacgtaccgaacgaacttagtaacgtgttaagtacgagtaccgtagaacgtaccgtacaacgttacgagtacggacctacggacttaacgtacgtaaacgtacggtaacggggaaaggtaccggggaaacgtcgggtaaccggtaacgtttaacccgtaaggtttacccgtaggttaccggttacggtccggtaacccgggg

SEQ ID NO: 76767 - DNA, 760 bp, Homo sapiens
  misc_feature: GYAE6OF01CVARF.8.34.D01.1.454.CMB.1.raw
  modified_base (206)..(206): a, c, t, g, unknown or other
  misc_feature (206)..(206): n is a, c, g, or t
  modified_base (258)..(258): a, c, t, g, unknown or other
  misc_feature (258)..(258): n is a, c, g, or t
  modified_base (320)..(320): a, c, t, g, unknown or other
  misc_feature (320)..(320): n is a, c, g, or t
  modified_base (403)..(403): a, c, t, g, unknown or other
  misc_feature (403)..(403): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccgacggagagattgtgttgacacatctccagccacctgtcttcgtctccgagggaaancgcccaccttctcgtgcgacgggcctagtcagaactggttagcgtcctagtntcccgaggtaaccaacgaacgaacccgtggacccacgggtcctacccggaccggtcccctanaacttccgtaagtcgggtacgtcaactacccgaaacgacgggaccctaggtcggacaccgtaccccgagtacccgtagggtcncggttagggccgtaaggttcggggaacgtcgggtaactacgtaccgtttacaacccgtttcgaaccctaacgtataccgtagtaccgtaaccgtccggtacggaaccgtccgttagggagttacgttgggtactacggtttaagtttacttacgtacgtaaccaacgttcgaacgtacgtaggtccggtacccgggtcccgggtactacccgggttccgaccggttacgggaaaccgtaaacggtcgttaaaccggttaccaaacccgggtaaaacgttcggttcccggtaacgtcccggtaacgtaccccgtaaccgtttctacggttaacccttcggtttaacccttaaccccgg

SEQ ID NO: 76768 - DNA, 902 bp, Homo sapiens
  misc_feature: GYAE6OF01AQDQX.8.34.D01.1.454.CMB.1.raw
  modified_base (578)..(578): a, c, t, g, unknown or other
  misc_feature (578)..(578): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccagtggtaggtttggctgtaacttgggttttcctcgttgtcttacgttttaagaggtcgtcctagtgtcaagtgacgtaacgttgggtggaggtcggtggggggacggtcggtcggtccgaggtccggttaggggacggtacaacgaggacgtaccgttcgttcggtggtcgtacgacgtcccgttcgttcgggttacctaccgttacgtaacgtaaccgtacggctacgtcggtaccgtacggtccgggtacccgaccgtaacgtccgtaccggaggacggtaacggggtagttaggggtaacgggttcgggtaacggtcgtttaggttttacgtttacgtacgttccggtacgggtagggtaccgttaggttacgttacgtaaggttcggtaagttcggacgtacggtaccggttacggacgggtaaccggtacgttaactacccgtaacnccgggttaccgtaacggtaacgaaacgttaccgttaaaccgttaacccggaacgggtaaaccttaggtaacgtttaggttaaccgttagggaaccgttcggaaacgtaacctaccggtaccggttaacgtaccgaacgggttaaccgggagtacccggttaataaccggttaccgtaaacggggttacgggggaaaaccgggtaacggggggtaaacccggggtaccggtcgggttaaaaccgggtacccgtttaaaccggttacggttttcccgttaaaccccgggttggggttaaaccccgggttcggggtaaccccggggg

SEQ ID NO: 76769 - DNA, 765 bp, Homo sapiens
  misc_feature: GYAE6OF01BDIRV.8.34.D01.1.454.CMB.1.raw
  modified_base (174)..(174): a, c, t, g, unknown or other
  misc_feature (174)..(174): n is a, c, g, or t
  modified_base (404)..(404): a, c, t, g, unknown or other
  misc_feature (404)..(404): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacgttgggttttcctcgttgcttcttttaagnggtgtccagtgtcaagtgcaacgtggtggagtcgtgggggagcgtggtccagccgtggggacgtcacgagacgactctcgtgtcgccagtcctgttcggttcctaccgttcaagtaacgtcggcagtgaccgacgttcggggtcccaccaagcctacgaggacaagggtacttgggaaggtgggtcggtactaggtttcgttcagtcgtggacgggtcgtagttcgttanaacgttggtaatcgacgacggtaccgtccggaggaacgggtcctaacgttcccaacgtacgtaccgttaccgaacggtaacgaaccgttaaacgttacccgaaacgggtaaacctaacgtaaagttacgttaacggtttcggaacgtaaccgtaacggtaaaccgtaacggttacccgttaaacgtccggttaacggaaacgggtaacccggtacgggtaccgttaaacggtaccggttaaaccgtacgggttaaacggggaaacgggggtaaccggggtaaacggcggggttaccgggtaacgttaccggaacgtttaccgttacccggtttagggtaacccgttcgggtaacccggggg

SEQ ID NO: 76770 - DNA, 981 bp, Homo sapiens
  misc_feature: GYAE6OF01DPEGD.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccagtgggtagttgggctagtaacgttgggttttcctcgttgtcttacgtttaaggtaggtacgtccgtagttgtacgaagtcgacgtaacgttgggtaggtaggttcgggtaggggggtacggtccggttcggtacccgacggtcccgggttagggggtacggtaccgaacgacggtacgtaccgttcgttcggttcggtacgtacgtaccggttccgttacggtttccgggtttaccctaaccgtttacgtaaccggttaaccgtaccgggtacctaggtttccgacccggtaccggttcccgggtaacccgtaacccgtaaccggtcccggtaccggtaacgggaaccgggttaagggttacgggttagggttacggggttacgggttacgggttcgttttacggttttcgttaaccgttacggttaccggtacggggtaaccggggttacgtttacggtttaccggttaaagtaacgggtttaacggtaggtttaccggaaccggtttaacccgggttaccgggtttaacccgggtacggggttaaacccggttacccgttaacggtttaacccccggtaacccttaccgttaaccgggttaacccggaaacgttaaccgggtaaccctacgggttaaacccgaataaaccgttacgttaaacgttacggtttacggttacggtacgttaaccggaacgtacccggtaacgttacccggtaacggtccggttaacgacgggtaaccgttacgggtacttaacgtacggtaaacgtacggggtaacgggaacgggtacggtacgtacggcgtaaccgttcgtaacgttaccgtagtcggtcggtggtacccggg

SEQ ID NO: 76771 - DNA, 890 bp, Homo sapiens
  misc_feature: GYAE6OF01D8W3Q.8.34.D01.1.454.CMB.1.raw
  modified_base (355)..(355): a, c, t, g, unknown or other
  misc_feature (355)..(355): n is a, c, g, or t
tcagctcgcgtgtccacgaccggtgctcgatttagatcgtctgtgttgggtcgtgggagaggagcccagcaactagaagtcggcggttgtttccattcggtgatcagccactgaacacagaggactcaccagtggagtttggctgaacttgggttttcctcgttgtcttacgttttaagaggttcgtcctagttgtacaaggtgacaacgttgggtaggacggttcggtggggggacgtcggtcggtccccgaaggtcccggtggggtacggtcgaacgaggacgtaccttcgttccgtggtcgaccacggtcctcgttacggttccctaccttacgaacgtaaaccgtaccggnagtcgcctaccggtcggtaccccgacaacggtccctacggaacgggtacgaacgggggtacgtttaggggagggttggggtacggacgttttacggtttttcggtttacccaaggtttcccggtaagggaccggggtactttaggtttacggttaaccttaaagggtttcggttacgtacggaccggtaaccggtccgtttaacccggggtagggaaaccccggggtcccgttaaccgttaaccccgaacccgttaaccgttccgtaaaccccggtaaaggtaaacccgaaaccgttaaaccgtttaccccgaaagggtaaacccccttaagtaaacgtttaccggttaagtttacgggtaagtaccgtaacggtaacgtaccggtaccgttaaccgtcgtaacgggacgtacggacgggtacgtacgttaacgaccggtaaggtaaacgggtaacgggaggggaacccgtacgggacggttaccgtaacgtaccgttacgtttacccggttcggtacggtccggtaacccgggg

SEQ ID NO: 76772 - DNA, 1015 bp, Homo sapiens
  misc_feature: GYAE6OF01EKYAK.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggtaggtttgggctgaacttgggttttcctcgttgcttcttttaagacggtgtccagtgtcaagtgcaagtggtggagtcggtgggggagcgtcgtccaggcccgtaggggacgtcaacgaggacgtacttcgtcgtgtcgacctacgtcccctggtttacgggttccctaaccgttttacgaacggttaaaccgtaccgggactaggtccggaccgtaccgggtccggggttccccgacctaaacggtcccgttaacccggaagggtaccggtaaaggggtagtttacgggggtaacggttggggttcggtacctttaaggtttttaccggttactaacggttcggtacgggtacgggttacgttaggtttaccggttagttaaggttacggttaacgtacgggtacccgtaaaccgggttacccggttaaccggggttaaaccgggtaaccgggttacccccgtttaacgtttaacccccgtaaacccctacgtttacccccgtaaaccgggtaaacgtaaaccgggttaaacccttaaaacccgggttacccgaaaacgggtaaaacctttaaacggtttaagttttacggttaaacggtttacgggtaacccggttaacgtaacccgggtaaacttaaccccgggtaaccgtttaccgggtaaccgggttacgggaaacccgggttacgggtaacccggttaaccgttaaacggttaaaccggttacgggtaaacccggggttaaaacggggggaaccgggggtaaacccggggttaacgggtaaacccggggttaacggtttaacccggttaaacccgggtttaacggtttacccggttaaccggtttaaccgggttcccgggtacggggtaaaccccgggg

SEQ ID NO: 76773 - DNA, 858 bp, Homo sapiens
  misc_feature: GYAE6OF01E3QTO.8.34.D01.1.454.CMB.1.raw
  modified_base (273)..(273): a, c, t, g, unknown or other
  misc_feature (273)..(273): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaacttgggtttcctcgttgctattttagaggtgtccagtgtacaagtgacaacgtgggtggacggttcggtggggggaggtccgttggtacccgaggcccgtaggggacggtcacgacggagtcctcgtcggnggttcgccgaacgtcccgttcgtcgggggtttcccaacccgtttacgtaacggttaaaacccgttacgggacctacgttcggacccgtaaccggttcgggtccccggaccaaacggtcccgtcccgaagggtaccgtaaagggtaggtttgggtaacgggttcgggggtttcggaccgttaaggttttcggttttaccgtaacgttccgggttacggaacggggacccgttaaaggttcggtttacgtaaaaggttgggttaaacttcgggtaacctaaccgggtaaccccgttccgggttaacggggaaccgggtaccgtaacgttacccgaacccttacgtaccgtaccgaacgtacgtaactacgttaaccagggaactaacgagtttacgttaagtttacggacgtactaacgaacgtacgtaccgttaacgtacgtagggtaaaccggccggtaacggtacttaacgtaccgtaaggtacgggtaaacgggaaacggggacggggaaaccgcgggtacccggtaaacgtttaccgtaaccgttaccgttacccgttacggtcccggttcggtaaccgggg

SEQ ID NO: 76774 - DNA, 867 bp, Homo sapiens
  misc_feature: GYAE6OF01BT370.8.34.D01.1.454.CMB.1.raw
  modified_base (176)..(176): a, c, t, g, unknown or other
  misc_feature (176)..(176): n is a, c, g, or t
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagctcgcgtgtccacgaccggtgctcgatttagatcgtctgtgttgggtctgggagaggagcccagcactagaagtcggcggtgtttccattcggtgatcagcactgaacacagagactcaccatggagtttggctgaacttgggttttcctcgttgcttcttttaagaggttntccagtcgtacaagtnactaactgggtgagtcgtagggggngtcgtgtccagccgtgggacgtcacgagacgactcgtcgtagtcgctacgtccgttgttcgggttacctaccgtttacgaagttaaccgtacggcctagtcggacctaccggttacgggtccccaactaaggtccctacccggagggtaccggtaaaacgggtggttcggggtaacgggttcgggggtacggtcgtttaaggttttccggtttaacacgtttcggtacgggaggggtcttaacgggttgtttaaccaaggtttcggtaactcgaccgtaacggttacccgttccggggtaaacggtacggggttcccttaacgtttaccccgaacccgttaagttaccccgtacgggaacgtaaacgggtaacctaaaccgttaccccgggaaacggtaaaccaacgtttacgtttaggtttaacggttcggtaacctaccgtaacggtaaccgtaacgtaccccggtttaaacgtccggttaagggaaccgtaccgggtacgtaacgttaactaccggttaccgtaagggtaaaccggggacgggtaaaccgggggaacccgtaccgggtaacgggttacccgtaacccggttaaacggttaccccggtttaggttcccgggtaacgggtccgggttaaccccgggggg

SEQ ID NO: 76775 - DNA, 809 bp, Homo sapiens
  misc_feature: GYAE6OF01B37VS.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagttggctgaactgggtttcctgttgcttcgtttaagaggtgtccagtgtcaagtgcaacgtggtggagtcgtagggggagccgtggtccagccgtaggggagtcaacagtagactcgtcgtgtgccagcctcgtcggttaccacctttcaagtaaccgtacggcaagtcgacacgtggggtccccaccaaagccctaccgaggccgtaaagggagtttaggggacggttggggtaagccgttaaggttttgttttccgaaagtttccgtaagggacggggtacttaggtttcgggttaaactaaagggtcgggtttatacggacgtaaaccggtaacccgttcccgggttaagggaaaaccgggggtcctaacttaccgaaaccctacgtaccgtaccgaagaacgtaaacctaaaacgtttaccgaaacgggtaaaacctaaaagttcgttaacgttagggaacgtacgtaacgtaaacgaaccgtaccgttaacgtacccggtaggaaaccggaccggtaacgggtacctaagttaaccgttacgaacgggttaacgggaaaacgggggaccgggggaaaccgtaaggggtcccggggaaacggttttaaccccgtaaacggttaacccttacgggttttaaccgccgggtttaaccgggtcgggggtaaccccgg

SEQ ID NO: 76776 - DNA, 814 bp, Homo sapiens
  misc_feature: GYAE6OF01DIGUG.8.34.D01.1.454.CMB.1.raw
tcagctcgcgtgtccacgaccggtgctcgatttagatcgtctgtggttgggtttgggggaggaactgctcagttaggacccagagggaaccatggaagccccagctcagcttctccttcctcctgctactctggctcctagtttcagactaccaccggagagattgtgttgacacaatctccacgcccacctgtcttcgtctaccgaggggaaacgacgcctaccctctcctgcgacgggctagtcagtatcggttggccgtacctacgtactccgtacggtaaccaacgaacgtaaccgtgggacccacgggtccctacccgaccggggtcccccctacgtacttccgtaacgttagggtcgactaacgtacccgaaacggacgggaccgtaaccgtcgggcctaacctaccccgacgtaccgtacggtaccgtaggttcggacggtagggttacggggtaagtacgggtaacgtacggtaccgttacgtaccgttaccctacctaaccttacgtactaccgtaccgaccgtacccggtaggtaccgttacccgtagggtaacggtactttcggtttacggtacgtttacggttttaacgtacgtttacgtaaccgttaacgttaccgtaccgttaccgggtacggttcccgggtacccgggttcccggggtaacccgttcccggttttaccccggaccgggtaccggtaaccggtaacgggttacgtaacggtaacttaaaccggaacggtaacgttcggtacggtccggacttaccgaccttaagttccgttacttacctccgtttacccg

SEQ ID NO: 76777 - DNA, 969 bp, Homo sapiens
  misc_feature: GYAE6OF01C6G6C.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctagtaacgttgggttttcctcgttgcttacgttttaaggaggttgtcctagtgtacaagtgacaacgtggtggaggtcggtgggggaggcgtgactccgaggccgtggggtagtcacgagacgactcgtcgtgtgcgacgtcctcgttcgggttccctacctttacgtaacgtaaaccgtaccggacagttcgacccgtaccggttccggggaccccgaaccgaaggcccgtaccggaacggtaccggaaggggttaggttacgggggaacgggtttgggggtacggtaccggttacggtttttcgttacgtacggttacggttacggggacggggtacggttacggtttacggttttaaacgtaacgggtttgggttaacgtacggtaaccggtaaccggttcccggtttaaaccggggtacgggtaaccccggggtaaccccgttaacccggtttaaccccctaaacccgttaacgttacccccgttaaccggaaaccgggttaaacccggttaaacccgtaaaccggtttaacccggaaaaccgggtaaaccctaaaccgttaaaagggttttcggtttaaacgggttttacgggaacccggttaacgtaaaccgtaacccggtaaaccgttaacccgggttaccggttaccggtacgggtaacgggtacccgggtaacggggttacccttaaaggttaccccggtaaagggttaccggggtaaaacgggggaaccgggggtaaacgggggtaaccggacggggtaccgggttaaccgttaaccggttaacgttaccgtttacggttcccgggtacgggttcccggg

SEQ ID NO: 76778 - DNA, 869 bp, Homo sapiens
  misc_feature: GYAE6OF01CO99R.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggtagtttgggctgtaacgttgggttttcctcggttgtcttacgttttaagaggtgtccagttgtacaagtgactaacgtgggtggtagtcggtagggggaggtcggtcggtccaggtcccggtggggacgtcgaacgagaacgaccttcgtcgtggtacgcgtacgtccgttcggttcgggtacctaccgttacgtaacgttaaaccgtaacggctaacgtcgaccgtacggttccgggacccgtaaccgaacgtcccggttacccgaagggaccggtaaaggggttacggttaggggtacggggttaggggtcgggttaacttaacggttttcggtttaacccgaagttacggtacgggtaacggggtactagggttcgttaacgtaaaggtttcgggtatacggactaaggtaccgttacggacggacgggtacctacgttacgtaccgtacgtaccgtacgaaacgtaacgtaaccgtaacgttaaccgaaacggtaaacctaacgttaacgttacggttaacgttaaccggtaacgtaaacgtaacgtaccggtaacctttaacggtaccgtaacgggaacggttaacgggtaaccggttacgtaaacgttacgttaaccgggtaacgggttaaacgggaacggggtaaacggggaacgtaacgggacgggttaccgttaaacggtacgttaccgttaccggttacggtaccggtcgggtacccgggtaacccggg

SEQ ID NO: 76779 - DNA, 817 bp, Homo sapiens
  misc_feature: GYAE6OF01CGMI3.8.34.D01.1.454.CMB.1.raw
  modified_base (188)..(188): a, c, t, g, unknown or other
  misc_feature (188)..(188): n is a, c, g, or t
  modified_base (461)..(461): a, c, t, g, unknown or other
  misc_feature (461)..(461): n is a, c, g, or t
  modified_base (493)..(493): a, c, t, g, unknown or other
  misc_feature (493)..(493): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccagtgggtaggtttgggcttggtaacgtttcgggttttcctcgtttgtcttacgttttaaggnggttcgtccgtaggtcgttacgaaggttcgacgtaacggttgggtagggtaggttcgggtgggggggaggtcggttcgggtccgacggtccggtggggtacggtccaacgaggacgtaccgttcggttcgtggtacgcgacggtcccgttcggttacgggttaccctaccgttacgaacgttaaccgtacggctagtcgaccgtacggtcgggtcccacgtacgccgtacgaggacgagggtagtgggaggtggtcgacttggttcgttacgngttcgaggtacgcgtagtcgttatagtggtanacggactagtaccgtcgggtacggaccgggtcttacttaccgactcttaaccgacgtaagtaacgtaactaaccgtacggaacaaacctagttaacggttagttaagttggaacgtacgtagtaaaccgtagtacccggttaagtccggaacgggtaacggtaccgttacgggttaacctaggttaaccggtaaggttaaccgggggaaaacgggtaccgggggggtaaacgggaaccggtcggggttaaccgggtaaccgttaaccggtaaaccggtttacgttaccgggttaacggggtccgggttaccgggtacccggggg

SEQ ID NO: 76780 - DNA, 844 bp, Homo sapiens
  misc_feature: GYAE6OF01BD7AK.8.34.D01.1.454.CMB.1.raw
tcagctcgcgtgtccacgaccggtgctcgatttagatcgtctgtgttgggtctgggagaggagcccagcaactagaagtcggcggtgtttccattcggtgatcagcactgaacacagaggactcaccatggagtttgggctgtaacgttgggttttcctgttgcttacttttaagaggtgtccagtgtcaagtgacaactgggtggagtcgtgggggaggcgtggtccaggccgtagggaggtcaacagagcctcgtcgtgtgcacgtcctacgttgggttacctacctttaccgaagtaaccgtacggacagttcgccgtaccggtcggggtacccaccgaacgcctaccggacgggtacgaaggggtagtttaggggagggttcggggtaggtacgttaggtttttcgtttacgtaacgtttcggtagggaaggggttcctagggttttgttaacgtaaggttcgggttaagtcggaccgtaacggtaccgttacccggggtaagggtaacgggttaccccgtaacttaccggaaccctacgtaccgtaccgaaaggtaaccgtaaaccctaacgttaacccgaaacgggtaaaccttaaacgtaaacggtttaggtttacgtttacgggaactaacgtttaacggaaaccttaaccggtaaccgtttaacggtacccgtaagggaaccggtaaccggtaccgggttagttaaccgtacggtttacgaaacggggttaaacgggaaggggggtaaacccgggggaacggaacgggttaccgggtaacgttaacccgttacggttaacgttaccgttacgggtcggttaccgggtaccggggg

SEQ ID NO: 76781 - DNA, 893 bp, Homo sapiens
  misc_feature: GYAE6OF01CMT62.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccagtggagtttcggctgtaacgttcgggttttcctcgttgtcttacgttttaagaggtcgtccagtgtacgaagtgacgtaacgtggtaggagtcggtgggggacgcggtcggtccgtacggccggtagggacggtcaacgagtacgtacctcgttcggtgtcgacgtcgtccttcgttacgggttacctaccgtttcgaacgttaaccgtccggtacctaagtcgtaccgtacggtcgggtacccgaccgaacgtccctacccggaggaccgtaagggttcgttagggacggttagggtcggtaccgtttaaggtttcgtttaccgagttaccggtagggtaacggtcgttacggttacgtttacgtaaacggttacgggttagtacggtaccgacggttaacccggttaccggtaagggtacccgggtaccttacgttaaccgaccgttacgttcgaacgacgtaacgaaccttaacgttccgaaaggtaacctaacgtaggtttagttaccggttaacggaacgttaccgtaaagtaaccgtaacggtacccgttttaaacggacctttacggggaaaccggtcccgggtaacgggttaccttaaacgttaaacccggttccgggttaaacgggaaaccggggtaaacggggggtacccggggtaaacccgtacggggttaaccccgggttaagttaacccccgttaagggtttaccccgggtttacccgttaaggggtcccggttaccggggtttaacccgggg

SEQ ID NO: 76782 - DNA, 978 bp, Homo sapiens
  misc_feature: GYAE6OF01A5VOT.8.34.D01.1.454.CMB.1.raw
  modified_base (176)..(176): a, c, t, g, unknown or other
  misc_feature (176)..(176): n is a, c, g, or t
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagactaccaccggagagtattggtgttgacanaatctccagccaccctgtcttcgtctccgaggggaancgccaccctntcctgcagggccagtcagtacgtggttacgcgtacctacgtactccgtaggtacccaaacgagtaaaacccgtcggacccgagggccctaccccggacggtcccccccttacgaacgtccgttaagttcggggtaccgacctaccttaccgaaaaccggtacgggggtaccccaccggttaccgggcctaacccgtacccccgtacgggacccgttaaacgggttttccgacgggggtaccggtacccgtaagggggtttacgggggggtaacttccgggggaaacctaacgggtacccgtttaacccgtaccggtttaccctaaccgacccgtaacgttcctaacgttacccgacgggtcccgggttacgggaaccgtttaccccgggtagggttaaaccgggttacgtttacgggttaacggttacgtttaaccggggtttttaactttacccggttacggtaaccttaaacggtaacctttcccggggtaaccgggttacccgggttaacgggtccccccgggggttaccccgggggttacccctttaaccccgggttttcccccggggtaaccccggtttaacgggggaaaacccccggtttaaagggtaacccgggttaacgtaaccccggtttaaaaaccgggaaccgggttaaaaccggtttccggggttaccgggtaccgttaccggtaacccccggtaacgttaaaccgttccttttaccggttcccgttaacccgttttacccgg

SEQ ID NO: 76783 - DNA, 763 bp, Homo sapiens
  misc_feature: GYAE6OF01A92YR.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgcccaccctctcctgcagggccagtcagaatggttggccgcctacgtactccgtcggtaaccaacaacgaaaccgtcggaccgacggcctcccgaccggtccccctacactctagtggtcgacacgtacccgaacgacgggccctacgtcggacctaccgtaccccgacgaccgtacggttacgaggtcggaccgtagggtaggggtacggtacgggtaacgtacgtaccttccgtactccgtacccgacctactacgacttccggacgtccggtacgggacgttccgtagggaacggttagttcggtttacgaccttttaaggttttaccttacggtacgtaccgtaacctacggttacccggtacgggacgggttcccgggtccccggggtccccggggttacccttacccgggtttcccgggtaccccgggtacgggtaaacccttaaggggtctaaacgtaacggttaaacccgaaacggttacgtgggtaccggtaccgtacgacccctaacccgttatttccggttcttacccttccgttacccg

SEQ ID NO: 76784 - DNA, 768 bp, Homo sapiens
  misc_feature: GYAE6OF01CC2GQ.8.34.D01.1.454.CMB.1.raw
  modified_base (178)..(178): a, c, t, g, unknown or other
  misc_feature (178)..(178): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgtcttactttaagaggtntccagtgtcaagtgacaacgtggtggagtcggtgggggagcggtggtccaggccgtggggagtcacaggagacctcgtcgtgtcgcacgtcctcgtcgggttcctaccttcgtaaacgtaacctacggctagtcgacgtaccggttaggggtccccaccgaacggtcctacccggaggtaccggaaaggggtcttggggacggtggggtagcgttaggtttgttacagtcgtggacggctagtaggttacgaagttggtatcgacgtaggtaccctaccgggtaggaccgggtcctacgttacccaaccgtacgtacctacccgaagtaacgaactaaccgttacccgaacgtaaacctaacgtaacgttaggtttaacgttacgggtactaccgtaacgtaaccgtacgtaaccggttaaccgttcggtaacggaccggtaacggtaccgggtacgtaaacgttaccgttaacgggtaacgggtaacggggaaaacgggggtaccggggaaacggtaggggtaccggggttaaacttaccggtaaacgtacccgtttacggtacggttaccggtcggggtaacccgggg

SEQ ID NO: 76785 - DNA, 684 bp, Homo sapiens
  misc_feature: GYAE6OF01DBCFE.8.34.D01.1.454.CMB.1.raw
  modified_base (171)..(171): a, c, t, g, unknown or other
  misc_feature (171)..(171): n is a, c, g, or t
  modified_base (175)..(175): a, c, t, g, unknown or other
  misc_feature (175)..(175): n is a, c, g, or t
  modified_base (338)..(338): a, c, t, g, unknown or other
  misc_feature (338)..(338): n is a, c, g, or t
  modified_base (398)..(398): a, c, t, g, unknown or other
  misc_feature (398)..(398): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcacatggagtttgggctgaacttgggttttcctcgttgcttctttaagnggtntccagtgtcaagtgcaagtggtggagtcgtgggggagcgtggtccagccgtggggagtcacgagagctcgtcgtgtgcagtcctcgttgggttccacctttcaagttaacctacggctagtcgccaggtcgggtcccaccaagcctaccgaggacgaagggtnttgggaggtgggtacggctagtttgttcagttcgtggaggtcagttgttcaagtggtaancgacagtacgtcgtagaacgggctacgtcacgactctacagacgaacgtacgtaccgaaggtaaccaacgtaagttcgtaagtttacggaacgtacgtaacggaaacgacggttacccgtaaacgtccgtaagggtaacggacggtaaccgggtagttaaactaccggttaacgtaacgggtaaaacgggtaacggggtaaacgggggaaacctacgggtaccgggttacgttaacccggtaacgttacccgttacgtttacgggtaggtcccgggttaaccgggg

SEQ ID NO: 76786 - DNA, 783 bp, Homo sapiens
  misc_feature: GYAE6OF01AS6EC.8.34.D01.1.454.CMB.1.raw
  modified_base (210)..(210): a, c, t, g, unknown or other
  misc_feature (210)..(210): n is a, c, g, or t
  modified_base (744)..(744): a, c, t, g, unknown or other
  misc_feature (744)..(744): n is a, c, g, or t
  modified_base (750)..(750): a, c, t, g, unknown or other
  misc_feature (750)..(750): n is a, c, g, or t
  modified_base (766)..(766): a, c, t, g, unknown or other
  misc_feature (766)..(766): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagactaccgaccggagagattgtgttgacacaatctccagccacctgtcttcgtctccgagggaaanagcccaccctcgtcctgacgacgggccagtacagtaatcgttggccgactacggtatccgtacggtaccaacgacgaaaccgtcggacccgtaaggtccctacccgaccggtaccccccgttactaccttaccgtaagttcgggtacgacccgtaacctaccccgtaaccggacgggtcccgaacgttaccgggacctacccgttaccccgaccggtacccgttacgggttaccgtaacgggtccggtaacggtacggggttacgggttaacggtaccggggtaccgtaacggttaaccctttcgtaacccgtttaccgtacccttaacccgaacttaccgtactaccggtaacggtcccggtacgggtaccggaccgttgggaacggtcgtttacggttcggtactttacgtttaatacgttcgtaactaacgtacgtcgtaccgagggttccggtacccggtccgggtaccttcccggttaccgggcccgtagggtaacctaaggtgtaacctcgtaacgaaccgtgtacgnggtccncgaccgtactacgttntcgttccgtcgttaccc

SEQ ID NO: 76787 - DNA, 687 bp, Homo sapiens
  misc_feature: GYAE6OF01AYLMM.8.34.D01.1.454.CMB.1.raw
  modified_base (213)..(213): a, c, t, g, unknown or other
  misc_feature (213)..(213): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (289)..(289): a, c, t, g, unknown or other
  misc_feature (289)..(289): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagactaccaccggagagattgtgttgacacaatctccagccaccctgttcttcgtcgtccgaaggggaaancgccaccctctcctgcgacgggccagtcagtatggtggccnctacgtntcctacgtaacacaagaaccgtggacgnggcctaccgacggtcccctcatcgtatggtgctacaccaacgcggaccncgtcggcacnccagaccgtacggttcaggtcggcgtaggttagggggtagtacgggaaccgtacgtaccgttttacaccgttcctacctaccgacttacaacgtcgaccggtacgtcgggacgtcggtagaagggttcttggtcgttacttagttttattactacgtactaacgtcgttacgtaccggtagttcccgggtccgggtacccgggtcccgttaccggttccgggacccggttaacgggaaccgtaacgggttcggaacgttaacgtaaccggtaaaccgtaggttacggcgttaccggacgtacccgtacttacgttacctttcttccgttacgttacccg

SEQ ID NO: 76788 - DNA, 789 bp, Homo sapiens
  misc_feature: GYAE6OF01EWB4A.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtacaagtgcaatggtggagtcgtggggagcgtggtccagccgtgggagtcacgagagactctcgtgtgcacgccttcgtgggttccaccgttcaagtaaccgtacggctatgacctacgtcggggtcccaccgtaaacgcctaccgaagggccgaaaggggtacgttggggaaggttggggtggtaccgttaggttttgtttcaagttcgtaggtaggggctaggttacgttagaaagttcgggttaatcgacgtaacgtacggttcccggtaggtaaccgggtccgtacgttacccgtaacccgtacgtaccgttaaccgaacggtaaacgtaaccgttaaacgttaacccgaacgggtaaaacctaacgttaaacgtttacggtttacggtttaaggtaaccgtacgtaacgaaacgtaaccggtaccggttaaccgttaccgtacgggtaacggtaaccggtaacggggtactaaacgttaaccgttacggtaaggtaaacggggaaaggggtaaccgggggaacgtaacgggtacgggtaacggttacccgtaaacggttacccgttaaccgtttacgggaacggttccgggtaaccgggg

SEQ ID NO: 76789 - DNA, 852 bp, Homo sapiens
  misc_feature: GYAE6OF01ERES1.8.34.D01.1.454.CMB.1.raw
tcagctcgcgtgtccacgaccggtgctcgatttagatcgtctgtgttgggttgggggaggaactgctcagttaggacccagagggaaccatggaagccccagctcagcttctcttcctcctgctactctggcctcccagtttcagactaccgacggagagtattgtgttagacacaatcctccacgccctaccgtgttccttcgtccgtaccggaaggggaaacgaccgtcccctacccgttcctccgtcggaccgaccggggccctaaggtaccgaaaggtaacgttcgggttacggcccgtacccgttacggttacctccgttaaccggtaacccaaacgaaaccgtaaacccgtcgggaccctaaccgggtccctacccgaccggtcccccttacacgttaccgttaggttcgggtccgtacctaacccgttacccgaaaacgggtccggggtaccctacggtcggaccctacctacccggaacgtccggttaagggtccagggtcggtacggtagggttggggtaacgtacgggaactacgtaccttacgacctccaacctacctactacaaccgtcgtaccgtccggtaagggccgttcggtaggtaacggttgttcgtaccgttaaagtttaggtttactacgtacgtactaaccgttacggtccggtaacggtccgggttaccgggtccccgggttacgggttccctttaccgggttcccggaccgttaacgggaaccgtaaggtcgttaaccgtaaacgtaaccgggaacgttacggttacggtcggtaaccgtaacgtcccgtaaacctttgttaccctttcgtaacccttcggttaaccccg

SEQ ID NO: 76790 - DNA, 952 bp, Homo sapiens
  misc_feature: GYAE6OF01E0BD3.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctgttgcttacttttaagaggttgtccagtgtacaagtgacaacgtggtggagtcgtgggggaggcgtggtccagccgtggggagtcacgagacgtactcgtcgtgtgccacgtcccttcgttcgggtttacctacctttacgaacgttaaaccgtaccgggctaagttcggacctacggttcgggggtaccccgaccgaaacggtccctaccgggaagggtacggtaaagggggtactttagggggaagggtttcggggtgggtacctttaagggtttttcgttttacaacggtttcggtacggggaacggggttccttaagggtttacggttaacgtaaaggtttcgggtaacttacggggtacccgtaacgggttacccggttacccggggtaggggtaaacccgggggttcccgttaacgttacccgtaaaccccgttaacgttaccccggtaccgtaaaggtaaaccggtaaacgttaaaccgttaaaccccggaaacgggtaaaacccttaaacgttaaacggtttaggttttaacggttttacggggaacgttaccgtaacggtaaaccggtaaccggtaaccccgtttaacgggttacccgtaacggggtaaaccgggtaaccggtaaccggggttaacttaaacgttaaccgttaacgggttaaacggggtaaaccggggtaaacgggggtaaccgggggaaaccgtacggggtaccgggttaacgttaacccggtaaacggtttacccgttaccggtttacggtaccgggttccgggtaacccggggg

SEQ ID NO: 76791 - DNA, 1033 bp, Homo sapiens
  misc_feature: GYAE6OF01EGSJU.8.34.D01.1.454.CMB.1.raw
  modified_base (374)..(374): a, c, t, g, unknown or other
  misc_feature (374)..(374): n is a, c, g, or t
tcagctcgcgtgtccacgaccggtgctcgatttagatcgtctgtgttgggtctgggagaggagcccagcactagaagtcggcggttgtttccagttcggtgatcagcactgaacacagaggactcaccagtggtaggtttggctgtacgttgggttttcctcgttgtactttacgttttaaggaggttcgtccgtagttgtacgtaagtcgacgtaacgtgggtagggtaggttcgggtggggggacggtcggtcggtaccgacggtccggtaggggacggtacacgaaggtacgtaccgttcgttcggtgtacgaccgtacgtccgttcggttcgggttacctaccgttacgtaacggttaaaccgtaccggntacgtcggtaccgtaccgggttacgggtaccccgaccgtaacggtcccgttaaccggaacggggaaccggtaagggggttacggtttagggggtaacgggtttcgggggttacggttaccggtttaggtttttccgtttacgtacgttaccgggtagggaacgggttacgttaagggtttccggttaaacgtaaggggtttacggttaacgttacggtaaccgtaacgggttacccggttacccggggtaaagggtaacccggggttacccgtttaacttaccccgaacccgttaacgtccccggtaaacccggtaagggtaaaccccttaaacgttacccggtttaaacccgaaaaggttaaaccctaaaccgtttaagttttaccggttaaccgttaacccggtaacaacgggtaaacccgttaccggttaaacccgtttaaacgggcccggtaacgggtaaccgggttaaccgtaaggggtttaaacccttacgtaaaacccgggtttagggtaaaccgggggaaaaccgggggtaaacggggggaaaccgggttaacccgggtacgggtaacccgggttaacgttaaccccggtaacggttttccccttaaggggtttacccgccggggttaagggtaccccggggtaaacccgg

SEQ ID NO: 76792 - DNA, 836 bp, Homo sapiens
  misc_feature: GYAE6OF01EIXP8.8.34.D01.1.454.CMB.1.raw
tcagctcgcgtgtccacgaccggtgctcgatttagatcgtctgtgttgggtttgggggaggaactgctcagttaggacccagagggaaccatggaacgccccagctcagcttctcttcctcctgctactctggcctccagtttcacgactaccgaccggagagattgtgttgacaacaactccgtccacgccctaccgttcgttccgttcgtcgtaccggaaggggaacgacgcccaccttcctacccgtggaccgacgggccctacggtaccgtaaggtaagttcggttacgggccgtaccgttaccggtacttccgtacggtaacccaaaacgaacgtaaaccgaccggaccggaccggtccctacccgtacccggaccccttccgtacttacgttagtccgggtacggtaacctaccgacccgaaccggaccgggtaccctaccggtccgacccgtaccgtaccccgacggtacccgtacggtacgtacgggaacggtcgtaacgggtagggtaaccggtaagggaccgtaacgttaccgttaccgtaccttccgtaacctaaccgtacttacctacgtaccggacgtacccggaaggtcgtacgtaggtaccgtgttagtaccggttactttacgtttacgttactacggtaactaacgtcgttaccgggtcggtacgggtcccgggtccgggttaacccgggtccgttaccgggtcccgtaccgggtaccgtaacggtacggtacgttacggaacgtaacggtaacggttacgtggtaccggtacgtgaaccccgtcgttaacgttccttacggttcccgtacttacccgg

SEQ ID NO: 76793 - DNA, 755 bp, Homo sapiens
  misc_feature: GYAE6OF01DDIZV.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccagtggtagtttgggctgaacgttgggttttcctcgttgtcttacgttttaaggaggtgtccagtgtacaagtgacgtaacgtgggtaggaggttcggtggggggaggcgttacgtccgacggccggtggggacggtcaacgacgacgtccttccgtcgtggtacgcctacgtccttcggttcgggttcctaccgtttcgaggtacgccgtacggctagcgcgtaccgtcgggtacccaccaaccgtcgaggacgtagggtagttcgggaggttgggtgcgttaggttcgtttacagttcggtagacggggttcctaggttagttacgtaaggttcggtatcgggtacgtcgggaacggtccgggtaagggtaccggtccgttacgtaccctaaccgtaccgttaccgtaccgaaacggtaacgaaccgtaacccgtaacggaaaccgtaactaacgttaaagttacgttaacgtttcgggaacttaacggaacgtacgtacgtaccggtacgttaggaaccgcggttacgttcgtaactacggtacgtaaggtaacgggaacggggacgggacgtacgggacggttacgtaccgtagttaccgttcgagttccggtcggacgggtaccg

SEQ ID NO: 76794 - DNA, 983 bp, Homo sapiens
  misc_feature: GYAE6OF01CSQTA.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagagactcacagtggtaggtttgggctaggtaacgtttcgggtttttcctcgttgtctttacgtttttaaggacggttgtccgagttgtactaagtgactaacgtgggtagggacgtcgggtgggggacgtcggtcggtccacggccgtaggggtagtaccaacgaggtaacgtaccgttcgtcggttgcggctaccgttccgttcggttcgggttacccttacccgttacgtaacgtaaccgttccggactacgttacggtacccgtacggttacggggtacccccgaaccggtaaccgtacccgtacccggtaacggggaaccggttaaagggggttaccggtttaggggtaacgggggttttgggtaccgggttaaccgttttagggtttttccgttttacggtagttaccgggtttaaggggacccggggttaacctttaagggtttaccggtttaagtaaacgggttttacggggtaagtccgtaaacccgtaaccgggttaccggtaccggggttaaacgggtaacccggttaccggtttaacccttaacccgtaacgtaaccgttacccgtacgaaccgtaaccgtaacctaaaccggttaccgaaaccgtaacctaaacggttaacgttaggttacggtttaacgggaacgttactaaacggaacctaacggttaccgtaaaccggtacggttacggaacgtaccgtaaccgggtacttaaccgttaaccgtacgggttaacgggtaaacccggggaaaggggttaacccggggaacgtaaacggggttaccgtaacggttaacccggttacgttttaccccggttacggtttacggaacggggttcccgggtaacccggg

SEQ ID NO: 76795 - DNA, 883 bp, Homo sapiens
  misc_feature: GYAE6OF01AMBK0.8.34.D01.1.454.CMB.1.raw
  modified_base (237)..(237): a, c, t, g, unknown or other
  misc_feature (237)..(237): n is a, c, g, or t
  modified_base (405)..(405): a, c, t, g, unknown or other
  misc_feature (405)..(405): n is a, c, g, or t
tcagctcgcgtgtccacgaccggtgctcgatttagatcgtctgtgttgggtttggggaggaactgctcagttaggacccagagggaaccatggaacgccccagctcagcttctcttcctcctgctactctggcctaccgtagtttcagactaccgaccggagagtactttgtgttagaccaactagtcctaccgagccctacccgttgttccttacgtcgtaccggaaggggaaacnccgtccctaccctcgttccgcggaccgacgggcctagtaccaaggtacgttcgttccgggcctaccgttaacggtccttaccgaacggtaaccaaccggtaacgaaccggttcggaccgaacggtccctacccggaccgtccctactagtcgttaacggtcggtaccnctacgttaccgaacggtaccgggtaccctagccggacctaacccgtaccgaaaccggttcggacggtaacctaggggtaccggttcgaaacggggtttacggaacggttaccgggaacgtaaccgttacgttaccccgtaaacctcccgttaacggaaccttaccggtacttaaccggtaaccgtgtacccggttagggtaaccgtccggtacgggtaacggttacgttagggtaaccggtttaaccgtttaggtttactaaaccgttaccgtacgtaacgttacggttaccggtaacgggtccggttccggtaacccggggttccgttaacccggttaccgggtacccgttacccgggtaaccggtaagttaacggtacgttaaacgtaacgttaacccggaaaccggtttacgacggttccgaccgtacccgaacgttacctacggtttaccgtacgtttacccaccggtttaccg

SEQ ID NO: 76796 - DNA, 995 bp, Homo sapiens
  misc_feature: GYAE6OF01EHXKK.8.34.D01.1.454.CMB.1.raw
tcagctcgcgtgtccacgaccggtgctcgattttagatcgtctgtgttgggtcgtgggagaggagcccagcactagaagtcggcggtgtttccagttcggtgatcagcactgaacacagaggactcaccagtggtagtttgggcttgtaacgttgggtttttcctcggttgtctttacgtttttaaggaggttcgtccgtaaggttcgttacgaaaggtcgacctaacggttgggtggtggttcgggtggggggaggtccggttacggtcccgtacggtccgttaggggacggttaccaacgacggaacgtaaccgtttcgttcggttgtcggactacggtcccgtttgtttacgggttccctaccgtttaccgaaacgtttaaccgtacggcctaagttcggtcccgtaacggttcggggttacccccaccgtaacggtcccgttaaccgggaagggaccggtaaaagggggtttgtttacgggggtaagggttcggggtacggtcgtttaacgggtttttccgtttacgacggttccggttaagggaccgggggttacttaaagggtttccgttaacgtaaaggggtttcggttaaacgcccggttaacgtaaaccggttacccggtaacccgggttaaacgggtaacccggggttaccgtttaccttacccggaacccgttattaccccgtaacgtaacggaacgtaaacgtaactttaacccgaacggttaaacctaacgtaacgtttcgtttaacggttacggtaacgttcgtaaacgaaccgtaccgttaaccgttaaccgggttccgtaagggtacggtaacggtacccgggttaacgttaagtaacccggttaggttaacggggttaaaaccggggaaaccggggtagggggtaaacccggaggggttaacccggaacgggtttaacccgtaaaccgggtttaccgttacgggtttacggtaacccggttcggggttaaaccccggg

SEQ ID NO: 76797 - DNA, 857 bp, Homo sapiens
  misc_feature: GYAE6OF01BT21O.8.34.D01.1.454.CMB.1.raw
  modified_base (216)..(216): a, c, t, g, unknown or other
  misc_feature (216)..(216): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgcctactctggctcccgagttttcagataccaccggagagattgtgttgacacaatctccacgcctaccctgtcgttcgtctccgaaggggaancgcccaccgtctctgacgacgggccagtcagtaagtggttaggccgacctacgtactccgtacggtaccaacgacgaaaccgtcggaccacggccctacccacggccccctacatccgtaagtcggtacgtaccgactaccgaaacggaccggggacccacggttcggacctaaccgtccccgaggtacccgtacggttaccgaggtcggacgtacggggttaggggtacgtaggggaacctacggttaccgttaccgtaacgttacccgtaccgtaaccgtaccgttacgtaaccgtaccggtaccggttacccggtaggggtaaccgttaccggtacgggtaaggtacggtttacgggtttacggttaacgtttaacggttttaaacttaaccgtttacgttaaccgtaaacgttaacggttaccgggttaaccggtacggggtacccgggttaccgggttaaccccgggggttaccctaccgggttttacccgggtaccccggttaaggggtaaacccgtaaacgggttaccggtaaaccgttaaccgtaacccgggtaaaaccgttaaccggtagggtacccgggtactaccgtacccgtaacccgtacttaccggttcgttaccttccgttacccg

SEQ ID NO: 76798 - DNA, 910 bp, Homo sapiens
  misc_feature: GYAE6OF01DSP7C.8.34.D01.1.454.CMB.1.raw
  modified_base (176)..(176): a, c, t, g, unknown or other
  misc_feature (176)..(176): n is a, c, g, or t
tcagctcgcgtgtccacgaccggtgctcgatttagatcgtctgtgttgggttgggggaagaggaagactgacggtcctgccacaggtggtgtttccattcggtgatcagcactgaacacagaggctcaccatggagtttgggctgaactgggttttcctcgttgcttcttttaagnggtgtccagtgtcaagtgcaacgtggtggagtcggtgggggagcgtggtccaggccgtgggaggtcacgagagcttcgtcgtgtgcacggccttcgtcgggttccaccttcaacggtaaccgtaccgggctaagtgaccgtaccgtcggggttccccgaccaaaggtccctaccgaacggacgtaaggggtagtttagggaacgggttggggtcggtacgttacgggttttcgttaccgtaagttccggttaggaggggtaccttaggttacggtttaccgaaagggtttggttacgtacgggtacgttaaccggaccggtttaccgggtaacgggacggggtacccgtacgtttacccgaaccgttaccgtaccgttacccgtaacggtaacgaaacccgttaacgttaaccccgggaacgaaacccgttaaacgtaaacgtttacggtttaagggttttaacggaacgttaccggttaacgtaaaaccgtaacccggtaacccgtttaacggttacccggttaaggtaacccgggaacccggttaaccggggtacccggtttaaaccgtttaaccgttaacccggttaaacggggtaaaccggggtaaacgggggtaaacccggggggaaaccggttaaccggggtacccgggtaaccgtttaacccggtaaaaccggtttacccctttaccggtttaccggggttacccgtaccggggttaaccccggggg

SEQ ID NO: 76799 - DNA, 795 bp, Homo sapiens
  misc_feature: GYAE6OF01DY6F6.8.34.D01.1.454.CMB.1.raw
  modified_base (144)..(144): a, c, t, g, unknown or other
  misc_feature (144)..(144): n is a, c, g, or t
  modified_base (331)..(331): a, c, t, g, unknown or other
  misc_feature (331)..(331): n is a, c, g, or t
  modified_base (413)..(413): a, c, t, g, unknown or other
  misc_feature (413)..(413): n is a, c, g, or t
  modified_base (475)..(475): a, c, t, g, unknown or other
  misc_feature (475)..(475): n is a, c, g, or t
tcagctcgcgtgtccacgaccggtgctcgatttagatcgtctgtgttgggttgggggaggaactgctcagttaggacccagagggaaccatggaagccccagctcagcttctcttcctcctgctactctggctccagtttcagntaccacggagaattgtgttgacacagtctccagtccacctgttcttcgcctccgaagggaaacgcgccctaccctcgtccgtgccacgggcctagttcttagtcttagaccgtaagttacgacgtacgtaaccaactaacggtaaccgtcggacctacggtcctaccccgaggtcctacccgttacncttactcctagtataacctaccaccgaacggtccggaccctacgtccggactacccgtcccgagacccgttggtttaaccgnggtacggacgtaggttggtacgtacgggacctaacgtcgtttacacccgtacgtccctaacncgttacctaactccgacgtccgtaagggtcctaccgggtagacgttaagttcggtaacgtacgtttaacgtttacgtttaccacgttaaccgtaacgtaccgttccggtaaccgtttcgggcccggttaccccgggttggtaaccccctttcgggttacccccgtccgggtaacggggacttaggggacccgtaaagtacccggtaaacggaaaccgtttacggtcggggttaccgacggttacccgacccgggtaaacccttcgggtttccccgtttaccgttcccttttaaaccggcccttccccgggttaacccccg

SEQ ID NO: 76800 - DNA, 904 bp, Homo sapiens
  misc_feature: GYAE6OF01BQAWZ.8.34.D01.1.454.CMB.1.raw
  modified_base (231)..(231): a, c, t, g, unknown or other
  misc_feature (231)..(231): n is a, c, g, or t
tcagctcgcgtgtccacgaccggtgctcgatttagatcgtctgtgttgggtttgggggaggaactgctcagttaggacccagagggaaccatggaacgccccagctcagcttctcttcctcctgctactcgtggcctccctagtttcagactaccgaccggagagtattgtgttgacactaatcctccacgccctacccttgttccttcgtcctaccggaaggggtaaacncgccccacctcctccgtgcgacggcagtacaagtagttcggtggccgtaccgtacgtactccgtacggtaccaaacgtaacgaaccgtcggaccgacggtccctacccgaccgcccctctacttacgtagtggacctcgtaacctacccgaaaccggcgggacccgtacggtaccggtacacccgtacccgacgtaccggttaggtaccgtagggtcgacgggtaggtacgggtacggtacggactacgtacttaccgtactcctacgactcgtacgactaccgacgtccggtacgtaccggtacgtagggtaacgtttacggttggttaccttaacggtttaactttttcgaacttttaccggaaaccttaaccggtttaccgggtacccggtaccggttaccccgggggtacccggggtttacccccgggggtaccccgggttacccgggtttttaccccggttaccccgggggaaacccgggttaacccggtaaccggttaaaccgggggtttaacgtaaacccggtttaaaaccccggttaaaccgggtaaacccgggttttacggacccggggtttcccgggaaccttacccggtaaaaccccggttacctttacccgggttttacgtttaccccgggtttttacctaacccccggttttccccccgg

SEQ ID NO: 76801 - DNA, 792 bp, Homo sapiens
  misc_feature: GYAE6OF01BJEF0.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaanagccaccctctccgtgacgaggggcccagttccaagtaatggttaggccgaccttacggatcccgtaggtaccctaagaacgtaaacccgtggacccaagggcccttcccgaaccgggtccccccttacaacttccttagttcggggacgcctaactaccgaacggacggggtacccaacgttcgggcctacttcccccgacggtaccccgtaggttacgacggtggaccgtagggtggggttaacgcggggtaacaggtaccttcaccgttaccttacacccgtattcccacttcgaccgtccggtaggaccgtcccggtaggtaggctttaggtcgtactttaacggttttactttaccggttataacccgtaagttaccgtacccggttaacgggtacgttcccggggtacccggttcccggggggtaccctttacccgggtttacccggtaccccggttacgggaaaccgttaacggtcggttaaacgtacccgtaaacgtaaaccggtaaccgttcggggttacccgtcgtacgtaccccgtaacctacgtttaaccgtcgttccgttcccgttaccc

SEQ ID NO: 76802 - DNA, 731 bp, Homo sapiens
  misc_feature: GYAE6OF01DAKUK.8.34.D01.1.454.CMB.1.raw
  modified_base (116)..(116): a, c, t, g, unknown or other
  misc_feature (116)..(116): n is a, c, g, or t
  modified_base (158)..(158): a, c, t, g, unknown or other
  misc_feature (158)..(158): n is a, c, g, or t
  modified_base (165)..(165): a, c, t, g, unknown or other
  misc_feature (165)..(165): n is a, c, g, or t
  modified_base (175)..(175): a, c, t, g, unknown or other
  misc_feature (175)..(175): n is a, c, g, or t
  modified_base (182)..(182): a, c, t, g, unknown or other
  misc_feature (182)..(182): n is a, c, g, or t
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
  modified_base (579)..(579): a, c, t, g, unknown or other
  misc_feature (579)..(579): n is a, c, g, or t
tcagctcgcgtgtccacgaccggtgctcgatttagatcgtctgtgttgggtctgggagaggagcccagcactagaagtcggcgtgtttccattcggtgatcagcactgaacacagngactcacatgagtttggctagtactggtttcctcgttgcctntttaagnggtgtcagtntacagtnacacgtgggtgagtcggtagggggngcgtcgtaccaggcccgttgggagtccaagagtagctntcgtgcggacacgtcctgttcgggttacctacccgttagaacgtaaccgtaggaccagtgtaccgtaacgttccggggacccaccgtaaaacgtccggaccgtaaggacggaaaagggttggtttacgggacgggttggggtaccgacttaagtttatacgtctaagtaatgaagtcggtaagtaacgtagaaactgtagtcggaaccagtaccgtcggtaacggacgggtacctacttacgaacctcgtacctacgtacggaaactaaactacgtaaccgtaaacgaaacctagaaccgtttataacgtcctaaggaattaaacccggtaaanaacccggtacgtaaccgtaacggtaacgtaacgacggtacggtaacctccggttaagttagtttaacggtttacggttacgggttaaggggtaaaagggaacgggtattaaaggtacggtaacggtacggtaaacgtacgttaaacggaaag

SEQ ID NO: 76803 - DNA, 818 bp, Homo sapiens
  misc_feature: GYAE6OF01DHB3O.8.34.D01.1.454.CMB.1.raw
  modified_base (187)..(187): a, c, t, g, unknown or other
  misc_feature (187)..(187): n is a, c, g, or t
  modified_base (556)..(556): a, c, t, g, unknown or other
  misc_feature (556)..(556): n is a, c, g, or t
  modified_base (701)..(701): a, c, t, g, unknown or other
  misc_feature (701)..(701): n is a, c, g, or t
tcagctcgcgtgtccacgaccggtgctcgatttagatcgtctgtgttgggtctgggagaggagcccagcactagaagtcggcggtgtttccattcggtgatcggcaactgaaacacaggaggactcaccagtggtagttgggctgaacgtttgggttttcctcgttcgtcgtttacgttttaaaggnggttcgtaccgtagttcgtacaagtgacgtaacggttgggtagggacggttcgggtaggggggacggtcggttcggtaccgacgggtccggttagggggaacggttccaaaccggaaggtacgtacccgttccggttggttaacggttcggaccgtaccggttcccggttaccggttcgggttaccctaaccgttttaccgaaacgttaaccgtacggtcaacgtcgaccccgtaaggtccggggtaccccgaacctacggaccctaccggagggtaaccggtaaaggggttcgtaggggtacgggttgggtacgtaggttagtttccgtagtcggtagtcggacggtgtagttcgtagaggttgacgntacgagtacgtcggtaacgacggtaccttacgtccaacgtccgttacgaaccgaagaaccgttactaacggttacgaaaccgtaacgtaacgtaagtttacggtaacgttagggactaacgtaagaccgtagtaacccgttacgngtacggacggtaccgtagtacgtaagtaccgaggtaccggaacgggaggggtaaccggacgggttacggcggtaacgttcgtaacgttcgttacggtgacggtcgggtccgtaccgg

SEQ ID NO: 76804 - DNA, 813 bp, Homo sapiens
  misc_feature: GYAE6OF01AFRED.8.34.D01.1.454.CMB.1.raw
  modified_base (462)..(462): a, c, t, g, unknown or other
  misc_feature (462)..(462): n is a, c, g, or t
tcagctcgcgtgtccacgaccggtgctcgatttagatcgtctgtgttgggtctgggagaggagcccagcactagaagtcggcggtgtttccagttcggtgatcagcactgaacacagaggactcaccagtggagtttggctgaacgttgggttttcctcgttgcttacgttttaaggaggtcgtccgtagttgtacgtaagtgactaacgtgggtggaggttcggtgggggagcggtcggtccgaggccggtgggacgtcaacgagagaccttcgttcggtgtcgacgtcgtccgttcgttcgggtcctaacccgttcgtaacgtaacgtaccggactagtcgtaccgtaccggttcggtaccccgacctaacgccgtacccgaaggtacggtaaggggtagtttacgggaaggttggggtcggtacgttagtttacgtttcgagttccggtaggaccggtnttaggtcgttaacgtaaggttggtaagtcgtacgtcggtaccggtcggtaacggtaccggtccgttaacgtacccgtaccgtaccgttaccgttaccggaaacgtaacgttaaccccggaccgtttaaacccggaaacgtaaaccgtaaacgtaagttttacggttaaccgttaccgaaccgttaacgaaccgtcgtaaccgttaacggtacgtacgggaaccgtacggtaaggttactaaacgtacgttacgacgggaaaggggtaccgggaacgggtaccgagggtacccggttacgtaacgttacgttccggttacggtacgtcccgggttgggacccggttaaccgg

SEQ ID NO: 76805 - DNA, 935 bp, Homo sapiens
  misc_feature: GYAE6OF01A26RZ.8.34.D01.1.454.CMB.1.raw
  modified_base (899)..(899): a, c, t, g, unknown or other
  misc_feature (899)..(899): n is a, c, g, or t
tcagctcgcgtgtccacgaccggtgctcgatttagatcgtctgtgttgggtttgggggaggaactgctcagttaggacccaggagggaaccatggaacgccccagctcagcttctcttcctcctgctactctggcctcccagtttcagactaccgaccggagagtattgtgttgacacaatctccacgccaccctgtccttcgtctaccgagggaacgtcgccaccctctcctcgccgagggcctagtcaagtacgtggtcggcgaccgttacgtactaccgtacggaccctaacgaacgtaaaccgtcggaccgacggtccctacccgaccggtaccccccttacgtaccttacgttacgtcgggtactaccgtaacgtacccgaaaccgggtaccggggacccctacgggtaccggcgtaacccgtccccaccggtaccgtaaccgggttccgtacggtacggtacccggtagggttaccggggtaacggtaccggggtaaccgaacggttaccttaccgtaccgttaccaccccggtacctaccgtaacgtcctaacccggacgtacccgggtaggtacccgtccgtaaggtaacgggtcgttacggtttaccgtaaccggttttagtttaaaccgtcctttaaccgggaaccctttaaaccggtccggtttaacccgggtacgggtaaaccgggtttccccggggtacccccgggggttaccccgggggtttaaccccgtttaacccgggttccccgggttaaaccccggggtacggtaaacccgggttttaaagggccgttaaaccggtaaccgttaaaaccccggttaaaacgggtcccttttcggggacccggtttacgtaccccgggaaccctttaccgggtaaccctttntttaaccccgggttaattccccggtttaacccccgg

SEQ ID NO: 76806 - DNA, 907 bp, Homo sapiens
  misc_feature: GYAE6OF01AO0U5.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatgggagttttgggctgtaacttgggtttttcctcgttgccttacgtttttaaggaggttgtccagtgtacaagtgcaagtgggtggagtcgtgggggagcgtggtccaggccgtgggagtcaacaggagacctcgtcgtgcgcagtccgttcgttgggttcctaccttcgaacgtaaccgtacggtacagtcgcgtaccgtcggggtaccccgaccgaaacggtccgtacccgaacgggacggtaaaggggttagttaggggtaacggttcgggggttcggacgttaaggttttcggttttaacgaagtttccggtagggtacgggtacgtacggtttagggttaactaaacgggtttgggtaacttacgggtaccgtaacgggttaaccccggttacgggtaacgggaacggggtcccgttaacgttacccaaccgttacgtacccgttaccgaaggtaaacctaaccgtaacgtttaccggaaacgtaaaccgtaaacgttaaacgtttacgggttaacgtttacgggacttaaccgtaacgtaaaccctaacggtaacccgttaaaccggttccggttaacgggtaaccgggtaaccgggaaccgggttaaccgtttaacgtaacccgttttaaacgggaaccggggttaaaccggggaaacggggggtacccgggggttaaaaccggcggggtaaccgggttaaccgttaacccgggtaaccggtttaccggtttaccggtttaaccgggtccgggttaaccggttacccgggggg

SEQ ID NO: 76807 - DNA, 783 bp, Homo sapiens
  misc_feature: GYAE6OF01CYL4Z.8.34.D01.1.454.CMB.1.raw
  modified_base (165)..(165): a, c, t, g, unknown or other
  misc_feature (165)..(165): n is a, c, g, or t
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (341)..(341): a, c, t, g, unknown or other
  misc_feature (341)..(341): n is a, c, g, or t
  modified_base (750)..(750): a, c, t, g, unknown or other
  misc_feature (750)..(750): n is a, c, g, or t
  modified_base (761)..(761): a, c, t, g, unknown or other
  misc_feature (761)..(761): n is a, c, g, or t
tcagctcgcgtgtccacgaccggtgctcgatttagatcgtctgtgttgggtttgggggaggaactgctcagttaggacccagagggaaccatggaacgccccagctcagcttctcttcctcctgctactctggcctcctagtttcaagactaccaccggagagtnttgtgttcgacaacaatcctaccacgccctaccctgttcttccgtcgtaccggaaggggaaacgacgccctaccctcgtaccnggcgacgggtccacgtanaaggtaagttggttcggaccgtaccttaacgtcgttcccgtaacggtaacccaaacgaacgaaccgtcggaaccncggtaccctacccggaacccggtcccctctacttacgtaggttcggtacaccgtaccgtaaccgaaccggtacgggacccaggtacggacctaaccgtccccgaacggtaccgtaggttcggtaacgggtgggacgtacgggggttaaggggtaccggtaggggaaacctacggttacctaccgtacgttaccaccgtaaaccttacacgtaacgtccgaacggtcgtacggacgtacgtaggtacggttagtacggttatacgtttaggtttacttacgtaccgaacttacgtaccggtaccgtacgggttaccggtcgggttacccccgggtaccgggtccgttaccggtccggacgtacggaacggtagtacgacttaaacggacgtaacggtcgttagcgttacncgacgtacctnttccgtgttacctcgtaccccg

SEQ ID NO: 76808 - DNA, 1068 bp, Homo sapiens
  misc_feature: GYAE6OF01CXWH8.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagacggactcaccagtggtaggttggctggtaacgttcgggttttccttcgttcgtcttacgtttaaggaggtcgtaccgagtgtacaagtcgactaacgtgggtggtacggttcgggtgggggtacggtcggtcgggtacccaggtccggtgggacggtccgaacgaggtacggaccttcggtcgttagtcgcgtacggttccttcggtttacggttacctaccggtttacgaccggttaacgaccgtctacgttcgtaccgacggttaccgggaccccaccgacgtcccgtccggaaggtacggaaaggggtgtttaggggacgggttcgggttacggtacgttggttttaccgttctagttcggacggtaggacttaacggttggttaactaaggttcggtacgtacggtaccgacgtaccggtttacgggtaacggacgggttacccgtacgtaacccgtaccgtacccgttaccgtaacgacggtaaccgttaaccgtaaccgttaccgaaacggtaaaccgttaacgttaacgtggtttaaacgggtaaccgttaacgggtaaccgttaaccggttaacggtaaacccggttacccgttaaacccggtacccggggtttaaacgggaacccggttaaccccggggtaacgggttaaacccgggtttaaaccggttaaccccggtttaaaacggggggtttaaaacccgggtaaaccgggggggtttaaaacccgggggggaaaccccggggggggtttaaaaacccccggggtacccgggggggttttaaaaaccccgggggtttaaacccccgggggtttttaaaacccggttttaaaacccccgggggttttaaccccccggtttaaccccggggggtttttttaaaccccccgggggccccggggggggttaaacccccccgggggttttaaaccccgggggggg

SEQ ID NO: 76809 - DNA, 843 bp, Homo sapiens
  misc_feature: GYAE6OF01APTFE.8.34.D01.1.454.CMB.1.raw
  modified_base (200)..(200): a, c, t, g, unknown or other
  misc_feature (200)..(200): n is a, c, g, or t
  modified_base (306)..(306): a, c, t, g, unknown or other
  misc_feature (306)..(306): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggngtcggtgggggggcgtggtccagccgtggggacggtccctgagactctcctgtgcaggctcgtggtattccaccttcagtaacctacggcgtgcacgtcgggtccnccgaggcctccgaggacgaaggggtccgttagggaggtcgggcgtgggcctaggtttcgttttaccgacgttcgtacggacggggtactacggttacggtttacctaaagtttgggttaactgggtacccgttacggtacccggtacccgggttagggtaaccgggggtcccgtaactttccccgaaccgttacccttaccgtacccccgaaaggtaacccgaacccgtaaacccgttaaccccggaaacggaaacccgtaaaccggtaagttttaaccggttaacgtttttacccggggaacccttaacgtaaacccggtaaccgtaacccgttaaaccggttcccgttaacgggaaccgggtaaccggtaaccgggttagttaaaccgttaccgttaccggttagggtaaacccggggtaaagggggtaacccgggggtaacgtacggggtaacccggggtacgtttaacccggtaacggttaaccctttacccggtttaggtaaccggttcgggttccggggttaacccggggg

SEQ ID NO: 76810 - DNA, 792 bp, Homo sapiens
  misc_feature: GYAE6OF01CBHWC.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggtttcctcgttgctcttttaagagtgtccagtgtcaagtgcaatggtggagtctggggagcgtggtccagcctgggagtcacagagactctcgtgtgcaggcctcgtagggttcacccgtttcaagttaacctcggcaagtgaccacttggggtccccgaccctaaggccctcccgaaggggtcccgaaggggtatttaggggaacggttggggttacgggccttaaggtttcgttttccaagttccggtggaagggtcctaggtcggttttacaaaggttcgggtactacgggaccgtaaggtaccgtcccggttaaggaacgggtcccggtaatttcccgaacccgttacgtacccgttacccgaaacgtaacggaacctaaacgtttcccgaaacggtaaaccgtaacgtaaacgttacgttaacgtttaaggacgtaccgtacgtaaacgtacggtaccgtaaaccggttccgtaacggacggtaaccggtaccgggtaacttacggttaccgtaacgggtacggttaaaccgggaacggggtaacgggggtaacccgaaggggtaccgggtaacgggttaacccgtaaacggttaccggttaacccgtttacgggtaaccggttccgggtaacccggggg

SEQ ID NO: 76811 - DNA, 702 bp, Homo sapiens
  misc_feature: GYAE6OF01C7089.8.34.D01.1.454.CMB.1.raw
  modified_base (99)..(99): a, c, t, g, unknown or other
  misc_feature (99)..(99): n is a, c, g, or t
tcagctcgcgtgtccacgaccggtgctcgatttagatcgtctgtgttgggtctgggagaggagcccagcactagaagtcggcggtgtttccattcggtnatcagcactgaacacagaggactcacatggagtttgggctgaacttgggttttcctcgttgcttcttttaagaggtgtccagtgtcaagtgcaacgtggtggagtcgtgggggaggcgtggtccagccgtgggaggtcacagagactctcggtgtgcacgtcctcgttgggttccaccttcaagttaactacggcatcgcacgtgggtcccaccaagcctaccgaggacgaaaggggttttacgggaggttggggtgtacgtaggtttgtttcagttccgtggacgggcaaggtttgttacgaaagtttgggtaattcggcaacgtacgttccggtagggaacgggtccgtacttaccgaacctacgttccctaccgaagtaacgaacgtaacttacccgaaggaaccaactaaacgttagttacgttttgggaacgtcgtacggaaactacgtaccgttaacgttccgtaggaacgtacggaccgggtacgttaactacgttacgtaggtaacgggtaaacggggaacgggggaaaccgacgggacgggtaacgttaccgtaaacggttaccttaccgtttacggccggttcggtaccgggg

SEQ ID NO: 76812 - DNA, 765 bp, Homo sapiens
  misc_feature: GYAE6OF01BQYTK.8.34.D01.1.454.CMB.1.raw
  modified_base (704)..(704): a, c, t, g, unknown or other
  misc_feature (704)..(704): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccagtggagtttgggctgaacgttgggttttcctcgttgcttactttaaggaggtcgtccagtgtacaagtgacaacgtggtggagtcggtgggggagtcggtggtccgagccgtgggcgtacacgagagcctcgtcgtgcgcgacgtcctcgttcggttacctaccttcaaggtaacctacggtcagtcgacgtcgtcgggtaccacgacgctacgagacggaagggtgttacggaggttgggtgacgttaggttcgttacgacgttacgagggtacggtcgtagttcgttacgaggttacgtatcgtacgacgttaccggtcggtaaggtaaccgggcctaacggttccctaacctcgtacccgtacgaacggtaacgtaacctaaaccgttacggaaaacggtaacctaaccgttaaaggtttacgtttaaggttaacgggacgttaccgtaagggaaacccctacgtaacccggttaacgtcccgggttaaacggaacgggttaacccggtacgggttaacgtacgttaaacccgtagggtaacggggtaaacggaaggggggaacgggaacccgngggttaaacggtccgtaaaccgacggtttccgtagtaccggtacggttcggtaacccgggg

SEQ ID NO: 76813 - DNA, 944 bp, Homo sapiens
  misc_feature: GYAE6OF01AJEK3.8.34.D01.1.454.CMB.1.raw
tcagctcgcgtgtccacgaccggtgctcgatttagatcgtctgtgttgggtttgggggaggaactgctcagtttaggacccagagggaaccatggaagccccagcgtcagcttctcttcctctacgctactcgtgctccctagtttcagacgtaccgaccggagaacgagtttgtaggttacgaacactaaacgtcctccgaacgcccctacccgttcgtcctttccgttccgtacccggaaagggggaaaacgtaccggacccctaaccccgttcgttaccccgaggtacccggaacgggccgttaacgtaccgaaaaggttaacggttcggtttaccggaccggttacccttaaaccggtttaccgttcccggttaaccgggttaaacccaaaaccggttaaacggaaaacccggttccgggaacccgtaccggaccccgtttaacccccgaccgggtaccccccgtaagtacccgttaccgttaacggttcggtaaccggtacccttaacccgaaccgtaaaccggttaccgggaaccctaccggttaaccggacccgtactaccccgaacgtccgggtaacgtcgtaacggtcgtacggtggttaccggtagtacggggtaactacgtaaccgtttaccgacctttaccgtaaccgtacctacgtaaccgtaccgtacggacgttcgaaccggtacgtccgtacgtaaggcgttacgttagtactttagtttagtaccgtagttaacctatacccggttcgtttaccggacggttaacccggccgggttacccggggtacccttcgggttacccgtccccgggtaggtaaccgggtaacgtacgttaacgtaacccgttaaacggtaaccggtagtacggtcggtacctaacggaccctttacggtactaccggttacgttacccgtttacgtaacccgg

SEQ ID NO: 76814 - DNA, 1007 bp, Homo sapiens
  misc_feature: GYAE6OF01A8SUF.8.34.D01.1.454.CMB.1.raw
tcagctcgcgtgtccacgaccggtgctcgatttagatcgtctgtgttgggttgggggaggaactgctcagttaggacccagagggaaccatggaacgccccagctcagcttctcttcctcctgctactctcggcctccctagtttacagtactacccgccggagagtatttgtgttagacactaatcctaccgacgccctacccttgttcctttccgtacctccggaaaggggaaagaccgtccctaaccctccgtccctacgggaccgacggggacctaggttacaacggtaagtttcggtcggccctccgttaacgtacgttccgtaacggtaaccaacgaacgtaccgtaccggaccacggtccctaccgacccgcccctctactcgtacgtcggtcacctacgaccgaacgccgggtacctacggttaccgaccgactccccgacggtaccgtacgggttacgacgggttacggccgtaacggggtcgggttaccggacggaacgtacgttacctacgtaccttacccgtctaacccgaaacttaccaacgtacgtaccgtacgtacgtaaccggtacgttaaccggtaaagtttacgtttaaccggttacggttaacgtttaaaccggtttttaccgttaacggtttaacggttaacccggttacgttaacccggtttaacgggttttaacccgtttaaccccgggttttaacccgggttaccccgggggtttaaccccggggtttaacccggggttaaaccccgggtttaaccccgggggttaaaaccggttaaccggggggtaaaaacccggttacccgggtaaaccgggtttaaaacccccgtaaacccggggttaaaccccggttaaacgggttcccgggtaaaccgggtttccccgggaaaccctttaaaccccggtaacccccgttttaagggtttaccccctttacccgggtttaacccttttaaccccgggttaaccccttttaacccccccgg

SEQ ID NO: 76815 - DNA, 1200 bp, Homo sapiens
  misc_feature: GYAE6OF01DFPAN.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacgagaggacctcaccagtggtagtttgggcttagtaacgttcgggtttttccctcgttgtaccttacgttttaaggacggttgtccgaggttgtacgaagttcgactaacggttgggtagggtaggttccgggtgggggggacggtccggttgggttacccgaacggtcccggttagggggtacggtaccaacgaacggtacgtaccttcgttaccggtggtccgacgaccggttcccttcggttccggttacctacccgtttaccgaaacggttaaccgtacggactaacgtcgtaccgtccggttcccggggtaccccgaacctaaccggtcccgttaacccgggaagggtaaccggtaaaggggttggtttaaggggggtagggtttcgggggtacggttacggtttacggttttttcgttaccgtacgtttacggggtaacggtacggggtttcgtttaacggggtttactttaacggtaaaggtttcgggttaacgttaccggtacccgttaaccgggtacccgggtttaccgggtaaacgggggttaaccccgggttaccgtttaaccgtttaacccccgaacccgtttaaacccgttacccgtaaacccgggtaaacgttaacccggtaaaaaccccgttaacggttaaaaccccccgggtaaacggttaaaaaccctaaacccggtttaaaacgggtttttaacggggttttaaaccggtttaaccggggtaaacgtaacccgttaaacccgggtaaacccgtaaaccgggttaaaccccgtttaaacccgggttacgggttaacggggggaaaacccccgggtttaaccgggttaacccggggtttaacccggtttaaaaccgggttttaaaacccggtcccggggtttaaaaaacccggggggttaaaacccgggggggggtaaaaaaccccggggggtaaaacccggggggggtaaccggttaaaccccgggggtttaaacccgggggttaacccggtttaaaacccggttacccgggtttttaaaccccggtttacggtttttaaacccgggggtacccggggtttaccccgggg

SEQ ID NO: 76816 - DNA, 802 bp, Homo sapiens
  misc_feature: GYAE6OF01EBVA5.8.34.D01.1.454.CMB.1.raw
tcagctcgcgtgtccacgaccggtgctcgatttagatcgtctgtgttgggtttgggggaagaggaagactgacggtcctgccacaggtggtgtttccattcggtgatcagcactgaacacagaggactcaccagtggtagtttggctgacttgggttttcctcgttgcttcgttttaagaggtgtcctaggtgtcgaagtgactaacgtggtggagtcgtgggggagtcgtggtccagccgtgggacgtcacgagagacctcgtcgtgtcgccacgtccttcgttaggttcctaccgtttacaacgtaaccgtaaccggcaagttggaccgtaccggtcggggtccccgaccgaaacggcccgttacccggaaggggtaccggtaaaaggggtgtttaggggaagggttgggggtcgggtacctttaagggtttttcgttttacgaacgtttccggtaggaacggggttccgtaaggtttacggttacgtaaaggttggttacgttaggaccgtaaggtacccgttccggtagggtaaccgggtccgtacttaccgaaccctagttacccgtacgtaagaacgtaacctaaacgttaacccgaacgaaactaacgtaagttcgttaagtttcggacgtacgtacgaaacgtaccgtaaccgttaacgtcgtaacggtaacgaacggtaccggtacgttaagtaccgttacgaaggtaacggaacgggtacggggtaaacgcgggtaacggtacgttaacgtaacgttaccgttacggttacggtccggtcggttacccgggg

SEQ ID NO: 76817 - DNA, 685 bp, Homo sapiens
  misc_feature: GYAE6OF01EV6A8.8.34.D01.1.454.CMB.1.raw
  modified_base (68)..(68): a, c, t, g, unknown or other
  misc_feature (68)..(68): n is a, c, g, or t
  modified_base (124)..(124): a, c, t, g, unknown or other
  misc_feature (124)..(124): n is a, c, g, or t
  modified_base (159)..(159): a, c, t, g, unknown or other
  misc_feature (159)..(159): n is a, c, g, or t
  modified_base (164)..(164): a, c, t, g, unknown or other
  misc_feature (164)..(164): n is a, c, g, or t
  modified_base (179)..(179): a, c, t, g, unknown or other
  misc_feature (179)..(179): n is a, c, g, or t
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (381)..(381): a, c, t, g, unknown or other
  misc_feature (381)..(381): n is a, c, g, or t
  modified_base (424)..(424): a, c, t, g, unknown or other
  misc_feature (424)..(424): n is a, c, g, or t
tcagctcgcgtgtccacgaccggtgctcgatttagatcgtctgtgttgggtttggggggaggaactgntcagttaggaccagagggaaccatggaacgccccagctcagcttctcttcctcctnctctctgcctacctattcagactacgacgtagganttgtntagacacatcaccgnacctcgtactctctccgngaagggaacncncctcctctcgacgcgacgtacgtagtacgaagttagtcgggtacacgtacctacgttcggtaccgtaacgaaaccaccggtaacgaccggtaccgcctacgggtaccctaccctaccggtacctacgtaacttaatcgggtcggtacctacggtaaacctacggaacggccnccgtaagttcgaccttacggacccggtcggtcggttactacgnggacgtacggtacgggtggtacggtagtacgtaacgtaccgtactactaccgtactacctacgtacgtacgtacgcgacgacgtacgtacggtagtaacgtagttacgttactaagttacgtacgtagtacgtacgtactacgtacgtacggacgaccgaccgtaccggtacgtaaccggtaacggtacggacgacgtgtacgtcggtacgtacgtacgtacgtacgcgtcgtacgcgtactacgttactctcgtacgtac

SEQ ID NO: 76818 - DNA, 745 bp, Homo sapiens
  misc_feature: GYAE6OF01BEDJY.8.34.D01.1.454.CMB.1.raw
  modified_base (207)..(207): a, c, t, g, unknown or other
  misc_feature (207)..(207): n is a, c, g, or t
  modified_base (479)..(479): a, c, t, g, unknown or other
  misc_feature (479)..(479): n is a, c, g, or t
  modified_base (636)..(636): a, c, t, g, unknown or other
  misc_feature (636)..(636): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccacggagagtattgtgttgacacaatctccagccacctgtcttcgtctccgagggaacncgccacctctcctgcgacgggcctagtacgaagtagttcggttacggcgtaccttacgtactccgtaggtaccaagtacgaacctggaccacggtcctacccgacggtcccctagactacgttacgtggtacgactacgtaccgaacggcgggaccctaacggtcgacctaaccgtccccgaacgcccgttagggttccagggttcgaccgtagggtacggttaggacgggaactagtaccgttacaccgtctaccgacctactacgtaacncccgtaaggtccgtagggacctacgtgggtacgtgttacggttactacgtttagtttactacggtactaaccgtacttacggtaccgacggtacggttcgggtccccggtacggggtacccttaacggggtttcccgaaccggttgggtaaaacccncgggtacgttaaacgacgtaaacccggaaaggttccggttaacgggtggtaccccgtacgttaaacccgtaccttacgttccggtttactttaccccgttcgtaccccg

SEQ ID NO: 76819 - DNA, 910 bp, Homo sapiens
  misc_feature: GYAE6OF01CS0JE.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcacatggagtttgggctgaacttgggttttcctcgttgcttctttaaggagtgtccagtgtacaagtgacaacgtgggtggagtcggtggggggacggtcggtcggtccaggcccggtggggacgtcacgaggacgtaccttccgtcggtggtcgaccgtacggtcccgtttcgttcggggttaccctacccgttacgtaacgttaaacctacgggacctagtccgaccgtacggtccggggtaccccgacctaaacggtcccgtaccgaacggggtaccggaaaaggggtggtttaggggtacgggttaggggggttacggtaccgtttaggttttacgttccgaagtttccggtaggggtacggggtacttagggtttacgttaacgtaaaggtttcggtaacgtcgtaaccgtaacggtaaccccggttaccgggaagggtaacccgggtacgttaacttaccccggtaacctacttacccgtaaccgaaacggtaacgtaacccgtaaacgttaccggaacgtaaacctaacggttaaacttaggtttaacgttacggtacgtaacgtaacggtaacctacgtaacccgtaaggttccggtaacggaaccgtaccgggacggttacgtaaaccgttaaccgtaccggttaaggggaaaccggggtaaacgggggaaccgggggaaacccgtaacggggaccgggttaaacccggttaaccgttaacccgggttacccgtttacccggttaaacgggtaccggggttcccgggtaaacccggggg

SEQ ID NO: 76820 - DNA, 703 bp, Homo sapiens
  misc_feature: GYAE6OF01A4I72.8.34.D01.1.454.CMB.1.raw
tcagctcgcgtgtccacgaccggtgctcgatttagatcgtctgtgttgggtttgggggaggaactgctcagttaggacccagagggaaccatggaacgccccagctcagcttctcttcctcctgctactctggcctcccagttttcagataccgaccggagagtattgtgttgacactaatcctccacgccctaccctgtccttcgtctccgaaggggaaagcgcccacccgttctccgtggccgtacggccagtcagtaatggttcggcgtcctagtactccgtacggtaaccaacgaacgtaaccgtcggacccgaggccctacccgaccgaccccgtctacttcctagtcggtcgacctacgtaccaaacggcggacccacgtacggactaccctccgacggtcctagggttaccaggtcggacgttaaggtcgggtaagtcgggaacacgtaccgtacacgttcctaccgacctagttacacgttccaacgtccgtaaggcctcgtaggacggttacttggtacgtagtttagtttacgttcgtacgtactaacggtccttaacgggtcgtacggtaccgggtcccgtaccgggccttacggttcccgacggtcgggaacttaggctaacgtaccgtaacgtaacgtagtcggtcgtacctggaccctagttcccgttattccgttactccgttacccg

SEQ ID NO: 76821 - DNA, 750 bp, Homo sapiens
  misc_feature: GYAE6OF01CFMK7.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggcctccctagtttcagactaccgaccggagagtattgtgttgacacaatctccacgcccacccttgtcttccgtctaccggaggggaacacgaccccaccctctcctggaccgacgggccagtcaagtagtgttcggctaccgtacgtacgtaccgtacggtaaccaaacgacgtaaccgtcggaccgacggtccctcccgaccggcccccttacagttaccgtagtggtccgactacctacccgaacggaccggacctacgcgaccgactacccgagtccgtaggttacgtacggtcggacggaagggttacgggtacggtccgggaaacgtaccgtaccgtttcctaaccgtttccaacccgtacctacgttaccttacaccgtacgtcgtacgggcgtacgtaggtagttcgttaggttactacgttaacgttttacttacgtaacgtactaaccggtcgttaacccgggtcggtaccggtcccgggtcccgggttacccgggttacccttacccggtccgtaccgggtacggttaaccgaggtacgtaacgtacgtaacgtacgtacgtggtaccgtacgtacgaccgttacacgttcttcgttgtccgttcccg

SEQ ID NO: 76822 - DNA, 834 bp, Homo sapiens
  misc_feature: GYAE6OF01DMAD9.8.34.D01.1.454.CMB.1.raw
  modified_base (271)..(271): a, c, t, g, unknown or other
  misc_feature (271)..(271): n is a, c, g, or t
  modified_base (603)..(603): a, c, t, g, unknown or other
  misc_feature (603)..(603): n is a, c, g, or t
  modified_base (655)..(655): a, c, t, g, unknown or other
  misc_feature (655)..(655): n is a, c, g, or t
tcagctcgcgtgtccacgaccggtgctcgatttagatcgtctgtgttggggttgggggagaactgctcagttaggacccagagggaaccagtggaacgccccagctcagtcttctccttccctcctgtcctactctcggcctcccgtagttttcaaggacttaaccaccggagacgtatttgtcgttagacactaacgtcctccgacgccctacccgttgttccttaccgtcctaccggaaagggtaaacgccgtccctaccctcgttccngaccggtaccgggaccagttacgaagtaacgtttggtccggtcctaccggtttaaacgtccttccggtaaccggttaaacccaacgtaaccggaaccgttacgggacccgacgtaccccgtacccgtacccggtacccctactacgtaccgttttaggcgggtaaccaccgttaaccgttacccgaagttacgggaccctagtacgaccgttccaccccgggcctacgggttacgttacccggaaggtccgtttacgggacgggggtttaagtacggacgggaacttaccctacgttccaaccgttccttccgaaatcttacgtacgaccgnggtccacggacgtcgtagacgttggttactagtactttagtacgtttaccgngttaccacgtttcgacggtcgtaacgggttccggacccggttacccgggtcttaccccggttaccgtccggtaaccgtcggtaacgtaggaccgtaagtaacccggtaacggtacggtgtaccgggacttacccggacgttaacctccgtttaccgtccgttctacccggtttaccccg

SEQ ID NO: 76823 - DNA, 865 bp, Homo sapiens
  misc_feature: GYAE6OF01D8911.8.34.D01.1.454.CMB.1.raw
  modified_base (475)..(475): a, c, t, g, unknown or other
  misc_feature (475)..(475): n is a, c, g, or t
tcagctcgcgtgtccacgaccggtgctcgatttagatcgtctgtgttgggtttggggggaagaggaagactgacggtcctgccacaggtggttgtttccattcggtgatcagcactgaacacagaggactcaccagtggagtttgggctgaacttgggttttcctcgttgcttacttttaaggaggttgtccagttgtacaagtgactaacgtgggtaggtagtcggtaggggggacgtccgtcggtcccaaggcccgttaggggaacggtaccaacaaggtaacgtaccttccgtggtggtcgacacggtccgtttcggttacgggttaccctaacccgttttacgaaacggttaaaccgtacgggactaagttcggacctacggttccggggtacccgaccgtaaacgccgttacccgagggtacggaaaggggttacttaggggacggtggggtacgcgttagtttcgtttnactgtaggaggctagttgtactaagttggtactgacacggtcgtccggtaaggaacgggtcctattaccgacctataccgtacgaagtagtaactaacgtacccgaaggaaacctagtaaagttcgttagtttacggacgtacgttacgaaaccgtacgttaaccgttaacggtcccgtaagggtaccggaccggtaaccgggttaacgttaaacgttaaacgtacccggttaaagggtaaccggggaaaacggggggtaaccgggggtaaacccggtaaggggtaaaccccggggggttaaccgttaaaaccccggttaacgggtttaaaccccgttttacccggttttaacggggtacccgggtttaccgggggttaaccccgggggg

SEQ ID NO: 76824 - DNA, 722 bp, Homo sapiens
  misc_feature: GYAE6OF01BPCZG.8.34.D01.1.454.CMB.1.raw
  modified_base (253)..(253): a, c, t, g, unknown or other
  misc_feature (253)..(253): n is a, c, g, or t
tcagctcgcgtgtccacgaccggtgctcgatttagatcgtctgtgttgggtcgtgggagaggagcccagcactagaagtcggcggtgtttccattcggtgatcagcactgaacacagaggactcaccatggagtttgggctgaacttggttttcctcgttgcttacgttttaagagtgtccagtgtacgaagtgcaacgtggtgagtcgtgggggagtcggtacgtccaggtccgtggggagtaccacgaganacctcgtcgtgtcgcagcctgtcggtacctaccttacgaacgtaacctacggctagtgccgtacgtcggtacccaccgaacgcctacccggacggaccggtaaagggttcgttacggggtaggtcgggtacggtcgttaggttttccgttagacgttcggtaggacgggtctaggttgttactaagttggtcgtcgactacggtaccgttaccgggtacggaaccgggtccgtacgttaccgtaacccgtacttccgaaccgtaacggaacgtaacgtaaacgtacccgtaaaggtaacctaaccgtaagttacgttagtttacggacttacgtacgtaacgtacgtaccgtaagttccgtaggaacggacgtacggtactacgtacgtacgtaacgggaggaacgggtaaccgggcgaaggtacggtaccgtaacgtacgttacgttccgtcgtacgtggtacccggg

SEQ ID NO: 76825 - DNA, 817 bp, Homo sapiens
  misc_feature: GYAE6OF01AM6CB.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaacgtgggttttcctgttgcttcttttaagagtcgtccagtgtcaagtgacaacgtggtggagtcgtgggggaggcgtcggtccacgccgtggggacgtcacgagacgaccttccgtcggtgtcgcacgtcctcgttcgggttcctaccttacaagttaaccgtacggctagtacgccgtacggttccgggtacccgaccgtaacgccgtaccgtaacggaacgtaaacgggtacgtttacggggaacggttggggttacggaccgtttaaggttttccgtttacaacgttcggaacgggtacgggtacgttaacggttcggtttaacgaacgtttgggtaacgtcgtaccgtacggtacccgttacgggtaagggtaaccgggtccgtacctaccgacccgtacgtccgtaaccgaacggtaaaccgtaacgttaacgttaacccgaaacgggtaaacctaacgtaaacgtttaagttaaccggttacggtaacgtacgttaaacgaaaccgttacgtaaccccgtaaacgtacccggtacgacgggttaaccgacgggtaaccgtaacgtacgtaacgttacggaaacggtacggggaacgggtacgacgggtaaccgggtacgttaacccgtaacggttacccgttaaccgttcggtacgtcgggttaaccggg

SEQ ID NO: 76826 - DNA, 970 bp, Homo sapiens
  misc_feature: GYAE6OF01DGC09.8.34.D01.1.454.CMB.1.raw
tcagctcgcgtgtccacgaccggtgctcgatttagatcgtctgtggtttgggtttgggggaggaactgctctaggttacggacccagagggaaccatgggaacgccccagctcagctttctccttcctcctgccttactctggtcctaccctagtttcaagtactaccgaccgggagtagtattggtgttacgaacctaactaacttcctaccgaacgtccccgttacccgttcggttttccctttaccgggtttacccgtaaccgggaaaacggggggaaaaaccgacccggtcccccttaaccccggttaccctttcccggttcggacccgggtaaaccggggtcccctaaaggttaccggaaacggttaacggttcggggtttaccgggacccggtttacccgttaaaacggggttcttacccccggtaaagggttaaaaacccccaaccggtaaaaaccggtaaccccggtacgggaaccccgttaacccggggtccccttaccccggaacccgggttcccccctaagttaacgttaacccggttgtaccgggtttaacaccgtaccgttaaccggaaccggtaccgggaacccttaccggcgtaacccgaccgtacccgtaccgaacggttccggttaagcgggttacgtggtaccgggttagggtacgagacgttaccgtactaccgacttaccaccgtaaccgtatacccgcgtaaccgtacggtacgtaacgtccgttaggtaccggttagtccgttaacgttgtaaccgttagtttacccgacgtaacggtaactcggaactttccggggaacggtttcgggaacccggtcccggggtccggttacgttcccgggttaccggtcggtaacggtaacgtacgtcggtaataaccgtaaacgtcggtaagttcggcgtaacctacgtacctacggttattccgcggtttccttcgtaaccccg

SEQ ID NO: 76827 - DNA, 796 bp, Homo sapiens
  misc_feature: GYAE6OF01BB9P2.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagataccaccggagagattgtgttgacacaatctccagccaccctgtcttcgtctcgagggaaancgcccacctcgtcctgcgagggccagtcagtaatgttggctcctagtagtcctaggtaccaacaagtaaaccgtcggaccgacggtcctacccgaccggccccctacacgttcctagtggtcgactaactacccgaaacgaccgggaccctacgtcgggcctaccgtacccgacgccgtaacgggttcgaaggtcggacgtacgggttacgggtagtacgggaacctacggtaccgtttacccgaaccttcccgttaaccaacccgtaacttcgtaacgtaccgtaaccggtacccgtcgggtaaccggtccgttaacgggtaacgggttagttacggtttcggaacgttttaacgttttaacgtttacctacgggtttaaccaaacgttacggttaccgtaccgggtacggtacccgggttcccggtaccccgggggttaccttaacccgggttccgggtaccccgggtacggtaaccggtaaggtaccggttaaacgtaaccgttaaccgtaaaccggtacgtacggttacggtcccgtacgacccgtaaccttagtaccttaccgttacgttcccgttaacccg

SEQ ID NO: 76828 - DNA, 777 bp, Homo sapiens
  misc_feature: GYAE6OF01CWRFJ.8.34.D01.1.454.CMB.1.raw
  modified_base (173)..(173): a, c, t, g, unknown or other
  misc_feature (173)..(173): n is a, c, g, or t
  modified_base (182)..(182): a, c, t, g, unknown or other
  misc_feature (182)..(182): n is a, c, g, or t
  modified_base (189)..(189): a, c, t, g, unknown or other
  misc_feature (189)..(189): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (217)..(217): a, c, t, g, unknown or other
  misc_feature (217)..(217): n is a, c, g, or t
  modified_base (252)..(252): a, c, t, g, unknown or other
  misc_feature (252)..(252): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcacagtggaggtttggctggtaacttgggtttcctgttgcttactttaagngtctcagtntacagtnacagtggngngtgtggggagcgtgtccngtcgtggacgtcacgagacgtactcgtcgtgtcgngtacgtccgttcggttaggttcccgtacctaagaacgttaaccgcggtactacgtgtaccgtcggttccgggacccacgtaagtcccgtacgacgggtaacgtaagggtagttggggacgtggggtacgtacgttacggtttcggtttacacgttacggggacgggttacgggtaccgttaacggttgttaccgtaaaggttgggtaacctaggacccgtaaacgtccggtaccgggtaaagggaccggttaccctaacgtttacaacccgttaagtaccccgtagtaaacgaacgtaactaacgttacgaacgtaaactacgtaagttacttacgggtaactggacttaacgccgtaacgttaccgtaagtccgaagggaccggttaaccggaccggtaacttaaccgtaacgtacgggttaacggggaaagggaccgggggtaaagggtaccggacgggttaacggtacccgttaaaccgtacggttacctagggttcggaccgttaccgggggtaccccggg

SEQ ID NO: 76829 - DNA, 799 bp, Homo sapiens
  misc_feature: GYAE6OF01DWFGG.8.34.D01.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (441)..(441): a, c, t, g, unknown or other
  misc_feature (441)..(441): n is a, c, g, or t
  modified_base (475)..(475): a, c, t, g, unknown or other
  misc_feature (475)..(475): n is a, c, g, or t
  modified_base (784)..(784): a, c, t, g, unknown or other
  misc_feature (784)..(784): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgcctactctgcctccctagtttcaagactacccgaacggtagacgtatttgtgtacgaacgactaatcctcgacgcccacccgtgttctcggtctaccgaagggaaancggcctacccgtnttccgagcgacgggacctaagcaagtactggtacggcgtacctcgtaactcgtagtaaccaagacgaacctggaccaggtcctaccgacgtcctacgactcgtaattcgggataccgatacccaaacggaccggcctaacggtcgacctacggtaccgacgtccggttaagttcgacggttggacttacggggtaagnggcgtaacaggtccttagacgttccacgaactanccgtaatacgagtcctagggactagtcggtaagtcgttggttacgtacgttaacgttttacgtaacgttcgtaaccgtaaccgttaaggtttacccgtaacggtaccggttacccgggtacccccgggttcggggtaccccttttaacgggtcccccggtttaaccggggtaaccggtaacccggttaaaggttcgggtaaaacgttaaaccggtaaacccgtaaaacgggttaccccggttagttaaccggggttaacccgttaagtaccccgtaaacgttaacgttcccgtaaggttttaaaccccncggtttaaacccccg

SEQ ID NO: 76830 - DNA, 863 bp, Homo sapiens
  misc_feature: GYAE6OF01BYTWR.8.34.D01.1.454.CMB.1.raw
  modified_base (461)..(461): a, c, t, g, unknown or other
  misc_feature (461)..(461): n is a, c, g, or t
tcagctcgcgtgtccacgaccggtgctcgatttagatcgtctgtgttggggtttgggggacggtaactgctcagttaggacccaggagggaaccagtggaacgcccagcctcagcttctcttcctctgcctactccgtggcctcctaggtttcagactaccgacggagagtagttgttgtacgactacaatcctccgaacgccctacccgtgttcctttaccgtcctaccggaaggggaaacgacgtcccctacccgttctaccgcggaccggtacggcctaacggtcaaggtaacgttcgggttacggccgttaccgttaccgtattccggtaacgtaccgaaacgtacggtaaaccgtcggacctacggcccttaccggccgtcccctctacgtcgttaactcgggtacacctaccgtaccgaacgggtccggacctacgccggtactaccgtacccgnggtaccgtaagttccggtacggtcggtacggttaacggggtggtaaacggtccggggaaactagggttaaccctttaccgaccctttaccccactaacccgttacgtaactacgttccgaccggtaccgggttacgccgggtaacgtacggtacggttaggtcgttacggttactttaagtttaccgtactcggttaactaacgttcggttaaccggtaccgggtcgggttaaccccggtccccgggttacccggggttacccgttacccgggttcccgggtacccggtaccggtaaccggttaagggtacgttaccctaaaagacccgtaacggttaccgagggtcgtaacttccggaaccgttaccgttacgttactttacgtccttaaccggttacccg

SEQ ID NO: 76831 - DNA, 644 bp, Homo sapiens
  misc_feature: GYAE6OF01A1O07.8.34.D01.1.454.CMB.1.raw
  modified_base (206)..(206): a, c, t, g, unknown or other
  misc_feature (206)..(206): n is a, c, g, or t
  modified_base (251)..(251): a, c, t, g, unknown or other
  misc_feature (251)..(251): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (379)..(379): a, c, t, g, unknown or other
  misc_feature (379)..(379): n is a, c, g, or t
  modified_base (420)..(420): a, c, t, g, unknown or other
  misc_feature (420)..(420): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccacggagagattgtgttgacacaatctccagccaccctgtcttcgctccgagggaaancgccaccctctcctgccagggccagtcaagatggtggcgctacgntccgtggtaccaacgagaaacctggccaggctcccgaggcccctnacnctatggtcncacttcccaagcgggaccactggctaactccccaggcctaggtcctaagtcggacgtacggtggggtaacngggggaaccaggtaaccctcgtaacctcctacgaaaccctnttcggaactaccgacgtccgttacggacgccgtagagggtatacgttacgcttaaggtttacttacgtcgtactacgtactccgtacggtacgcggtacccggtccggggtcctaccgttccgggtcccgtacgggtaccgtaaaggtcgaaagttccgtaacgaaaccggttaagtcggtacgggtacgtcgacctaccgacttaccgtcgttcgtcctaccg

SEQ ID NO: 76832 - DNA, 831 bp, Homo sapiens
  misc_feature: GYAE6OF01A22CL.8.34.D01.1.454.CMB.1.raw
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (351)..(351): a, c, t, g, unknown or other
  misc_feature (351)..(351): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctggggagtcacagagactctcgtgtgcagcctctgggttcaccttcagtaactacggcatgcacgtcggtccncaagctccgaggcaagggnttgggagtgggtgcgtagttgttcagtcgtaggngggactaggtgttacaagttggtatcgacgtaagtaccgttaccggtaggaacggggtaccctacgttaccaaccgtataccgtaccgtaaggaaacgtaacctaaacgttacccggaacgggtaaacctaacgtaaacgtttacggtttaagtttacgggtaacgtaccgttaacggtaaaccgtaacgggttaacccgtttaaacgggttaccccggttaacggggtaaacggggtaacccggtaaacccgggggttaaccgttaaaccgggtttaaacccgttaaccgggtttaaacggggtttaaaaccggggggaaaacgggggggttaaaccccgggggggggtaaaaccggtaaacgggggtaaccccggggggtttaaaccggtttaaccccgggtaaaacgtttaacccgggtttaaccccggtttttacggggtaaccccggtttacccgggggttaaaccccggggggg

SEQ ID NO: 76833 - DNA, 940 bp, Homo sapiens
  misc_feature: GYAE6OF01DGTMB.8.34.D01.1.454.CMB.1.raw
  modified_base (196)..(196): a, c, t, g, unknown or other
  misc_feature (196)..(196): n is a, c, g, or t
tcagctcgcgtgtccacgaccggtgctcgatttagatcgtctgtgttgggtttgggggaagaggaagactgacggtcctgccacaggtggtgtttccattcggtgatcagcactgaacacagaggactcaccatggagtttgggctacgtaaccgtttcgggttttcctcggtttgtcctttacgtttttaaaggnggttagtccagtgtacaagtcgactaacgttggaggtagtcggtagggggacgtcggtcggtcccaaggccggttaggggacgtacaacgaaggaacgtccgttccgttcgggttgcggtaccgacggttcccgttaccggtttccgggtttaacccttacccgtttacgtaaaccggtttaaaaccgtacccggataacgttccgaacgtaccggttaccggggtaccccgaaccgaacgttcccgacccggaaagggtaccggtaaaggggttggttacggggagggttaggggtacggtaacgtttggttttaccgtttccgagtttacggtacgggtacgggtaccgtttaaggtttcggtttaacctaaggtttacggtaacgttcgaccgttaaacggtacccggttaaccgggggtaaggtaacccgggttcgttaaccttaccccgtaaccggtacttaccggtaaccgaaacggtactaaaccggtaaacttaaccggaacggtaaacctaacgttaaagttcggtttaacgttacggaacgtcgtaacgaaccgtacgttaaccgttaacgtcggtaacgggaacgtaccgggtacgggtaaccttaacgttacgaaacgttacggggaaaccgggtaaagggggtaccggacggtaccgggttaccgggttaaacccgttacgtaaccgtttaacccggttccgttaaacggtccgggttaccgggtaccggg

SEQ ID NO: 76834 - DNA, 840 bp, Homo sapiens
  misc_feature: GYAE6OF01EBWOM.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcacctatggtaggtttgggctgtaacgttgggttttcctcgttgtcttacgttttaaggagggttcgtaccaggttagtacgaaaggttgaccgtaaacgttggggtggaggttccgggtgggggggaacggtcggtcggttcccgaggtcccgggtagggggtacgtaccgaacgtaaggtaccgtccgttccggtcggttcggtcaccgtccgttccgttcggttacggttaccctaccttaacggtaaccgtaaccgtcggactacggtcgaccgtccgggtcccgggtacccaacgtacctcccggaacggtaacggtaacggggtaagggttacgggtaggggtacgggttcggggtcgtacggtttaggttttaccgtagtcgggttacggtaggggacgttacgttacggtttacgtaagtacgggttagtcgtaacggtccgaccggttacgtagggacggtacggaccgttacgtaacctactaccgtcgtaacggtaaatacgtaaaccgttacgaacgaaacggtaataaacgttagtacgttacgtaggtacacgtaactacgtaactacgttacggtcggtaagaccggtaacggtccgttaacgtaccgttaggtaaccggtagggaaagggacggggtaagtaccggaggtaccgtacgtaaccgtcgttacccgttaggtacggtacggtcgggtaacccgg

SEQ ID NO: 76835 - DNA, 965 bp, Homo sapiens
  misc_feature: GYAE6OF01AOBDY.8.34.D01.1.454.CMB.1.raw
  modified_base (213)..(213): a, c, t, g, unknown or other
  misc_feature (213)..(213): n is a, c, g, or t
  modified_base (332)..(332): a, c, t, g, unknown or other
  misc_feature (332)..(332): n is a, c, g, or t
  modified_base (459)..(459): a, c, t, g, unknown or other
  misc_feature (459)..(459): n is a, c, g, or t
  modified_base (483)..(483): a, c, t, g, unknown or other
  misc_feature (483)..(483): n is a, c, g, or t
tcagctcgcgtgtccacgaccggtgctcgatttagatcgtctgtgttgggtcgtgggagaggagcccagcactagaagtcggcggtgtttccattcggtgatcagcactgaacacgagaggactcaccattgggaggttttgggcttaggtaacttggggttttttcccctcggtttgtcctttacgttttttaaaggacggttcggtacccnggttaggtacctaaaggtcgacctaaacgttgggtagggtattccgggtgggggggtaggtcggttcgggtacccaggtcccggttaggggacggtcaacggtagacgcttcgttcggnggtaccgctacgtccgtcggttacggtacctaccgttcgaacgttaccgaacggtcctgttagaccgtaccgggttccggcccgacgtaacgtcccgtaccgaggtacggaagggttggtaccgggnggttgggtcggtacgtaggttttntttaccgatggtaccgggtaggtcccgttaaggtttccgttagtaaggttcggtacttacggtaacgttaccggtaacccggtacgggttaaacgggtaccgggacccgtttaaccggtttacccaacccggttacccttaccgttaaccggaaacgtaccgggtaaaacctttaaacccgttaaccgggtaacccggttaaacctaaacccgtttaagtttaacgtttaacggttaacggtaacggtaacgttaacggtaaacccggttaccggttaaccgtaaccgttaaccggttaccgggacgggtaacccgggtacgttaacgttaacggttaccggttaaacggtaaccgggtaaccgggttaaaacggggggaccggtaaaccgggtaacgggtaccgggttaaaccgtaacccggttaacggttaacccgggtttacggttcccgggttaaagttcccggggttaacccggggg

SEQ ID NO: 76836 - DNA, 540 bp, Homo sapiens
  misc_feature: GYAE6OF02H1W9V.8.34.D01.1.454.CMB.1.raw
  modified_base (295)..(295): a, c, t, g, unknown or other
  misc_feature (295)..(295): n is a, c, g, or t
  modified_base (317)..(317): a, c, t, g, unknown or other
  misc_feature (317)..(317): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcactgggtccncccaagcctccgaggcaagggnttgggagtgggtgcagttgttcatctgagggcagtgttcaatggtatgcagactcgtgaacggccgatcacatctcagagacatccagaacacaatgtatttgagctagaacagacctaagtccgtagacggacgacgggacgtatacgtactagtacggaagggacgggggaaccgaggacggagttaccgaagtaccttccgtttagaccgtcgtacgggg

SEQ ID NO: 76837 - DNA, 531 bp, Homo sapiens
  misc_feature: GYAE6OF02IQ7OA.8.34.D01.1.454.CMB.1.raw
  modified_base (210)..(210): a, c, t, g, unknown or other
  misc_feature (210)..(210): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagngccaccctctcctgcagggccagtcagaatgttggcgcctacgtactcctggtaccaacagaaacctggccaggctccaggcccctcatctatggtgcatccgaacagggccacgtggcatcccagccaggttcagtgcagtgggtatgggacagacttcactctcaccgatcatcagcctggacgcctgaggatgtgactagtttattacttgtactaacatcgtacgagtcggccgtccggggcctacgtttcgcccgtacgggaccaagtggacgtagtacgaaacgacgtagtcgactgcacactcgtcgtctctac

SEQ ID NO: 76838 - DNA, 521 bp, Homo sapiens
  misc_feature: GYAE6OF02GW0O2.8.34.D01.1.454.CMB.1.raw
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctnatctatggtncatccaacngggccactggcatcccagccaggttcagtggcagtgggtatgggacagacttcactctcaccatcatcagctggagcctgaggatgttgctagtttattacttgtacaactatacgtacgagtcggccgtccggggcctacgtttccggccgtcggaccgaagtggatagtacgaacgaactgtgtcgtgcacatctgtctctac

SEQ ID NO: 76839 - DNA, 522 bp, Homo sapiens
  misc_feature: GYAE6OF02JR5OW.8.34.D01.1.454.CMB.1.raw
  modified_base (162)..(162): a, c, t, g, unknown or other
  misc_feature (162)..(162): n is a, c, g, or t
  modified_base (178)..(178): a, c, t, g, unknown or other
  misc_feature (178)..(178): n is a, c, g, or t
  modified_base (274)..(274): a, c, t, g, unknown or other
  misc_feature (274)..(274): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (490)..(490): a, c, t, g, unknown or other
  misc_feature (490)..(490): n is a, c, g, or t
tcagctcgcgtgtccacgaccggtgctcgatttagatcgtctgtggttgggttgggggaagaggaagactgacggtacctgccacgaggtggtgtttccattcggtgatcagcactgaacacagaggactcaccagtggagttgggctgactgggttttccncgttgctcttttaagnggtgtccagtgtcaagtgcaatggtggagtctgggggagcgtggtccagcctggggagtcacagagtctctgtgtcgcagcctctggttcaccttnagtaactcggcatgcactgggtccacaagctccaaggcagggtatggagtgggtcgcagttgttcattcngaggcaggtcttanatggatcgcagctcgngaaggccatcacntcncagagacaatcaaggaccanaatntattgganctgaacagcctaagtccgtagagacgacggtcgtaatacgtctaggtacgaagggacggggactaggnggagttccaagtcgttcttaggcgtcgtgggg

SEQ ID NO: 76840 - DNA, 528 bp, Homo sapiens
  misc_feature: GYAE6OF02H4STT.8.34.D01.1.454.CMB.1.raw
  modified_base (374)..(374): a, c, t, g, unknown or other
  misc_feature (374)..(374): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgtgcgcctagtatcctggtaccaacagaaacctggccaggcctcccaggccccctcatctatggtgcatccaaacagggccactggcacgtcccagccaggttcagtgcagtgggatgggacagacttcactcncaccatcatcagcctggacgcctgagatgtgctagtttattactgtcaacatacgtacgaggtacgccgtccggggcctacgtttcgcccgtggaaccgaagtgacgtatacgaaacgtaactggtagcgtgcacctatacgtcgtcttctacg

SEQ ID NO: 76841 - DNA, 521 bp, Homo sapiens
  misc_feature: GYAE6OF02JDMCR.8.34.D01.1.454.CMB.1.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctacgtatcctggtaccaacagaaacctggccaggctcccaggcccctnatctatggtcgcatccaacgagggccacgtggccatcccagccaggttcaggtggcaggtgggtatgggacagcttcactctcaccatcatcacgcctggacgccgtgaggtatgttgcgtagtttattactgtacaactatcgtacgagtcggccgtccggggcctacgttccgccgtcggactagtgatagtacgaacgactgtcgctgcacatctctctctc

SEQ ID NO: 76842 - DNA, 579 bp, Homo sapiens
  misc_feature: GYAE6OF02HL1YF.8.34.D01.1.454.CMB.1.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
tcagctcgcgtgtccacgaccggtgctcgatttagatcgtctgtgttgggttggggaggaactgctcagttaggacccagagggaaccatcggaagccccagctcagcttctcttcctcctgctactctggctcccagtttcagataccaccggagagattgtgttgacacaatctccagccaccctgtcttcgtctccaggggaaacngccaccctctcctgcagggccagtcagaatgttggcgcctacgtatcctggtaccaacagaaacctggccaggctcccaggcccctnatctatggtcgacactacccgaacgacgggcccacgtggccacgtccccagcccgaggttcaggtcggcaggtgggtatgggactagacttcactctcaccatcatcacgctggacgcgtagaggtattgttgctagtttattacgtgtacaactatcgtaccgtagtcggtccgtccggggtcctacggttccggacccgtacgggaaccgtaagtcggagtacgtacgtaaacgtacgtacggtacggtacgtgactacctacgtcttcgtcttactaccg

SEQ ID NO: 76843 - DNA, 542 bp, Homo sapiens
  misc_feature: GYAE6OF02IGBQR.8.34.D01.1.454.CMB.1.raw
  modified_base (302)..(302): a, c, t, g, unknown or other
  misc_feature (302)..(302): n is a, c, g, or t
tcagctcgcgtgtccacgaccggtgctcgatttagatcgtctgtgttgggtttgggggaagaggaagactgacggtcctgccacaggtggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccnccaagctccaggcaagggattggagtgggtgcagttgttcatctgagggcagtgttcaatggtatgcagactccgtgacgggccgattcaccatctccagagacaattccaggaacacaatgtattggagctgaacagcctaagtcctagaggacgacgggcgtagtactactaggtacggaagggacgggggaaccgaggacgggagttccgaagtaccttccgttgacgtcgtcgggg

SEQ ID NO: 76844 - DNA, 554 bp, Homo sapiens
  misc_feature: GYAE6OF02GDMNN.8.34.D01.1.454.CMB.1.raw
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctntcctgcagggccagtcagaatgttggcncctagtatcctggtaccaacagaaacctggccaggctcccaggcccctnactctatggtgcatccaacngggccatggcatcccagccagttcagtgcagtggtatgggacagacttcactctcacatcatcagcctganctgagntgtgctagttacttactgtacaactatcgtacgtagtcggtccgtccggggtcctacgtttccggcccgtacgggacctaacggtcggtacgtacgtaccgaaacgtaacgtcggtacggtccgttagacctaccgtacgttacgtcgttaccttcgtaccg

SEQ ID NO: 76845 - DNA, 530 bp, Homo sapiens
  misc_feature: GYAE6OF02GMXII.8.34.D01.1.454.CMB.1.raw
  modified_base (210)..(210): a, c, t, g, unknown or other
  misc_feature (210)..(210): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagngccaccctctcctgcagggccagtcagaatgttggcgcctacgtatcctggtaccaacagaaacctggccaggctcccaggccccctcactctatggtgcatccaacagggccactggcactcccagccaggttcagtggcaggtgggtatgggacagacttcactctcaccatcatcagcctggacgcctgaggatgttgctagtttattactgtacaactatacgtacgagtcggccgtccggggcctacgtttccggcccgtgggacctaaggtcggatagtacgaacgaactgtggctgcacctatctgtctctac

SEQ ID NO: 76846 - DNA, 563 bp, Homo sapiens
  misc_feature: GYAE6OF02IQMYI.8.34.D01.1.454.CMB.1.raw
  modified_base (306)..(306): a, c, t, g, unknown or other
  misc_feature (306)..(306): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
  modified_base (552)..(552): a, c, t, g, unknown or other
  misc_feature (552)..(552): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagcccaccctctcctgcgacggccagtcagatgttggcgcctacgtatccgtggtaccaacagaaacctggaccaggcctccccgacggccccctanactctatgggtcgcatacccaacgcgggccacgtggacactcccagccaggttcaggttcggacaggttgggtagtcgggaacaggtacttcgtaactcctacaaccatcatcacgtctggacnctggagtntgtgactagtttatactgtacaacgtntccgtacgngtcgggccgtccggggaccttcgttccggccgtacggaactaaggtgactatacgaaacgtatggtcgctacgcactntctcgtctcac

SEQ ID NO: 76847 - DNA, 552 bp, Homo sapiens
  misc_feature: GYAE6OF02IYH0Y.8.34.D01.1.454.CMB.1.raw
  modified_base (314)..(314): a, c, t, g, unknown or other
  misc_feature (314)..(314): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgcaagctccaggcaagggnttgggagtgggtggctagttgttcatcgtgagggcaggtgttacaatggtatgcagactccgtggaagggccgattcacatctccagagacaatccaggaacacaatgtatttggagctagaacagacctaagtcctagacgacgacgggacgtatacctacgtagtacggaacgggacgggggaaccacggacgggagtaccgaacgtaccgttaccgttacgtacggtcgtcgggg

SEQ ID NO: 76848 - DNA, 538 bp, Homo sapiens
  misc_feature: GYAE6OF02IPIEQ.8.34.D01.1.454.CMB.1.raw
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggagtcacagagactctcgtgtgcagcctctgggttcaccttcagtagctacggcatgcactgggtccnccaaactccaggcaagggnttggagtgggtgctagttgttcatctgagggcagtgttacaatggtatgctgacgccgtgaacgggccgattcaccatctcagagacaactccaggaacacatgtattgacctagaacagacctaagtcctaggacggacgacgggtgtaatactacgtgtacggaagggacgggggaaccaggcgggtagttaccgaagtactccgttgacgtcgtgggtaccg

SEQ ID NO: 76849 - DNA, 575 bp, Homo sapiens
  misc_feature: GYAE6OF02F88C3.8.34.D01.1.454.CMB.1.raw
  modified_base (209)..(209): a, c, t, g, unknown or other
  misc_feature (209)..(209): n is a, c, g, or t
  modified_base (395)..(395): a, c, t, g, unknown or other
  misc_feature (395)..(395): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctacgtatcctggtaccaacagaaacctggccaggcctcccgaggcccctcatctatggtgcatcccaacgagggcccacgtcggacactccccgagccctaggttccaggtcggcaggtgggtatgggacagacttcactctcaccntcatcacgcctggacgcctgagtagtgttcgctagtttattacttgtactaactatccgtacgtagtcggccgtccggggtcctaccgtttccggtcccgtacgggtaaccgtaacgtcggtagtacgtacgaaacgtaacgttacggtcggtcgtagcactacgtctcgttcttctacc

SEQ ID NO: 76850 - DNA, 550 bp, Homo sapiens
  misc_feature: GYAE6OF02JGLR5.8.34.D01.1.454.CMB.1.raw
  modified_base (297)..(297): a, c, t, g, unknown or other
  misc_feature (297)..(297): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcacgtgggtccnccaagctccgaggcaagggattgggagtgggtgcagttgttcatctgagggcagtgttcaatggtatgcagactccgtgaaggccgattcaccatctccagagacaattccaggaacacaatgtattggagctagaacagtacctaagtccgtgagacgacggacgtatactagtagacggaagggacgggggaacaggtacgggacgttaccgaacggttaccgtaccgtttacggtacgttacgtacgggg

SEQ ID NO: 76851 - DNA, 603 bp, Homo sapiens
  misc_feature: GYAE6OF02GTUHP.8.34.D01.1.454.CMB.1.raw
  modified_base (402)..(402): a, c, t, g, unknown or other
  misc_feature (402)..(402): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggaccaggcctcccaggcccctcatctatggtgcatccaacagggccacgtggcatcccagccaggttcagtggcaggtgggtatggggacaggacttcactctacacctatcatcagcctggacnccgtgaggtattgttgcttaagtttacttacttgtacaactataccgtacgagttcgggtcccgtacccgggggtcctaccgtttccgggacccgttcgggaaaccctaaggttcggacgttacgtaaccgaaaacggtaacgttcgggtacggtacgttacggaccctaaccgtacgttccttcggttaccttcgtaacc

SEQ ID NO: 76852 - DNA, 591 bp, Homo sapiens
  misc_feature: GYAE6OF02IY0OC.8.34.D01.1.454.CMB.1.raw
  modified_base (209)..(209): a, c, t, g, unknown or other
  misc_feature (209)..(209): n is a, c, g, or t
  modified_base (265)..(265): a, c, t, g, unknown or other
  misc_feature (265)..(265): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcaggccagtcagaatgttggcgcctagtatcctggtaccaanagaaacctggccaggcctcccaggcccctcatctatggtgcatccaacagggccacgtggcactcccagccaggttcagtggcaggtgggtatgggacagacttcactctcaccatcatcagcctggacgcctgagtagttgtgctagtttacttacgttgtactaacgtattaccgtacgtaggtcggtacccggtccgggggtacccttacgtttccgggccccgttacgggaacctaaagggtcggtacgtactaaccggaaacgtaacgttcggtacggccgttacgaccgtacctacgttccgtacgttcccttactaccg

SEQ ID NO: 76853 - DNA, 516 bp, Homo sapiens
  misc_feature: GYAE6OF02FK34O.8.34.D01.1.454.CMB.1.raw
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctccccaggccccctcatctatggtgcatccaacagggccactggcatcccagccaggttcagtggcagtgggtatgggacagacttcactctcaccatcatcagcctggagcctgaggatgttgctagtttattacttgtcaactatcgtaccgagtcggccgtccgggggcctacgtttcggccctgggaccaagtgatatcgaaacgactgtgctgcacatcntctntac

SEQ ID NO: 76854 - DNA, 537 bp, Homo sapiens
  misc_feature: GYAE6OF02IBMGM.8.34.D01.1.454.CMB.1.raw
  modified_base (209)..(209): a, c, t, g, unknown or other
  misc_feature (209)..(209): n is a, c, g, or t
  modified_base (297)..(297): a, c, t, g, unknown or other
  misc_feature (297)..(297): n is a, c, g, or t
  modified_base (400)..(400): a, c, t, g, unknown or other
  misc_feature (400)..(400): n is a, c, g, or t
  modified_base (534)..(534): a, c, t, g, unknown or other
  misc_feature (534)..(534): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctcccaggcccctnatctatggtgcatccaacagggccactggcatcccagccaggttcagtggcagtgggtatgggacagacttcactctcaccatcatcagcctggagctgaggntagttgctagtttattactgtacaacatcgtacgtagtcggccgtcccgggggtcctaccgtttccggcccgtcgggaaccgaagtcgtagtacgtacgaaacgtaactggtacgctgcaccatccctgtcttntac

SEQ ID NO: 76855 - DNA, 552 bp, Homo sapiens
  misc_feature: GYAE6OF02IV3ZZ.8.34.D01.1.454.CMB.1.raw
  modified_base (255)..(255): a, c, t, g, unknown or other
  misc_feature (255)..(255): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctctttaagaggtgtccagtgtcaagtgcaactggtggagtctgggggagcgtggtccagcctgggaggtcacagagactctcgtgtgcagcctntgggttcaccttcagtaactacggcatgcactgggtccncaagctccaggcaagggnttggagtgggtgcagttgttcatctgagggcagtgttcaatggtatgcagactcggtgaacgggtcattcacatctcagacgacaatccaggaacacaatgtattgagactagaacagacctaagtcctagaggacacgggcgtaatacgtacgtagtaacggaagggtaacgggggaaccgaggtacgggtaacgtaccgtaacggttaccgtaccgtttaggtaccggtcgtacgggg

SEQ ID NO: 76856 - DNA, 529 bp, Homo sapiens
  misc_feature: GYAE6OF02IHW2X.8.34.D01.1.454.CMB.1.raw
  modified_base (210)..(210): a, c, t, g, unknown or other
  misc_feature (210)..(210): n is a, c, g, or t
  modified_base (314)..(314): a, c, t, g, unknown or other
  misc_feature (314)..(314): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagngccaccctctcctgcagggccagtcagaatgttggcgcctagtatcctggtaccaacagaaacctggccaggctcccaggcccctcatctatggtgcatccaanagggccactggcactcccagccaggttcagtggcagtgggtatgggacagacttcactctacacatcatcagcctggacgcctgaggatgtgctagtttattactgtactaacatcgtacgagtggtcccgtccggggcctacgttccggccgtacgggaaccaagtggatacgtacgaaacgtactagtggtctgacacctatctcgtctctac

SEQ ID NO: 76857 - DNA, 592 bp, Homo sapiens
  misc_feature: GYAE6OF02I274E.8.34.D01.1.454.CMB.1.raw
  modified_base (209)..(209): a, c, t, g, unknown or other
  misc_feature (209)..(209): n is a, c, g, or t
  modified_base (293)..(293): a, c, t, g, unknown or other
  misc_feature (293)..(293): n is a, c, g, or t
  modified_base (314)..(314): a, c, t, g, unknown or other
  misc_feature (314)..(314): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagatgttgcgcctagtatcctggtaccaacagaaacctggccaggctcccaggcccctnatctatggtgcatccaaacgngggccactggcatcccagccaggttcagtcggcaggtgggtatggggacagaccttcactctcaccatcatcagtcctaggcgcctgacggattggttcgctagtttacttacttgtacctaactatccggtaccgaggtcggtacccgtcccgggggtccctacgtttccgggcccgtacgggaaccgtaacggtcggtacttaacgtaccgtaaacgtaacgttacggtaggtccgtacggacctaccgtattaccggtcgttccgttacgtaccg

SEQ ID NO: 76858 - DNA, 596 bp, Homo sapiens
  misc_feature: GYAE6OF02IE2RA.8.34.D01.1.454.CMB.1.raw
  modified_base (209)..(209): a, c, t, g, unknown or other
  misc_feature (209)..(209): n is a, c, g, or t
  modified_base (268)..(268): a, c, t, g, unknown or other
  misc_feature (268)..(268): n is a, c, g, or t
  modified_base (310)..(310): a, c, t, g, unknown or other
  misc_feature (310)..(310): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcaagggccagtcagaatgttggcgcctagtatcctggtacccaanagaaacctggccaggcctcccaggccccctcatcctatggtncatcccaaacagggccacgtggccactcccacgcctaggttccaggtcgctaggtacggggtatggggaactaggactttacaactttcgaccaccgaattcaatcacgcctggacgtaccctaggaggtacgttgttgtacgtagttttaattctagtacaactatccgttacgagtacggccgtaccggggtcctaacgtttccgccgttcggaaccgaagtcggtatactacgaacgtaacgtgtacggacgttggacctacgattacgtcttacgttctacg

SEQ ID NO: 76859 - DNA, 527 bp, Homo sapiens
  misc_feature: GYAE6OF02G7PMF.8.34.D01.1.454.CMB.1.raw
  modified_base (295)..(295): a, c, t, g, unknown or other
  misc_feature (295)..(295): n is a, c, g, or t
  modified_base (347)..(347): a, c, t, g, unknown or other
  misc_feature (347)..(347): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcactgggtccncaagctccaggcaagggattggagtgggtgcagttgttcatctgaggcagtntcaatggtatgcagactccgtgaacgggccgattcaccatctaccagagacaattcagaacacaatgtattgagctgaacagacctaagtctagacggacgacggcgtatactactagtacggaagggagggggaaccaggacggagttacgaacgtactccgttgtacgtcgtacgggg

SEQ ID NO: 76860 - DNA, 632 bp, Homo sapiens
  misc_feature: GYAE6OF02II4FX.8.34.D01.1.454.CMB.1.raw
  modified_base (271)..(271): a, c, t, g, unknown or other
  misc_feature (271)..(271): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtcgtgggggagcgtggtccagccgtgggaggtcacgagagactctcgtgtgcagcctctgggttcaccttnagtaactacggcatgcacgtcgggtcccaccaagcctaccgaggccaagggattgggagtgggtggctaggttgtttcatcgtaggagggctagtgttcaagtggtatgcagtacctccggtaggaacgggccgtacgttctaaccgtactcctaccgagaacgaactaaacgttaccgaacggaaaccaactaacgttagttaactttagggacgtactagaaccgagtaccctaagtccgtaggacgaccgacggacgttaagtacgtacgtaggtacggaaagggtacgggggaaccgaagggaccggtacggttaccgaacgttaccgttaccgttacggtacggtacggtacgggg

SEQ ID NO: 76861 - DNA, 556 bp, Homo sapiens
  misc_feature: GYAE6OF02G4LHJ.8.34.D01.1.454.CMB.1.raw
  modified_base (210)..(210): a, c, t, g, unknown or other
  misc_feature (210)..(210): n is a, c, g, or t
  modified_base (295)..(295): a, c, t, g, unknown or other
  misc_feature (295)..(295): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaancgccaccctctcctgcagggccagtcagaatgtaccaccagttagcctgtaccaacacaaacctggccaggctcccaggcccctnatcttgatgcatccatcgaggccactggcatcccagccaggttcagtgcaggtggtctgggacagacttcgactctcaccatcagcagcctagacgctagaagtatttgactagtttattactgtacaactactcgtaccgtagtcggccgtccggggcctacgttccggccgtacggaacctaaaacgttgaacgataacgaaacgtaacgtagtacggtacgtgtaccaacctagtaccttcggtacttcacgttcccg

SEQ ID NO: 76862 - DNA, 523 bp, Homo sapiens
  misc_feature: GYAE6OF02FVENB.8.34.D01.1.454.CMB.1.raw
  modified_base (209)..(209): a, c, t, g, unknown or other
  misc_feature (209)..(209): n is a, c, g, or t
  modified_base (297)..(297): a, c, t, g, unknown or other
  misc_feature (297)..(297): n is a, c, g, or t
  modified_base (520)..(520): a, c, t, g, unknown or other
  misc_feature (520)..(520): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctacgtatcctggtaccaacagaaacctggccaggctcccaggccccctnatctatggtgcatccaacagggccactggcatcccagccaggttcagtggcagtgggtatgggacagacttcactctcaccatcatcagcctggacgcctgaggatgttgctagttttatactgtcaactatcgtacgagtcggccgtccgggggcctacgtttccggccctgggaccaagtggatatacgaaacgactggtacgctgcaccgatctgtcttntac

SEQ ID NO: 76863 - DNA, 273 bp, Homo sapiens
  misc_feature: GYAE6OF02GL2AD.8.34.D01.1.454.CMB.1.raw
  modified_base (247)..(248): a, c, t, g, unknown or other
  misc_feature (247)..(248): n is a, c, g, or t
  modified_base (250)..(273): a, c, t, g, unknown or other
  misc_feature (250)..(273): n is a, c, g, or t
tcagctcgcgtgtccacgaccggtgctcgatttagatcgtctgtgttgggtttgggtgccgaagttgctggaggtcacggtcaccacgctgctgagggagtagagtcctgaggactgtaggacagcccatcggtcttccccctggcgccctgctccaggagcacctccgagagcacagcggccctgggctgcctggtcaaggactacttccgacacgcgagctgagcgggctggcaaggcgcatagnncnnnnnnnnnnnnnnnnnnnnnnnn

SEQ ID NO: 76864 - DNA, 594 bp, Homo sapiens
  misc_feature: GYAE6OF02JLBAA.8.34.D01.1.454.CMB.1.raw
  modified_base (208)..(208): a, c, t, g, unknown or other
  misc_feature (208)..(208): n is a, c, g, or t
  modified_base (294)..(294): a, c, t, g, unknown or other
  misc_feature (294)..(294): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccaggggaaangccaccctctcctgcagggccagtcagaatgttggcgcctacgtatcctggtaccaacagaacctggccaggcctccaggcccctnatctagtggtgcatccaacagggccacgtggcactcccagcctaggttcagtgcaggtgggtatcgggacaggtacttcgactcacactatcatcacgtctaggacgccgtaggagtatggttcgctaagtttacttacgtgtaccaatacgtcgtacgaggtcggcccgtaccggggcctaccgtttccggcccgtacgggaacccgtaaggtacggtacttaacgtaccgtaaaccggtaacgttcggtacggtaccgtacgaccgtaccgtacgttaccgttcgttaccttctaccg

SEQ ID NO: 76865 - DNA, 585 bp, Homo sapiens
  misc_feature: GYAE6OF02ID7NO.8.34.D01.1.454.CMB.1.raw
  modified_base (269)..(269): a, c, t, g, unknown or other
  misc_feature (269)..(269): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttnagttaactacggcatgcacgtgggtcccgccaagcctccgaggcaagggattggagtgggtgctagttgttcatctggagggcaggtgttacaagtggtatgcaagaccttccggtaggaacgggtccgattcgaccctagtcctaccagacgaactaacttccgaaggaacaactaattgttaatttggagtactagaaaccacgaccttaacgtcctaggaacgacgtacgggcgtaatactacgtggtacggaagggacggggaaccgaaggcgggaagttaccgaagtaccgtccgtttagacgtcgtcggg

SEQ ID NO: 76866 - DNA, 553 bp, Homo sapiens
  misc_feature: GYAE6OF02GJVOK.8.34.D01.1.454.CMB.1.raw
  modified_base (209)..(209): a, c, t, g, unknown or other
  misc_feature (209)..(209): n is a, c, g, or t
  modified_base (297)..(297): a, c, t, g, unknown or other
  misc_feature (297)..(297): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctcccaggcccctnatctatggtgcatccaacgaggggcccactggccactccccagccaggttcagtggcaggtgggtatgggacagacttcactctcaccatcatcagcctggacgcctgaggtatgttgctagtttattactgttacaactatcgtaccgtagtcggccgtccggggcctacgtttccggcccgtacgggaaccgtaaggtggactagtaccgaaacgtaacgtggtcggcgtgacacctatcctcgttccttctac

SEQ ID NO: 76867 - DNA, 533 bp, Homo sapiens
  misc_feature: GYAE6OF02GQFAW.8.34.D01.1.454.CMB.1.raw
  modified_base (209)..(209): a, c, t, g, unknown or other
  misc_feature (209)..(209): n is a, c, g, or t
  modified_base (297)..(297): a, c, t, g, unknown or other
  misc_feature (297)..(297): n is a, c, g, or t
  modified_base (519)..(519): a, c, t, g, unknown or other
  misc_feature (519)..(519): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttaccaccagttagcctggtaccaacacaaacctggccaggcctcccaggcccctnatctttgatgcatccatcagggccactggcatcccagcccaggttcagtggcagtgggtctgggacagacttcactctcacctatcacgcacgcctagacgcctagaagtatttgctagtttattactgtacaactatcgtacgagtcggccgtccggggcctacgttccgccgtcggtacctaaagttgacgtatacgaacgtaactagtcggctgcactntctgtcttacatcc

SEQ ID NO: 76868 - DNA, 535 bp, Homo sapiens
  misc_feature: GYAE6OF02G0P9N.8.34.D01.1.454.CMB.1.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (438)..(438): a, c, t, g, unknown or other
  misc_feature (438)..(438): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctacgtatcctggtaccaacagaaacctggccaggctcccaggcccctnatctatggtgcatccaacgngggccactggcactcccagccaggttcagtgcagtgggtatgggacagacttcactctcaccatcatcagcctggagcctgaggtatgttgctagtttactactgtacaactatccgtacgngtcgccgtccggggacctacgttccggccgtaggaacctaagtcgatacgtacgaaacgtagtggcgtcgtgacctaccgtagtctcgtcttctacg

SEQ ID NO: 76869 - DNA, 522 bp, Homo sapiens
  misc_feature: GYAE6OF02GBYDM.8.34.D01.1.454.CMB.1.raw
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
  modified_base (519)..(519): a, c, t, g, unknown or other
  misc_feature (519)..(519): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctcccaggccccctnatctatggtgcatccaacagggccactggcatcccagccaggttcagtggcaggtgggtatgggacaggacttcactctcaccatcatcagcctggacgccgtgaggatgttgcgtagtttattactgtcaactatcgtaccgagtcggccgtccggggcctacgtttcgcccgtggaccaagtgatatacgaacgactgtcgctgcacactctcgtcttntac

SEQ ID NO: 76870 - DNA, 651 bp, Homo sapiens
  misc_feature: GYAE6OF02IACES.8.34.D01.1.454.CMB.1.raw
  modified_base (299)..(299): a, c, t, g, unknown or other
  misc_feature (299)..(299): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctagtactcctggtaccaacagaaacctggccaggcctcccaggccccctnatcctagtggtcgccatcccaaacgcgggccacgtcggcactccccaagccagggttccaggtcggctaggtgggtatcgggacagacttcactctacaccatcatcacgcctggacgccgtagacggtagttcggttgtcgtaagttttacttacgttagttacctaaacgtacgtaccgttaccgtaacggttacgggtacccgtacccgggggtaccctaccggttttaccgggtcccgttacgggaaccgtaaacggtacgggacgttaaccgtacgaaaccggtaacgtacggtacgggtaccgttacgtaccgaccgtacgttaccgttcgttaccgttacttacg

SEQ ID NO: 76871 - DNA, 739 bp, Homo sapiens
  misc_feature: GYAE6OF02JLB9B.8.34.D01.1.454.CMB.1.raw
  modified_base (210)..(210): a, c, t, g, unknown or other
  misc_feature (210)..(210): n is a, c, g, or t
  modified_base (298)..(298): a, c, t, g, unknown or other
  misc_feature (298)..(298): n is a, c, g, or t
tcagctcgcgtgtccacgaccggtgctcgatttagatcgtctgtgttgggtttgggggagggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctagtatcctggtaccaacagaaacctggccaggctcccaggccccctnactctatggtgcactccaacacgggccacgtgggcacgtcccagccaggttcaggtggcctaggttgggtaagtcggggacacggtacttaccaccgtttcctacaacccgtatccaactccacgtcccgtacggaacgtcccgtaggacggtacgttcggttacgtaccgttaacggtttagtttaaccgttcgttaccgtaaacttacgttaccggtaaccgtaacgggttccggtacccgggttccccggggggtaccgttacccggttttacccgggtccccggttacggggtaaacccgttaaaacggggttaccggtaacgtttaacgttaaccggtaaaacccgggtaaacgtttaccgggtacggtacccggttaccggtaccgtaacccggtaacgtttacccgttacgggtttacccttaccgttaacccg

SEQ ID NO: 76872 - DNA, 542 bp, Homo sapiens
  misc_feature: GYAE6OF02HQ8GH.8.34.D01.1.454.CMB.1.raw
  modified_base (209)..(209): a, c, t, g, unknown or other
  misc_feature (209)..(209): n is a, c, g, or t
  modified_base (297)..(297): a, c, t, g, unknown or other
  misc_feature (297)..(297): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttgtaagctggtaccaacacaaacctggccaggctcccaggccccctnatctatggtgcatccaacagggccactggccatcccagccaggttcagtggcagtgggtatgggacagacttcactctcaccatcatcacgcctggacgctgaagatgttgctagtttattactgttacaactataccgtacgtagtcggccgtccgggggcctaccgtttccggcccgtcggaaccgtagggtcggagacgtacgaaacgacgtaggtcggctgacacgatctcgtcttctacg

SEQ ID NO: 76873 - DNA, 531 bp, Homo sapiens
  misc_feature: GYAE6OF02ISRWL.8.34.D01.1.454.CMB.1.raw
  modified_base (208)..(208): a, c, t, g, unknown or other
  misc_feature (208)..(208): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (291)..(291): a, c, t, g, unknown or other
  misc_feature (291)..(291): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcaggccagtcagatgtgcncctagtancctggtaccaacagaaacctggccaggctcccaggcccctnatctatggtgcatccaacagggcccatggcatcccagccaggtcagtgcagtggtatgggacagacttcactctcaccatcatcagcctggacgcctgacgatgtgtcagtttatactgtcaacatcgtaccgagtggaccgtccggggcctacgtttccggcccttggaaccaaagtcgatacgtacgaaacggtaactcggtacggcgtgactaccgacgtcgtacgttcttcgtaac

SEQ ID NO: 76874 - DNA, 551 bp, Homo sapiens
  misc_feature: GYAE6OF02G22ZI.8.34.D01.1.454.CMB.1.raw
  modified_base (302)..(302): a, c, t, g, unknown or other
  misc_feature (302)..(302): n is a, c, g, or t
  modified_base (415)..(415): a, c, t, g, unknown or other
  misc_feature (415)..(415): n is a, c, g, or t
  modified_base (439)..(439): a, c, t, g, unknown or other
  misc_feature (439)..(439): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggaggcgtggtccagccgtggggaggtcacagagactctcgtgtgcagcctctgggttcaccttcagtaactacggcatgcacgtgggtcccnccaagcctccgaggccgaagggattgggagtgggtggctagtttcgttcatcgtggacgggcaggttgttacaagtggtatgcagactcgtagacggcgatcacatctcaganacatcagaacacatagtagttganctagacagtacctagtcctagacgacgacggagtatactagtacgtacggaagggtacggggaaccaggacggtagtacgacgttacgttaccgttcgtacgtcggtacggg

SEQ ID NO: 76875 - DNA, 586 bp, Homo sapiens
  misc_feature: GYAE6OF02HAFQ0.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagaatgttggcgcctagtatcctggtaccaacagaaacctggccaggctcccaggcccctcatctatggtgcactccaacacgggccacgtggcactcccagccaggttcagtgcaggtgggtatgggacagacttcactctcaccatcatcagccgtggacgccgtggagagtgtgatagttattactgtacaactatccggtacgtacggtacggcccggtaccggggcctaccggtttccggcccgtacgggaccgtaacggtcggagttacgtacgtaaaccgtaaccgtaggtacggtccgtacggacctaaccgtacttaccgttacgttaccttacgtacccg

SEQ ID NO: 76876 - DNA, 641 bp, Homo sapiens
  misc_feature: GYAE6OF02GW6AD.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagatgttggcgccttcgtaagctggtaccaacacaaacctggccaggctccaggcccctcatctatggtgccatccaacgacgggaccacgtcggcactccccagcccgagttcagtggcaggtgggtatgggacagactcactctcacatcatcagccgtggacgcctaggaagtatgttagcttaagtttatacttgtaccaaactactccggtaaccgagttacgggtcccggtacccggggggtacctaccggttttcccgggccccggttacggggaacccgtaaggggttcgggaacggtaccgtaacccgtaaaaaccgggtaaccgttcgggtacgggtacccgttacgggaccctaacccgtaagtttccggttacgtttacccgttaccgtaacccg

SEQ ID NO: 76877 - DNA, 548 bp, Homo sapiens
  misc_feature: GYAE6OF02JAQ1O.8.34.D01.1.454.CMB.1.raw
  modified_base (209)..(209): a, c, t, g, unknown or other
  misc_feature (209)..(209): n is a, c, g, or t
  modified_base (317)..(317): a, c, t, g, unknown or other
  misc_feature (317)..(317): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctccccaggcccctcatctatggtgcatccaacngggccactggcatcccagccaggttcagtggcagtgggtatgggacagacttcactctcaccatcatccagcctggagcctgaagatgttcgctagtttattacttgtcaacatccgtaccgagtcggccgtccgggggccctacgtttccggtcccgtcgggaccgtaagggtacggagaacgtacgaaaccgtaacgtgtggacgtacgcacctatcctgttcttctac

SEQ ID NO: 76878 - DNA, 737 bp, Homo sapiens
  misc_feature: GYAE6OF02JLOBM.8.34.D01.1.454.CMB.1.raw
  modified_base (478)..(478): a, c, t, g, unknown or other
  misc_feature (478)..(478): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagccctggttcggtacctacctacgtaacgttaaccgtacggctagtcgacctacgggttccgggcccaacgaacgtccctacggacggacggaagggtgttagggagggttggggcgacgttaggttttcgttacacgttcgtagggacgggtactaggttcgtaacgtaaggttcggtaagtcgacgaacgtccgttcggtaagggaccgggtcctatcccgactnttccacgagaacgaacttacgtaccggaacgaactaacgtaagttacggttaaggttacggacgtaccgtaaacgaaccgacgttacccgttaacgtccggtagggaaccggttaaccggaccgggttaacttacgttaaccgtcggtaacgggtaacggggaaacggggggtaacgggaaccgtacgggggtaccggttaacgttaaccggtaacgtttcccgttaccggtttacgggaccgttaccggggtaccggg

SEQ ID NO: 76879 - DNA, 643 bp, Homo sapiens
  misc_feature: GYAE6OF02HFCI4.8.34.D01.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (308)..(308): a, c, t, g, unknown or other
  misc_feature (308)..(308): n is a, c, g, or t
  modified_base (460)..(460): a, c, t, g, unknown or other
  misc_feature (460)..(460): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaancgccaccctctcctgcagggccagtcagatgtcggcncctagtactccgtaggtaaccaacacgaaaccgtggaccaggcctcccgacggcccctanactcgtagtcggtcgcctaactaccaacgcggccacgtcggacactcccacgtccgtaggttcgaggtcggacgaggtgggtagtcgggacacgtaccgttcacgtcctaccactatacacgtccgacgtccgtaggacgtccgtaggagtnttcggtgtacttagtttacctacgtacgtaactaacgtacgtaccggtaccggtaggttcccgggacccgggtcccgggtaccttaccgtttcccgggaccggtaggaaacctaaggtacgtactacgtaaccgaaacgtcgtgtaccgctacgacctacgtgttctacgttctacgtacccg

SEQ ID NO: 76880 - DNA, 563 bp, Homo sapiens
  misc_feature: GYAE6OF02FKF3I.8.34.D01.1.454.CMB.1.raw
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (310)..(310): a, c, t, g, unknown or other
  misc_feature (310)..(310): n is a, c, g, or t
  modified_base (329)..(329): a, c, t, g, unknown or other
  misc_feature (329)..(329): n is a, c, g, or t
  modified_base (416)..(416): a, c, t, g, unknown or other
  misc_feature (416)..(416): n is a, c, g, or t
tcagctcgcgtgtccacgaccggtgctcgatttagatcgtctgtgttggggtttgggggaggaactgctcagttaggacccagagggaaccatggaagccccagctacagcttctcttcctcctgcctactctggctcccacgtttcagagtacccaccggacgagattgtgttgacacaatctccaggcccacctgtcttcgtctccaggggaaagacgccaccctctcctgcagggccagtcagaatgttggcncctacgtatcctggtaccaanagaacctcggccaggcctccccagggccccctnatctagtggtgcatccaancgggccagtggcactcccagccagttcagtgcaggtggatgggacagtactcactctacacatcatcacgctgacgctgagtatgtncgtagttatacgttgtacaactatacggtacgaggtcggtccgtccggggtccttcggttccggccgttacgggacctaaggtgtacgtacgtacggaaacgtacgtcggtcggacctgacctaccgacgtctcgttcctactaccg

SEQ ID NO: 76881 - DNA, 554 bp, Homo sapiens
  misc_feature: GYAE6OF02IQJE9.8.34.D01.1.454.CMB.1.raw
  modified_base (208)..(208): a, c, t, g, unknown or other
  misc_feature (208)..(208): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccaggggaaanagccacctctcctgcagggccagtcagaatgttggcgctacgtatcctggtaccaacagaaacctggccaggctcccaggcccctcatctatggtgcatccaacgagggccacgtggcactccccagcccaggttcagtggcaggtgggtatgggacagacttcactctcaccatcatcagccgtggagccgtagaggtatgttcgcgtagtttattactgtacaactatacgtacgagtcggccgtccggggtcctacgtttccggcccgtggaaccgtaagtggtacgtagtaccgaaacgtaacgtcgtacggtcgtgtaccacgtactcgtacgttctctac

SEQ ID NO: 76882 - DNA, 521 bp, Homo sapiens
  misc_feature: GYAE6OF02GG4JB.8.34.D01.1.454.CMB.1.raw
  modified_base (313)..(313): a, c, t, g, unknown or other
  misc_feature (313)..(313): n is a, c, g, or t
  modified_base (392)..(392): a, c, t, g, unknown or other
  misc_feature (392)..(392): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgttcagtgtcaagtgcaactggtggagtctgggggagcgtggtccagcctgggaggtcacagagactctcgtgtgcagcctctggttcaccttcagtaactacggcatgcactgggtccgccaagctccaggcaagggnttggagtgggtgcagttgttcatctgagggcagtgttcaatggtatgcagactccgtgaaggccgatcacatctcaganacaatccagaacacaatgtagttgagctagaacagacctaagtcctgacgacacggcgtagtactacgtagtacggaagggacggggaacgaggacggagtacgaagtactacgttcgacgtgtcgggg

SEQ ID NO: 76883 - DNA, 678 bp, Homo sapiens
  misc_feature: GYAE6OF02GZDGM.8.34.D01.1.454.CMB.1.raw
  modified_base (302)..(302): a, c, t, g, unknown or other
  misc_feature (302)..(302): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccaggcctggggaggtcacgagagactcgtcgtgtgcagcctctgggtcacttcagtaactacggcatgcacgtcgggtcccnccaagcctccgaggcgaagggtattgggaggtgggtggctaggtttgtttcagttcgtggagggctagtgttacaagtggtatgacgagtaccgtccggtaggaaacgggtcccgtaacgttaccaaccgtacgttccctaccgagtaacgaactaaacttacccgaaaggtaaaccaaacgtaaagttaggttaagtttaggtaagtacgtaacgaaacgtaacgtaccgttaacgtaccgtacgaacgggaaccggaccgggtacgtaacttaccgtacgttacggtaacgggaaacggggaacgggggaaccacgggtacgggtacgttaccgaacgttaccgttaccgtttacgtacggtacggtaccgggg

SEQ ID NO: 76884 - DNA, 531 bp, Homo sapiens
  misc_feature: GYAE6OF02H1Z2Y.8.34.D01.1.454.CMB.1.raw
  modified_base (153)..(153): a, c, t, g, unknown or other
  misc_feature (153)..(153): n is a, c, g, or t
  modified_base (309)..(309): a, c, t, g, unknown or other
  misc_feature (309)..(309): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaactgggtttccncgttgctcttttaagaggtgtccagtgtcaagtgcaactggtggagtctgggggagcgtggtccagcctgggaggtcacagagactctcgtgtgcagcctctgggttcaccttcagtactacggcatgcactggtccgccaagctccaggcaaggnttggagtgggtgcagttgttcagtctgagggcagtgtcaatggtatgcagctcgtagaacggcattcacatctcgagagacaattcaggaacacaatgtattgagactagaacagcctaaacgtccgtagacgaacgacgggctatactacgtacgtacggaagggacggggaacgaggacggagtccgaacggtaccttacgtttagacgtcgtaccgggg

SEQ ID NO: 76885 - DNA, 597 bp, Homo sapiens
  misc_feature: GYAE6OF02G1P12.8.34.D01.1.454.CMB.1.raw
  modified_base (299)..(299): a, c, t, g, unknown or other
  misc_feature (299)..(299): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctctgggttcaccttcagtaactacggcatgcacgtgggtcccnccaagctccaggcaagggattgggagtgggtggctaggtttgtttcagtctggagggcaggtgttcaagttggtatgcagacctccggtagaacgggtccgagttcaccatcctccagacgacaacttccgaaggaacaacaatgtattggagctagaacacgacctaacgtcctagacggacgacgggacgtatacgtacgtacggtacgggaacggggaacgggggaacccgagggacgggtaggttaccgtaacggttaccgttaccgtttacggtaccggttcggtaccggggg

SEQ ID NO: 76886 - DNA, 548 bp, Homo sapiens
  misc_feature: GYAE6OF02HF9AI.8.34.D01.1.454.CMB.1.raw
  modified_base (209)..(209): a, c, t, g, unknown or other
  misc_feature (209)..(209): n is a, c, g, or t
  modified_base (317)..(317): a, c, t, g, unknown or other
  misc_feature (317)..(317): n is a, c, g, or t
  modified_base (361)..(361): a, c, t, g, unknown or other
  misc_feature (361)..(361): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctcccaggccccctcatctatggtgcatccaacngggccactggcactcccagccaggtcagtgcagtggatgggacngacttcactctcacatcatcagcctggacgcctgaggtatgtgctagtttattactgtacaactagtcgtacgtagtcggcccgtccggggccctacgttcccgggcccgtacgggaaccctaaggtcggtatacgtaccgtaaacgaacgtggtacggctacgaccactactctgttccttctacc

SEQ ID NO: 76887 - DNA, 547 bp, Homo sapiens
  misc_feature: GYAE6OF02GOBKE.8.34.D01.1.454.CMB.1.raw
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctggggaggtcacagagactctcgtgtgcagcctctgggttccaccttcagtaactacggcatgcactgggtccncaagctccaggcaagggnttggagtgggtggctagttgttcatctggagggcagtgttcaagtggtatgcagactccgtgaacggccgatcacatctccagagacaatccaggaacacaatgtattgagtctagaacagacctaagtctagaggacgacggacgtatactacgtggtaacggaagggaagggggaacgaggcgggagttaccgaacggtacctaccgtttacggaccggtcgtacgggg

SEQ ID NO: 76888 - DNA, 686 bp, Homo sapiens
  misc_feature: GYAE6OF02IBE2C.8.34.D01.1.454.CMB.1.raw
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
  modified_base (332)..(332): a, c, t, g, unknown or other
  misc_feature (332)..(332): n is a, c, g, or t
  modified_base (381)..(381): a, c, t, g, unknown or other
  misc_feature (381)..(381): n is a, c, g, or t
tcagctcgcgtgtccacgaccggtgctcgatttagatcgtctgtgttgggtttggggggaagaggaagactgacggtcctgccacaggtggtgtttccattcggtgatcagcactgaacacagaggactcaccatggagtttgggctgaacttgggttttcctcgttgctcttttaagaggtgtccagtgtcaagtgcaactggtggagtcgtggggggaggcgtggtccagccgtgggaggtcacagagactctcgtgtgcagcctcgtgggttcaccttnagtaactacggcatgcacgtcgggtccnccaagcctccgaggcaagggtnttgggagtggggtggctaggtttcgtttcattcgtaggagggctaggtntttcgaaagttgggattggactaggtaccgtccggtaggaacggggtccgtattaccacctactctaccgagaacgaactaaacgtaccgaaggaaaccaacgtaattagttaagtttaggagtacgtacgaaacgtacgtaccctaaacgttaccgtaggtaacgggacgtaacgggtacgttaacgtaaccgttaacgttacggtaacgggaaacggggaacggggggaaccgacgggtacgggtaacggttaccgtaaacggttacccgttaccgtttacggtaccggttcggtaccggggg

SEQ ID NO: 76889 - DNA, 528 bp, Homo sapiens
  misc_feature: GYAE6OF02G7YH3.8.34.D01.1.454.CMB.1.raw
  modified_base (434)..(434): a, c, t, g, unknown or other
  misc_feature (434)..(434): n is a, c, g, or t
  modified_base (524)..(524): a, c, t, g, unknown or other
  misc_feature (524)..(524): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcactcccagccaggttcagtggcaggtgggtatggggacagacttcactctcaccatcactcacgcctggacgcctgaggtatgttgctagtttattactgtcaactntacgtacgagtcggccgtccggggcctacgtttccggcccgtcggaccgaagtgatagtacgaacgtactggtgctgcactatctgtctntacg

SEQ ID NO: 76890 - DNA, 536 bp, Homo sapiens
  misc_feature: GYAE6OF02HGJJY.8.34.D01.1.454.CMB.1.raw
  modified_base (247)..(247): a, c, t, g, unknown or other
  misc_feature (247)..(247): n is a, c, g, or t
  modified_base (443)..(443): a, c, t, g, unknown or other
  misc_feature (443)..(443): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcncctacgtatcctggtaccaacagaaacctggccaggctccccaggccccctcatctatggtgccatccaacgagggccacgtggcatcccagccaggttcagtggcaggtgggtatgggacagcttcactctacacatcatcagccgtgacgcctgacgtatgttgctagtttactactgtacaactatcgtacgngtcggccgtccggggcctcgttccgccgtggaacctaagtgatacgtacgaacgacgtggtcgactgcacctagtacgtcgttacttctaccg

SEQ ID NO: 76891 - DNA, 586 bp, Homo sapiens
  misc_feature: GYAE6OF02HZ5XU.8.34.D01.1.454.CMB.1.raw
  modified_base (421)..(421): a, c, t, g, unknown or other
  misc_feature (421)..(421): n is a, c, g, or t
tcagctcgcgtgtccacgaccggtgctcgatttagatcgtctgtgttgggtttggggggaagaggaagactgacggtcctgccacaggtggtgtttccattcggtgatcagcactgaacacagaggactcaccatggagtttgggctgaacttgggttttcctcgttgctcttttaagaggtgtccagtgtcaagtgcaactggtggagtcgtggggggagcgtggtccagcctgggaggtcacagagactctcgtgtgcagcctctgggttcaccttcagtagctacggcatgcacgtgggtcccgccaaaacctccgaggcaagggtattgggaggttggggtggctaggtttgtttcagttcgtggaggggctaggtgttcaagttggtatgctgacgcgtagacgggcatcacatcncagacacactccagaacacaatgtattgacctagaacacgtacctaacgtcctagacgtacgacgggtactatacgtacgtaggacggaacggggacggggaaccgaggacgggtacgttaccgaacgttaccgtccgtttaggacgttcggtacggggtaccgg

SEQ ID NO: 76892 - DNA, 636 bp, Homo sapiens
  misc_feature: GYAE6OF02G9WZJ.8.34.D01.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
  modified_base (323)..(323): a, c, t, g, unknown or other
  misc_feature (323)..(323): n is a, c, g, or t
  modified_base (387)..(387): a, c, t, g, unknown or other
  misc_feature (387)..(387): n is a, c, g, or t
  modified_base (410)..(410): a, c, t, g, unknown or other
  misc_feature (410)..(410): n is a, c, g, or t
  modified_base (419)..(419): a, c, t, g, unknown or other
  misc_feature (419)..(419): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaancgccaccctctcctgcagggccagtcagaatgttggcncctagtactcctggtaccaacagaaacctggaccaggcctcccgacggccccctnactctatggtgcatccaacgngggccacgtggcactcccagccaggttcaggtcggcaggtgggatgggacagtacttcacttcncaacctatcatcagccgtggacnctggaggtntgtgcttagtttacttatcgtacaacgtacttaccggtaccgtagggttccggcccgggttcccgggggtacccttaccgggtttcccgggccccggttacgggaaacccgtaaagggttcggtaacgttaacgtaaccgtaaaaccggtaaccggttcgggtacggtaccgttacggaccgacccttacgttaccgttcgttaccttaccgttacc

SEQ ID NO: 76893 - DNA, 515 bp, Homo sapiens
  misc_feature: GYAE6OF02HTZJD.8.34.D01.1.454.CMB.1.raw
  modified_base (209)..(209): a, c, t, g, unknown or other
  misc_feature (209)..(209): n is a, c, g, or t
  modified_base (371)..(371): a, c, t, g, unknown or other
  misc_feature (371)..(371): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
  modified_base (502)..(502): a, c, t, g, unknown or other
  misc_feature (502)..(502): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctccccaggccccctcatctatggtgcatccaacagggccactggcatcccagccaggttcagtggcagtgggtatgggacagacttnactctcaccatccatcagcctggacgccgtgaggatgttgctagtttatctgtcaantcgtacgngtcgccgtccggggctacgttccgcccgtgggacctaagtggatactacgaaacgactgtgctgcncatctgtctctac

SEQ ID NO: 76894 - DNA, 542 bp, Homo sapiens
  misc_feature: GYAE6OF02HAQHZ.8.34.D01.1.454.CMB.1.raw
  modified_base (208)..(208): a, c, t, g, unknown or other
  misc_feature (208)..(208): n is a, c, g, or t
  modified_base (292)..(292): a, c, t, g, unknown or other
  misc_feature (292)..(292): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagaggattgtgttgacacaatctccagccaccctgtcttcgtctccagggaangccacctctcctgcagggccagtcagatgtggcgcctacgtatcctgtaccaacagaaacctggccaggctcccaggccccctnactctatggtcgcatccaacgagggccacgtggccactcccagccaggttcagtggcaggtgggtatgggacagacttcactctcaccatcatcagcctggacgcctgagtagtgttgctagtttattacgtgtacaactactacgtaccgtagtcggcccgtccggggcctacgttccgccgtcggaaccgtaagtggactagtacgaacgtactgtagtcgtcgaccaccgattcgtcgttctctacg

SEQ ID NO: 76895 - DNA, 571 bp, Homo sapiens
  misc_feature: GYAE6OF02GE9GH.8.34.D01.1.454.CMB.1.raw
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgagggaaangccaccctctcctgcaggccagtcagatgttgcncctacgtatcctggtaccaacagaaacctggccaggcctcccaggcccctnatctagtggtcgcactaccaacgacgggccacgtggccactcccaggtccgaggttcaggtcggctagggtgggtagtgggacaggtacttcgactctcacctatcatcgagccgtggacgcctagaggtattggtgtacttagtttatacttacgtacaactcgtccgtacgagtcggcccggtccggggaccttacgttccggcccgtaggtaaccgtaaggtcgagtactaacgaacgtacgtgtacgtctagacacgtatctcgtctataccg

SEQ ID NO: 76896 - DNA, 637 bp, Homo sapiens
  misc_feature: GYAE6OF02HENCS.8.34.D01.1.454.CMB.1.raw
  modified_base (210)..(210): a, c, t, g, unknown or other
  misc_feature (210)..(210): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagcccacctctcctgcagggccagtcagaatgttggcgcctagtatccgtggtaaccaacagaaacctggaccaggcctcccaggccccctnatctatggtncactaccaacgacgggccacgtacggaccaactccccgagaccccgtaaggttccaggtcggacgtagggttggggtacgtggggaactaaggtaccgtttccaacgttcctaccaaccgtatctaactacacgtaccgtgggacgtcccgttaggacgtagtgttgacttaagtttacttactgtacaaactgtcgtacggtagtcggcccgtaccggggccttaccgttccggaccgtaggaacctaaggtgacttagtaccgaaacggtacgtcggtacggccttaggaccctacgtattaccgtgttacctacgttacccg

SEQ ID NO: 76897 - DNA, 663 bp, Homo sapiens
  misc_feature: GYAE6OF02IWPMZ.8.34.D01.1.454.CMB.1.raw
  modified_base (208)..(208): a, c, t, g, unknown or other
  misc_feature (208)..(208): n is a, c, g, or t
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
  modified_base (378)..(378): a, c, t, g, unknown or other
  misc_feature (378)..(378): n is a, c, g, or t
  modified_base (482)..(482): a, c, t, g, unknown or other
  misc_feature (482)..(482): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaancgccaccctctcctgcagggccagtcagaatgtggcgcctacgtatcctggtaccaacagaaccctggccaggcctccccaggccccctnagtctagtgggtnacactcccaacgacggccacgtcggacacgtcccagccaggttcaggtggcaggtggtatgggaacncgacttcacttccacacctatcatcgagccgtggacgcgttggaaggtattggttacgacgttagttttacttacgttcgtacaactactaccggttaaccggngttacccgggcccgtttacccgggggtcccttacggttttaccccgggacccggttaccgggaacccgtaaagggtacgggtacttaacggtacccgaaaaaccgggttaaccttcggggtacggtacccgttggaccctaaccgacgtttaccgttacgtttccgtttaaccctacccgg

SEQ ID NO: 76898 - DNA, 540 bp, Homo sapiens
  misc_feature: GYAE6OF02IV6EA.8.34.D01.1.454.CMB.1.raw
  modified_base (264)..(264): a, c, t, g, unknown or other
  misc_feature (264)..(264): n is a, c, g, or t
  modified_base (316)..(316): a, c, t, g, unknown or other
  misc_feature (316)..(316): n is a, c, g, or t
  modified_base (389)..(389): a, c, t, g, unknown or other
  misc_feature (389)..(389): n is a, c, g, or t
  modified_base (441)..(441): a, c, t, g, unknown or other
  misc_feature (441)..(441): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccaggggaaagacgccacctctcctgcagggcagtcagaatgttgcgctacgtatcctggtaccaanagaaacctggaccaggctccccaggcccctcatctagtggtgcatccaacgngggccactggcactcccagccaggttcagtgcaggtggatgggacagtacttcactctcaccatcatcacgcnggacgcgtcgagagtgttgctagtttatacgttagtcaactactcgtaccgnggtcggtccgtccggggcctaccgtttccggccgtacggaaccgaacgtcggatactacgaaacgtaacgtgtcggctagctacactcgtcttctctac

SEQ ID NO: 76899 - DNA, 570 bp, Homo sapiens
  misc_feature: GYAE6OF02HA0DW.8.34.D01.1.454.CMB.1.raw
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctcccaggccccctnatctatggtgcatccaacgagggccactggcatcccagccaggttcagtggcagtgggtatgggacagtacttcactctcaccatcatcacgcctgacgctgaggatgttgctagtttattacgttgtacaactatccgtacgagtcggccgtccggggcctaccgtttccgggcccgttacgggaacccgtaagtcggtacttactaccgtaaacggtaacttacgggtggtccgtaggacctaccgtacttcgttacgttccttctaccg

SEQ ID NO: 76900 - DNA, 565 bp, Homo sapiens
  misc_feature: GYAE6OF02GT330.8.34.D01.1.454.CMB.1.raw
  modified_base (249)..(249): a, c, t, g, unknown or other
  misc_feature (249)..(249): n is a, c, g, or t
  modified_base (303)..(303): a, c, t, g, unknown or other
  misc_feature (303)..(303): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtccttcgtctccgaggggaaagagccaccctctcctgcagggccagtcagaatgttggcnccgggtactatcctggtaccaacagaaacctggccaggcctcccaggccccctnatctatggtgcatcccaacgcgggccacgtggcactcccagccaggttcaggtggcaggtgggtatgggacagacttcactcncacntcatcagctggacgcctgagtatgtgctagtttattacgtgtacaactataccgtaccgaggtcggcccgtccggggcctacggttccggcccgtagggaacccgtaaggtcggtactacgtaccgaaacggtacgtggtacggctacgctaccgtatcgttcgtccttctaccg

SEQ ID NO: 76901 - DNA, 553 bp, Homo sapiens
  misc_feature: GYAE6OF02FR9G3.8.34.D01.1.454.CMB.1.raw
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcactgggtccnccaagctccgaggcaagggnttggagtgggtgcagttgttcatctgagggcagtgtcaatggtatgcagactccgtgaacgggccgtatcaccatctcagagacaatccagaacacaatgtattggagctagaacagtacctaagtcctagacgacgacggcgtaatacgtacgtacggtaacggaacgggaacgggggaaccgaaggtcgggagttaccgaacgttaccgttaccgttacgtaccggtcgtacgggg

SEQ ID NO: 76902 - DNA, 642 bp, Homo sapiens
  misc_feature: GYAE6OF02JSR1E.8.34.D01.1.454.CMB.1.raw
  modified_base (305)..(305): a, c, t, g, unknown or other
  misc_feature (305)..(305): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctctttaagaggtgtccagtgtcaagtgcaactggtggagtcgtgggggagcgtggtccaggcctggggagtcacgagacgactcgtcgtgtgcagtcctcgtgggttccaccttcagttaactacggcatgcacgtgggtcccncaagcctcgaggcaagggattgggagtgggtgctaggttgttcatcgtggagggctagtgttcaagtggtatcgtctggacgtccgtaggaacgggtccgtattaccaccgtactaccgtacgagaacgacgaaactcccgaaggaacctaactaagttaggttaacgttacgacctacgaaacacgtacctaacgtaccgtaggacggtaacgtacggtacgtaacgttaacgtacgtaggtaacggaaggggtaacgggggaaccgagggtacgggtaacgttacggtaacgttaccgttccgttacggacggttaccggtacgggtaacccggg

SEQ ID NO: 76903 - DNA, 638 bp, Homo sapiens
  misc_feature: GYAE6OF02GB1S4.8.34.D01.1.454.CMB.1.raw
  modified_base (210)..(210): a, c, t, g, unknown or other
  misc_feature (210)..(210): n is a, c, g, or t
  modified_base (295)..(295): a, c, t, g, unknown or other
  misc_feature (295)..(295): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaangccaccctctcctgcagggccagtcagaatgtggcgctacgtatcctggtaccaacagaaacctggccaggctcccaggcccctnatctatggtgcatccaacgacgggccacgtggcactcccagccaggttcagtgcaggtgggtatgggacaggacttcactctacacctatcatcacgcctgggacgcctaggacggtagttggttacgacgttaagttttacgttacttgtacctaaacgtagttaccggtaaccgtaggttcgggtcccggtcccgggggtacccttaccggtttcccgggacccgttacgggaaccgtaaacgggttcggtaactaacgtaaccgaaaacggtaaccgttacgggtacggtacgtacggaccgtaaccgtacgttaccgtacgtttacccgttactaaccg

SEQ ID NO: 76904 - DNA, 539 bp, Homo sapiens
  misc_feature: GYAE6OF02FPEPZ.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgagctgggttttcctcgttgctctttaagaggtgtccagtgtcaagtgcaactggtggagtcgtggggggggctggtccagcctgggaggtccctgagactctcctgtgcaggctctggattcaccttcagtaactacggcgtgcacgtgggtccgccaggcctccaggcaagggcttggagtggctggctagttgttcatctagaagtagtgttacaatactatacagactccgtgaagggccattcacatctcagagacaataccaagaacacgatagtatctagacaatgacagacctaagagtagaagacgacgtctagtttacttagtacgtaacgaaaggagggggaatacggagtaggacgacgtcgtaccgaagtacttacgttagtaccg

SEQ ID NO: 76905 - DNA, 619 bp, Homo sapiens
  misc_feature: GYAE6OF02JUWS0.8.34.D01.1.454.CMB.1.raw
  modified_base (211)..(211): a, c, t, g, unknown or other
  misc_feature (211)..(211): n is a, c, g, or t
  modified_base (347)..(347): a, c, t, g, unknown or other
  misc_feature (347)..(347): n is a, c, g, or t
  modified_base (541)..(541): a, c, t, g, unknown or other
  misc_feature (541)..(541): n is a, c, g, or t
  modified_base (559)..(559): a, c, t, g, unknown or other
  misc_feature (559)..(559): n is a, c, g, or t
  modified_base (569)..(569): a, c, t, g, unknown or other
  misc_feature (569)..(569): n is a, c, g, or t
tcagctcgcgtgtccacgaccggtgctcgatttagatcgtctgtgttgggtttgggggaggaactgctcagttaggacccagagggaaccatggaagccccagctcagctctcttctcctgctactctggctcccagtttcagataccaccggagacgattgtgttgacacaatctccagccaccctgtccttcgtctaccgaggggaaancgccaccctctcctgcaggccagtcagatgttcggcgcctagtatccgtggtaccaacagaacctggccagcctccgacggccccctagactctagtcggtcgacacgtaccaacgacgggccagtcgcactcccngtccaggttcagtggactaggtggtagtggggacaacgtacgtttaccgacttaccaccaccgtactccgaacttccgtaacgtacccgttccggaaacgtcccgtaggtaacggtaacgttcggttacggtaccttaaggtttactttacgtacgtacacgtactcggtaaccgagtcggcccgtcgggtacnccgttacgccgtagaacnggtcagtacncggaactacgttggacgcgtacggctacgtacctgtacgttctacgtacg

SEQ ID NO: 76906 - DNA, 523 bp, Homo sapiens
  misc_feature: GYAE6OF02GUOOU.8.34.D01.1.454.CMB.1.raw
  modified_base (209)..(209): a, c, t, g, unknown or other
  misc_feature (209)..(209): n is a, c, g, or t
  modified_base (297)..(297): a, c, t, g, unknown or other
  misc_feature (297)..(297): n is a, c, g, or t
  modified_base (503)..(503): a, c, t, g, unknown or other
  misc_feature (503)..(503): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctcccaggcccctnatctatggtgcatccaacgcgggccactggcactcccagccaggttcagtggcagtgggtatgggacagacttcactctcaccatcatcagcctggacgcctgagatgttgctagtttattacttgtcaactatcgtacgagtcggccgtccggggcctacgtttccggcccgtcggaccgaagtggtatactacgaacgtactgngctgacacatctgtctctac

SEQ ID NO: 76907 - DNA, 609 bp, Homo sapiens
  misc_feature: GYAE6OF02JNN8C.8.34.D01.1.454.CMB.1.raw
  modified_base (171)..(171): a, c, t, g, unknown or other
  misc_feature (171)..(171): n is a, c, g, or t
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (347)..(347): a, c, t, g, unknown or other
  misc_feature (347)..(347): n is a, c, g, or t
  modified_base (373)..(373): a, c, t, g, unknown or other
  misc_feature (373)..(373): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaatgggtggagtcgtggggggagcgtggtccagccgtggggagtcacagagactcncgtgtgcagcctgtgggttccaccttcagtaaatcggcatgcacgtggtccncaagcctccaggccaagggnttgggagtggggtgcaggtttgttcatgngagggctagtgttcaagtggtaatgnagcctcggtaggacggctacgtcacagtcctacgagactactaacgtaccgaaaggaactactaagttacgttagttagacgtacgtaagaactacgtacttaacgtaccgaggtacgaccggtaacggagtttaaccacgttaccgtggtaaaccgggaggggtaacgggacgtaaggacggttaacgtaccggtagttacccgttacggtaacgtaacggtcgggtaaccgggg

SEQ ID NO: 76908 - DNA, 544 bp, Homo sapiens
  misc_feature: GYAE6OF02HV519.8.34.D01.1.454.CMB.1.raw
  modified_base (263)..(263): a, c, t, g, unknown or other
  misc_feature (263)..(263): n is a, c, g, or t
  modified_base (320)..(320): a, c, t, g, unknown or other
  misc_feature (320)..(320): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (468)..(468): a, c, t, g, unknown or other
  misc_feature (468)..(468): n is a, c, g, or t
tcagctcgcgtgtccacgaccggtgctcgatttagatcgtctgtgttgggtttgggggaagaggaagactgacggtcctgccacaggtggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctggggaggtcacagagactctcgtgtgcagcctntgggttcaccttcagtaactacggcatgcactggtccgccaagctccaggcaagggnttggagtgggtgcagttgttcatctagagggtcagttgttcaatggtatgacagactccgtgaagggccgatcacatcncaganacatccagaacacaatgtattggatctagaacagacctaagtcctagacggacacggacgttanacgtacgtaggtaacggaagggaacggggacaggtaccggagttccaaggttacctacgtttagacgtcgtacggg

SEQ ID NO: 76909 - DNA, 571 bp, Homo sapiens
  misc_feature: GYAE6OF02FWHWM.8.34.D01.1.454.CMB.1.raw
  modified_base (210)..(210): a, c, t, g, unknown or other
  misc_feature (210)..(210): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagngccaccctctcctgcagggccagtcagaatgttggcgcctacgtatcctggtaccaacagaaacctggccaggcctcccaggccccctcatctatggtcgcatccaacgacgggccacgtggcactcccagccaggttcagtggctaggtgggtatgggactagaccttcactctcacctatcatcacgccgtggacgccgtgaggtatggtgtcgttagtttacttacgttgtactaactagtaccggtacgtaggtcggcccggtcccggggcctacgtttccggccgtcgggaaccgaaggtcgatacgtacgtaacgacgtggtcggtctcgaccacctacgtctcgttcttctacc

SEQ ID NO: 76910 - DNA, 862 bp, Homo sapiens
  misc_feature: GYAE6OF02FVP00.8.34.D01.1.454.CMB.1.raw
tcagctcgcgtgtccacgaccggtgctcgatttagatcgtctgtgttgggtcgtgggagaggagccagcacttagaacgtcggcggttcgtttaccgattcggttcgattcgagcactgaacacagaggactcaccgatggacgtttgggctgtaacgtgggttttcctcgttgtcgttcttttaagaggtgtcctagtgtcaagtgcaacgtggtggagtcgtgggggaggcggtggtccagggccgtgggtaggtcacgaggacggtacctcgtcgtgtcgcagcctcgtgggttcctaccgtttcgaagttaaccttacggctaattgcgtacgtcgggtcccgaccgtaacgggtcctacccgagggccctaaagggggtagtttacgggggaggttgggggttcgggaccgttagggtttttcgtttaccaacggtttacgttacggtaacgggggtacctaagggttacgtttacctaaagtttacgggtttaacgtcggtaaccgtaacggttacccgttaccggggttagggtaaaccggggccccgttaacgttttacccgaacccgttaccgttaccccgttacccggaaagggtaaccggtaaccgttaaaccgttacccggaaacgggtaaacctaaacgtaacgtttacggttaacggttttacgggaacgttaccgttaacggtaaaccgtacgtacccgttaacggtccgtaggaacggaccggtacgggtacgttacgttacgtacgttacggtacgggtaagggaccgggggtaacgacgggtacgggtaaccggtacggtaacggttaccgttaccggtttacgacccggttaggtacccgggg

SEQ ID NO: 76911 - DNA, 787 bp, Homo sapiens
  misc_feature: GYAE6OF02ILKHC.8.34.D01.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (312)..(312): a, c, t, g, unknown or other
  misc_feature (312)..(312): n is a, c, g, or t
  modified_base (327)..(327): a, c, t, g, unknown or other
  misc_feature (327)..(327): n is a, c, g, or t
tcagctcgcgtgtccacgaccggtgctcgatttagatcgtctgtgttgggtttggggaggaactgctcagttaggaccagagggaaccatggaagccccagctcagcttctcttcctcctgctactctggctcccagtttcagataccaccggagagattgtgttgacacaatctccagccaccctgtcttcgtctccaggggaaancgccacctctccngcagggccagtcagaatgtcggcgcctagtatccgtggtaccaacagaaacctggccaaggcctacccgaggccccctgaatcgtagtggcnctaatcccaaaacgngggacccacgtcggacaacgtccccgaagtacccgtaagggtttccaaggtcggaccgtaacgggtggggttaacgtagggggaaaccaacggttaacctttcaaacgtttccgtaccgaacccgtaatttccgaacttccaacggtcccgttaggggaaaccgcccgttaggaagggtacgttacgggtttacgacggttaagttttaacgtttacgttacgttaaccaaaccgtagtacccggttaaccgtacgggtccggtaccccgggtttccgggggaacccctttacccgggtttaccgggtacccccggttacggggtaaaccccgtaaggggtacgggtaacgtaacggtaacccgtaaaaccggttaaaccgtgggttaacccggacgttaaccgggacctaaccccgttaacgtttccggttaccggtttaccgttacccttaaacccgg

SEQ ID NO: 76912 - DNA, 541 bp, Homo sapiens
  misc_feature: GYAE6OF02I73A3.8.34.D01.1.454.CMB.1.raw
  modified_base (343)..(343): a, c, t, g, unknown or other
  misc_feature (343)..(343): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (427)..(427): a, c, t, g, unknown or other
  misc_feature (427)..(427): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctctgggttcaccttcagtaactacggcatgcactgggtcccgccaagctccaggccgaagggattgggagtgggtggctagttgttnatcgtgagggctagtgtcaagtggtatgcagctcgtgaacggcgatcacatctcananacactaccagaacacatgtattgganctgaacacgacctagtcgtagacggacgacggtcgtatacgtacgtgtaacggaagggacggggaaccaggacggtacgttacgagttaccgtcgttacgtacgtcgtacgggg

SEQ ID NO: 76913 - DNA, 753 bp, Homo sapiens
  misc_feature: GYAE6OF02IX4SG.8.34.D01.1.454.CMB.1.raw
  modified_base (206)..(206): a, c, t, g, unknown or other
  misc_feature (206)..(206): n is a, c, g, or t
  modified_base (289)..(289): a, c, t, g, unknown or other
  misc_feature (289)..(289): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccaccggagagattgtgttgacacaatctcagccacctgtcttcgtctccgagggaaancgccacctctcctgcagggccagtcagatgtgcgcctagtatcctggtaccaacagaacctggaccaggctccgaggcccctnatctagtggtcgcactccaacgacgggccacgtcggaccacgtaccccgaggtacccgtaaggtttccaagggttcggacgtaagggttggggtaacgttacgggggactaacggtaccgtttaccgaaccgtttcccgtaccgaaacccgtaattacccgtaacgttaccgtaaccggtcccgttagggaccggtacccgttagggtaacggtagtttcggttacgtactttaaggtttactttacggtacgttaaccaaacgtacgtccggttaaccggaggttccgggacccggttaccgggggtaccttaccggttttccggggaccccgttaaggggaaacccgttaaacggttcgggtaacttaaccggttaacgtaaaaccgggtacgttacgggttaccggacgttaccggaccgtaaccgtcgttaccgttaccggtttaccttaccttaaccgg

SEQ ID NO: 76914 - DNA, 721 bp, Homo sapiens
  misc_feature: GYAE6OF02H2V0S.8.34.D01.1.454.CMB.1.raw
  modified_base (296)..(296): a, c, t, g, unknown or other
  misc_feature (296)..(296): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaactgggttttcctcgttgctcttttaagaggtgtccagtgtcaagtgcaactggtggagtcgtgggggagcgtggtccagcctgggaggtcacagagactctcgtgtgcagcctctgggttcaccttcagtaactacggcatgcacgtgggtccnccaagctccgaggcaagggattcgggagtggggtgctaggtttgtttccagtctggagggtcaggttgttcaagtggtatcggactagtaccgtccgtagggaacgggtcccgtagttccaccgtacttccgtaccgagtaacgtaaccgtaaacgttcccgaaacgggaaacctaaccgtaaagttacgttaacgttttacggaacgtccgtaggtaaccgtaacggtacccgttaaacggttcccgttacgggtaacggtaacccgtaacgggtaccgttaacgttaaccgttacgtacgggttaacgggaaacggggtaaccgggggggtaaacccgaacgggtaccggggtaacggtttacccggtaacggttaacccgtttacccggttttacggtacccgggttacggttacccggggg

SEQ ID NO: 76915 - DNA, 866 bp, Homo sapiens
  misc_feature: GYAE6OF02IAFU7.8.34.D01.1.454.CMB.1.raw
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
  modified_base (319)..(319): a, c, t, g, unknown or other
  misc_feature (319)..(319): n is a, c, g, or t
tcagctcgcgtgtccacgaccggtgctcgatttagatcgtctgtgttgggtttgggggagaactgctcagttaggacccagagggaaccatggaagccccagctcagcttctcttcctcctgctactctggctcccagtttcagataccaccggagagattgtgttgacacaatctccagccaccctgtcttcgtctccaggggaanagccaccctctcctgcagggccagtcagaatgttggcncctagtactccgtaggtaccaacacgaaaccctggaccaggcctacccgacggccccctcattcctagtcggtnacctaactacccaaacgacgggcccaacgtcggacacgtccccaaggtccctaagggttcaaggtcggacgtagggttcggggtaagtacggggaacacggtaacctttcgaaccttccgtaccaaccgagttaccaagttccgaacggtccccttaggggaactcccgttagggaacgggttagttcgggtttacgtacgtttaacggtttttaacgttttacgttacggttaaccctaaacgttacggtttaccccgggttaacggtaaccgggttaccggggtaccccccggggtttaccccgggggggtaaccctttaaccccggggttttttacccccggggaccccgggtttaaaccgggggaaaaccccgttaaagggggttaccggggtaaacttttaaacccggtaaacccggtaaaaaaccggggttaccgtttacgggggttaacccgggttaccgttaacggggttaaccccctaaaccggttaaccgtttttcccggtttaaccgggtttttaccctttacccgttaaccccgg

SEQ ID NO: 76916 - DNA, 702 bp, Homo sapiens
  misc_feature: GYAE6OF02IDWZ4.8.34.D01.1.454.CMB.1.raw
tcagctcgcgtgtccacgaccggtgctcgatttagatcgtctgtgttggggtttggggaggaactgctcagttaggacccagacgggaaccatggaagtccccagcttcagcttctcttcctcctgctactctgctcccagtttcagactaccaccggagagattgtgtttgacacaatctccagccgaccctgtcttcgtctccgaggggaaacgcgccacccttcgtcctgtcacgggccacgtccaagaatgttacggcgtcctacgtatcctaggtaccaacaagaaccgtgacccgaggctccccaggcccctcatcctagtcggtagcctagtacccaacgacgggtccacgtggcacgcccgagccaggttcaagtcgacagtgggtactcgggaactacgacttccacgtctcgaccctagtacctatacacggtaccttaggtacgtaccgtagacggtacgttacgttaggtaccgttaagttttaacttaaccgttcggttaacctaaccgtacgttaccggtaaccggtacggtacgggtacccggttacccgggggaccttaaccgtttaccggtacccggtacgggtaaaccgtaagggtcggacgtaacgtaccgtaaacggtaaccgttaggttacggtccttacggtaccaccgtaacgttaccttcggttaccgttacgtaccg

SEQ ID NO: 76917 - DNA, 648 bp, Homo sapiens
  misc_feature: GYAE6OF02HAY60.8.34.D01.1.454.CMB.1.raw
  modified_base (309)..(309): a, c, t, g, unknown or other
  misc_feature (309)..(309): n is a, c, g, or t
  modified_base (388)..(388): a, c, t, g, unknown or other
  misc_feature (388)..(388): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaaagagccacctctcctgcagggccagtcagaatgttggcgcctacgtatcctggtaccaacagaaacctggccaggcctcccacggcccctcatctatgggtncatccaacgcgggccacgtggcactcccagccaggttcaggtggcaggtgggtatgggacagtacttcactctcacctntactactacacgccgtgggacgtccgtaggacggtagttggttcgtacgttaggttttaacttacgttacgtactaaactacgtaccggtaaccgacgggttacggtcccggtacccggggggtacccttaccggtttcccgggacccggttacgggtaaacccgtaacggtacgggtacttaacggtaaccgaaaaccggtaccgttaggtcggtaccgtacgcctaacgtacgttaccgtacggttccttactacccg

SEQ ID NO: 76918 - DNA, 567 bp, Homo sapiens
  misc_feature: GYAE6OF02INLQH.8.34.D01.1.454.CMB.1.raw
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcacgtgggtcccnccaagcctccgaggcaagggnttgggagtgggtggctaggttgtttcatcgtgagggctaggtgttcaagttggtatgcagtacctccggtaggaacgggccgattccacctatcctaccgagacgactaacttccgaaggaacaactaatagttagttggagcgtagaacacgtacctaagtcctagacgacgacggacgtatactacgtagtacggaagggacggggaccgaggacggagtacgaacgtctcgttacgacgtgtcggg

SEQ ID NO: 76919 - DNA, 578 bp, Homo sapiens
  misc_feature: GYAE6OF02I2VT4.8.34.D01.1.454.CMB.1.raw
  modified_base (209)..(209): a, c, t, g, unknown or other
  misc_feature (209)..(209): n is a, c, g, or t
  modified_base (297)..(297): a, c, t, g, unknown or other
  misc_feature (297)..(297): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctagtatcctggtaccaacagaaacctggccaggctcccaggccccctnatctatggtgcatccaacagggccactggcactcccagccaggttcagtggcaggtgggtatgggacaggacttcactctcacctatcatcacgtcctggacgcctggagattgttgactagtttattactgtactaactataccggtacgaggtcggtcccgtccgggggtccctacgtttccggcccgtagggaaccgtaagtcggtacgttacgtaccgaaaccgtacgtacggtacggtacgtagaccaccgtagtccgttagtccgttactacccg

SEQ ID NO: 76920 - DNA, 533 bp, Homo sapiens
  misc_feature: GYAE6OF02HEVOT.8.34.D01.1.454.CMB.1.raw
  modified_base (209)..(209): a, c, t, g, unknown or other
  misc_feature (209)..(209): n is a, c, g, or t
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
  modified_base (491)..(491): a, c, t, g, unknown or other
  misc_feature (491)..(491): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagcccaccctctcctgcagggccagtcagaatgttggcncctacgtatcctggtaccaacagaaacctggccaggctcccaggcccctnatctatggtncatccaacgngggccactggcactcccagccaggttcagtggcaggtgggtatgggacagacttcactctcaccatcagcagcctagacgcctagaagtatttgactagtttattacgtgtacaactactcgtacgtgtcggccgtccggggcctacgttccgccgtcggactaaggtgatanacgaacgtactcggtgctcgcacactcgtgtcttcacttccg

SEQ ID NO: 76921 - DNA, 590 bp, Homo sapiens
  misc_feature: GYAE6OF02JEKI0.8.34.D01.1.454.CMB.1.raw
  modified_base (325)..(325): a, c, t, g, unknown or other
  misc_feature (325)..(325): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtgggggaggcgtggtccaggcctggggaggtcacagagactctcgtgtgcagcctctgggttccaccttcagtaactacggcatgcacgtgggtcccgccaagcctccgaggcaaggggnttgggaggtgggtggctagttgtttcagttcgtggagggctaggtgtttacaagttggtatgcagacctcggtgaagggccgatcaccatcctccgagacgactaactccgaagaacactaatagttagttgagctagactacgacctaagtcctaggacgtacgacggtactataccgtacgtaggtaacggaacgggaacgggggaaccgaggtacgggtagtaccgtaacggttaccttcgtttacggacggtcggtacggg

SEQ ID NO: 76922 - DNA, 671 bp, Homo sapiens
  misc_feature: GYAE6OF02FWEFI.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggcctcccgacggccccctcactctatggtgcactccaacgacgggccacgtcggcactcccgagccgtaggttcaggtcggcaggtgggtatggggactagacttcactctcacctatcatcacgcctggacgtcctaggaggtattggttgtacttaggttttactacgttcgtactaacgtacttaccgggtaaccgtaggtccgggtcccggttacccggggggtcccttaccgggttttcccggggtaccccgttaccggggtaaacccgtaaacgggttcggtaacgttacgtaaccggtaaaaccggtaaccgttacgggtacggtaccgttacggtaccctaacccgtaccgttccgttacggtttccttacccgttacccg

SEQ ID NO: 76923 - DNA, 678 bp, Homo sapiens
  misc_feature: GYAE6OF02I45ZK.8.34.D01.1.454.CMB.1.raw
  modified_base (443)..(443): a, c, t, g, unknown or other
  misc_feature (443)..(443): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtgggaggtcacagagactctcgtgtgcagcctcgtggttcaccttcagtaactacggcagtgcacgtcgggtcccgccgaagcctccgaggcgaagggagttgggagtgggtggcgtaggtttgtttcgattccggtaggacgggtcgtaggttcgttacgaaagttggtaagtcgacgtagtaccgtcggtaggaacgggtccgtacttccacctntccgtaccgagaacactaacttccgaagtaaccaacgtaagttcgttaagtttacggagtacgtacgaaacgtaccgaacccttaagtcccgtaggaacggtccgaacgggtgttaactaccgttacgtacggtaacggaagggggaaccggggaacggtaacggtacggggtaaccggttaccgtaaccggttaccgttacccggtttacggaacccggttcggtaaccggggg

SEQ ID NO: 76924 - DNA, 540 bp, Homo sapiens
  misc_feature: GYAE6OF02IF3AI.8.34.D01.1.454.CMB.1.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
  modified_base (409)..(409): a, c, t, g, unknown or other
  misc_feature (409)..(409): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctagtatcctggtaccaacagaaacctggccaggctccccaggcccctnatctatcggtgcatccaacgagggcccacgtggcatcccagccaggttcagtcggcgagtgggtatgggacagacttcgactctcaccatcatcagcctggacgcgtgaggtntgttgctagtttactactgtaccaatactacgtacgtaggtcggtccgtccggggcctacgttccggcctgggaccgtaggtgacgacgtacgaacgtactggtcggctgccacgtcgtctcgtctactcg

SEQ ID NO: 76925 - DNA, 727 bp, Homo sapiens
  misc_feature: GYAE6OF02JS1CY.8.34.D01.1.454.CMB.1.raw
  modified_base (256)..(256): a, c, t, g, unknown or other
  misc_feature (256)..(256): n is a, c, g, or t
  modified_base (298)..(298): a, c, t, g, unknown or other
  misc_feature (298)..(298): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtcgtgggggagcgtggtccagcctgggaggtcacagagactctcgtgtgcagcctntgggttccaccttcagtaactacggcatgcacgtgggtcccnccaaggcctccgaggcaagggnttgggagtggggtgctaggttgttcatcgtggagggctaggtgttacaagtggtatgcaagtaccgtccggtagggaacgggtccgtagttaccgaccgtacttccgtaccgaaggaacgtaacgaacgtttacccgaaaggtaaacctaacgtaaacttacggttaacgtttacggaacgtacgttaacggaaaccgtacgtaacccgtttaacggtacccgtagggaacggtaaccggtaccgggtaaccgttaacgttaaccgttacgttaacgggtaaccgggtaaacggggggtaaaccgggggtaaaccggaaccgggtaccggggtaaccggttacccggtaaacgggttaccccggtttacccggtttacgggtacccggttaccgggttacccggggg

SEQ ID NO: 76926 - DNA, 669 bp, Homo sapiens
  misc_feature: GYAE6OF02IH8IG.8.34.D01.1.454.CMB.1.raw
  modified_base (272)..(272): a, c, t, g, unknown or other
  misc_feature (272)..(272): n is a, c, g, or t
  modified_base (388)..(388): a, c, t, g, unknown or other
  misc_feature (388)..(388): n is a, c, g, or t
tcagctcgcgtgtccacgaccggtgctcgatttagatcgtctgtgttgggtcgtgggagaggagcccagcactagaagtcggcggtgtttccattcggtgatcagcactgaacacagaggactcaccatggagtttgggctagaactgggttttcctgttgctctttaagaggtgtccagtgtcaagtgcaatggtggagtcgtgggggagcggtggtccagccgtgggacggtcacgagagactcgtcggtgtgcagcctgtgggttaccnccttcgaggttaaactacggcagttggtacctggggtcccaccaagtccttccgagggccaaaggggtattcgggaggtgggtcggctaggtttgttcagtcgtaggaggctagtnttcgaagtttggatgacagtaccgtcgtaggaacgggcctaattcgacctatcgtaccagacgtacgtaattaccgaaggaaactaacgtaagttagttacgttacggacgtacgtaacgaaacgtacgtaccgttaaacgtaccgtaggtaacggacgtaccggggtactaacgtaaccgttacgtacgggtaacggaagggaacgggggaaccgtacgggacggttaacgtaccgtaacgtaccgttcggttacgtacggttacggtcgggtaaccggg

SEQ ID NO: 76927 - DNA, 773 bp, Homo sapiens
  misc_feature: GYAE6OF02IBW8J.8.34.D01.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (309)..(309): a, c, t, g, unknown or other
  misc_feature (309)..(309): n is a, c, g, or t
  modified_base (321)..(321): a, c, t, g, unknown or other
  misc_feature (321)..(321): n is a, c, g, or t
  modified_base (371)..(371): a, c, t, g, unknown or other
  misc_feature (371)..(371): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagttttcagataccaccggagagattgtgttgacacaatctccagccaccctgtcttcgtctccaggggaaancgccaccctctcctgcagggccagtcagaatgtggcncctagtntcctggtaccaacagaaacctggccaggcctccgacggcccctcatctatggtncactccaaacgngggccactcggcaactcccgagccctaggttcaggtcggcaggtgggtangggacacggtacttcgacttcgtaccaccgtatccataccgagtacccgtcgggacggtcccgttaggaacgggtagttgggtttacgtaccgtttaaggttttaacgtttaccgtttaggttaacccgttaaactacggtttacccggttaaccggtaacgggttcccgggtacccgggttaccccgggggggtacccttaacccgggtttttaccccgggacccccgggttaacgggggtaaacccgtaaaaggggttcccggtaacgttaaaccggtttaaccccggtaaaaaacggttacccggttacggggttaccgggttacccgtaccgggttaaccctaacccggttacccggtttaccgtttaccgggtttaacccttttcccggttaacccg

SEQ ID NO: 76928 - DNA, 682 bp, Homo sapiens
  misc_feature: GYAE6OF02JZAEK.8.34.D01.1.454.CMB.1.raw
  modified_base (177)..(177): a, c, t, g, unknown or other
  misc_feature (177)..(177): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (323)..(323): a, c, t, g, unknown or other
  misc_feature (323)..(323): n is a, c, g, or t
  modified_base (352)..(352): a, c, t, g, unknown or other
  misc_feature (352)..(352): n is a, c, g, or t
tcagctcgcgtgtccacgaccggtgctcgatttagatcgtctgtgttgggtttgggggaagaggaagactgacggtcctgccacaggtggtgtttccattcggtgatcagcactgaacacagaggactcaccatggagtttgggctgaactgggttttcctcgttgctcttttaagnggtgtccagtgtcaagtgcaactggtgagtctgggggagcgtggtccaggcctgggagtcacngagactntcgtgtgcaggcctcgtgggttcaccttcagtaactacggcatgcacgtggtcccgcaagctccgaaggcaagggnttggagtcgggtgcaggttgttcagttcnggagggcagtgttcaagtcggtatcgacagacgttccggaggaacgggtcccgagttccgaacctacgtcgtaccgtagacgtaaccgtaacgttacccaagggtaaaccgtaacgaagttaagttaacgtttaggtaaacggtcgttaaggaacgtacgtaacccgttaaacggtacccgttaggaacgggaaccgtaccggggtaacggttaactaaccgtaccgtaggttaaccgggaaaggggtaaccgggggaaccggtaacggtacggggaccgttaccggaacggttaccgttaccgtttacggtaccggtaccggtacgggg

SEQ ID NO: 76929 - DNA, 822 bp, Homo sapiens
  misc_feature: GYAE6OF02JYK3P.8.34.D01.1.454.CMB.1.raw
  modified_base (206)..(206): a, c, t, g, unknown or other
  misc_feature (206)..(206): n is a, c, g, or t
  modified_base (280)..(280): a, c, t, g, unknown or other
  misc_feature (280)..(280): n is a, c, g, or t
  modified_base (299)..(299): a, c, t, g, unknown or other
  misc_feature (299)..(299): n is a, c, g, or t
  modified_base (332)..(332): a, c, t, g, unknown or other
  misc_feature (332)..(332): n is a, c, g, or t
tcagctcgcgtgtccacgaccggtgctcgatttagatcgtctgtgttgggtcgtgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgngggggaggcggtggtccagcctgggaggtcacgagagactctcggtgtgcagcctctgggtcacttcagtaacncggcatgcactgggtcccnccaagcctccaggcaagggactgggagtggggnggactaggtttggtttaccagttcgtaggacggggtaccagggttacggtttcgaaagtttgggggtaattcgggacgtaacggtaacctttcccgggtaggtaaacggggggcccggtaagttaccgtaaccgtaacgtaccgtaccgaacggtaacgtaaccgtaaacgttacccgaacgggtaaaccgtaaaccgtaaacgttacggttaacgtttacgggtaaacggtacccgttaagggtaaaccgtaacggtaccgttaaaccggttaccggttaacggtaaccgggttaaccggaaacggggtaccgggttaacgttaacccggttacggttaacggtttaaacccggggaaacggggttaaccgggggggtaaaacccggtaacggggtaaccggggtaaccgggtttaacccggtaaacgggttaaacccggtttacccgttttaacggggtacccgggttaccggtttaacccggggggg

SEQ ID NO: 76930 - DNA, 654 bp, Homo sapiens
  misc_feature: GYAE6OF02H8NRJ.8.34.D01.1.454.CMB.1.raw
  modified_base (210)..(210): a, c, t, g, unknown or other
  misc_feature (210)..(210): n is a, c, g, or t
  modified_base (387)..(387): a, c, t, g, unknown or other
  misc_feature (387)..(387): n is a, c, g, or t
  modified_base (437)..(437): a, c, t, g, unknown or other
  misc_feature (437)..(437): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgctccgaggggaaacngcccaaccctgtcctgcacgggccagtcaagatgttggcgcctacgatccgtggtaccaacacgaacctggccaggctcccgacggccccctcgatctatcggtgcatacccaacgagggaccacgttcggacaactcccaacgtccgaggttccaggtcggaccgagttgggtacnggggtacaggtacttcacgtctacacctatacactacacgtcctgggacnccgttaggagtattcgttcgattacggtttatttacgtgtacctaacgtacttccgtaaaccggtagtccggcccggttacccgggggtaccttaaccgtttccgggtacccgtacggggaaccgttaaagggttacgacgtttaacacggaaaaccggttaacgtcggtaccggtacgtacggacctaacctagttacctacgttccttacctacg

SEQ ID NO: 76931 - DNA, 562 bp, Homo sapiens
  misc_feature: GYAE6OF02GGJD7.8.34.D01.1.454.CMB.1.raw
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaangccaccctctcctgcagggccagtcagaatgttggcncctacgtatcctggtaccaacagaaacctggccaggctcccaggcccctnatctatggtgcatccaacgagggccacgtggcactcccagccaggttcagtggcaggtgggtatgggacagacttcactctccacatcatcgacgccgtggacgccgtaggaggtattggttcgtacttagtttatttacgtgtacaactactcgtaacgtggtcggcccggtccggggcctaccgttccggccgtacggaaccgaagtcggtatacgtacgaaacgtaacgtggtcgcgtgaccacgtactctcgttctctacc

SEQ ID NO: 76932 - DNA, 780 bp, Homo sapiens
  misc_feature: GYAE6OF02H9I21.8.34.D01.1.454.CMB.1.raw
  modified_base (210)..(210): a, c, t, g, unknown or other
  misc_feature (210)..(210): n is a, c, g, or t
tcagctcgcgtgtccacgaccggtgctcgatttagatcgtctgtgttggggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaanacgccaccctctcctgcagggccagtcagaatggttggcgcctagtatcctggtaaccaacacgaaacctggacccagggccctccccgaacggccccctgtactctaagtgggtacgccaacttacccgaaacgcggggacccacgtcgggaccaacttccccgaagcccgtaagggtttccgaacggttcggcgtaagggtcgggttacgtacggggactaacggtacctttaccaccgttacctaccgaaccctagttaccaacgtaccgaccggtacccgtacgggtaacggtaccccgttagggtaacgggttagttcgggtttacggtacgtttaacggtttttaactttaccgttacgtaaccctaaacgttaccgttacccgggttaaccgggtacgttaccggggtccccggttacccgggggtacccttaccgggtttcccgggacccggttacgggaaaccgtaaacgggttcggaacttacggtaaccgtaaacggtaacgttgggtccgttacgtacgtacctaaccgtactaccggttacttaccgtacttacccg

SEQ ID NO: 76933 - DNA, 632 bp, Homo sapiens
  misc_feature: GYAE6OF02HX73Y.8.34.D01.1.454.CMB.1.raw
  modified_base (209)..(209): a, c, t, g, unknown or other
  misc_feature (209)..(209): n is a, c, g, or t
  modified_base (301)..(301): a, c, t, g, unknown or other
  misc_feature (301)..(301): n is a, c, g, or t
  modified_base (451)..(451): a, c, t, g, unknown or other
  misc_feature (451)..(451): n is a, c, g, or t
  modified_base (488)..(488): a, c, t, g, unknown or other
  misc_feature (488)..(488): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgtcctagtatccgtggtaccaacagaaacctggccaggcctcccgaggccccctnactctatggtcgacatccgaagacgggccaacgtcggccaactccccgaagtcccgaggttcaaggtcggacgtagggtcgggtatcgggaacaggtaccttcaacgttctacgaccagtccatcacgtccgtggacgtccgtgaaggtntcggttagacttaggtttacttacgtagtacaacgtntaccggtacgtaggtccggtacccggttaccggggccttaccggtttccggcccgttacggaaccgtaagggtcgtagttaccgtacgaaacggttaacgtggtacgtccgagtaccgaacgtattccgtgttcctacgtaccg

SEQ ID NO: 76934 - DNA, 527 bp, Homo sapiens
  misc_feature: GYAE6OF02G3SV9.8.34.D01.1.454.CMB.1.raw
  modified_base (317)..(317): a, c, t, g, unknown or other
  misc_feature (317)..(317): n is a, c, g, or t
  modified_base (398)..(398): a, c, t, g, unknown or other
  misc_feature (398)..(398): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcactgggtccgccaagcctccgaggcaaggggnttggaggtgggtggcagttgtttcatctggaggcagtgttcaatggtatgcagactcgtgaaggccgatcacatctcaganacaatccagacaacatgtattgagctgaacagctaagtctgacgacgacggctatactactagtaacggaagggacggggaacgaggtacggagttaccgacgttactccgttagtaccgtcgtacggg

SEQ ID NO: 76935 - DNA, 620 bp, Homo sapiens
  misc_feature: GYAE6OF02GKAW7.8.34.D01.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
tcagctcgcgtgtccacgaccggtgctcgatttagatcgtctgtgttgggtttgggggaggaactgctcagttaggacccagagggatccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcncctacgtatcctggtaccaacagaaacctggccaggcctcccaggccccctcatctatggtgcatccaacacgggccacgtggcatcccagccaggttcagtggctaggtggtatgggacagtactcactctacacctatcactcacgccgtaggacgtccgtaggacggtacgttcggttgtacgttagttttattacgttacgtactaactacttaccggtaaccgtaggttccggtcccgtccgggggtacccttaccgtttccggacccgttacggggaaccgtaacgggttcggaacgttacgtaaccgaaaccggtacgtacggtcggacgtacgaccgtaccgtacgttacgttcgttccttaccg

SEQ ID NO: 76936 - DNA, 711 bp, Homo sapiens
  misc_feature: GYAE6OF02JKRV7.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctagtatccgtggtaccaacagaacctggccacggctcccacggcccctcatctatggtgcactccaacacgggccacgtggcactcccgagccgtaggttcagtcggcaggttgggtagtcgggactaggaccttcgacctctaccaacctatccactccgacgtcccggtggaccgtacctgggaaggacgtttggttcgacgttagttttactttacgttagttacctaaacgtagttaccggttaaccgtacgggttaccggtaccccgggttcccggggggtacccttacccgggttttacccgggtaccccgggttaaccggggtaaaccgttaaaccgggtcggtaaccgtttaccgtaaaccggtaaaaccgggttaacctttggggtaacccggtcggttacggcccttaaccggtactttaccggtccggtttaccgttacctttaaccccgg

SEQ ID NO: 76937 - DNA, 882 bp, Homo sapiens
  misc_feature: GYAE6OF02ICL9P.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacaagaaacctggccgaggcctcccgacggccccctcgacttccgtagtcggtcgccactaccgaaacgacgggcccaacgtcggaccactccccgacgaccgtaagggttccaggtcggacctagggttcggggtaagtcggggaactaggtaccttaccgactttacctaccgaacctacttcctaacgtaccgtacggcccgttagggaaccgtcccggttaggaacggtaacgttcggttacggtacgttacggttttaaacgtttaccgttacggtaaccgttaaaactacggttacccggtttaaaccgggtacgggtttaccgggtacccccgggttacccggggggttaccccgttaacccgggtttttccccggggtaacccccgggtttacggggtaaaaaccccggttaaaacggggttaccgggttaaaaccggttttaaccggtttaaacccgggtaaaaacccgggtttaaaccggtttaccggggggtttaaccggtttaccccggggtttaaccgtaacccccggttaaaaccccgggtttccggtttaacccggttttaacccggttttaccccgtttttaaccggtttaaccccccgg

SEQ ID NO: 76938 - DNA, 701 bp, Homo sapiens
  misc_feature: GYAE6OF02HRKH3.8.34.D01.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcaggccagtcagaatgttggcncctagtatcctggtaccaacagaaacctggccaggctcccaggcccctnatcctatggtcgcactcccaaacgcgggtcccacgtggaccactccccgagccctagggttccaggttcggcgtaggtcgggtatggggacaggtacttcgaactctaccacctattccatcgacgtccgtagggacgtccgtagagggtacttcggtttcggactttaaggttttactttaccgttgttaaccaaacgtacgtttaccggtaaccggtacggttccgggtccccggttacccggggggtacccttaaccgtttcccggggtacccccgtaggggtaaacccgtaaacgggttcgggaacttacgtaacccggtaaaacccggtaacgttggggttaccggaccttacggaccctaaccgtactttcccggtttacggttcctttaccctaacccg

SEQ ID NO: 76939 - DNA, 797 bp, Homo sapiens
  misc_feature: GYAE6OF02IA7I0.8.34.D01.1.454.CMB.1.raw
  modified_base (210)..(210): a, c, t, g, unknown or other
  misc_feature (210)..(210): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaancgcccacctctccgtgcgagggccagtcagaagtgttcggccgtcctacgtacttccgtggtaaccaacgaacgaaacctggaccgacggcctacccgacgggccccctcacttaccgtacgtggtcgcaactaccaaacgacggaccacgtcggactacctcccgacgtacccgtaggttaccgaaggttcgggaccgtaagggtacggggttacgtacgggggaacctaacgggtacgtttacccgaaccgtttacccttacctaaccccgatttaccgaacgttacgaaccggtacccgtttcgggaaccggtacccggttagggaaacgggtagtttcggttcggtaccgttaaggtttttaacggtttacgttaacgttaaccgtaaacgttaggttacccgggtaaccggttacggggttaccgggtccccgggttaccccgggggacccttaccgggttttcccgggtaaccccgtagggaaaacccgtaagggttacggtaacgtacgtaacgtaaaacccggtcgttacgggtacgtaccgtcgaccgtacctagttcgtcgttacgttaccttaccg

SEQ ID NO: 76940 - DNA, 989 bp, Homo sapiens
  misc_feature: GYAE6OF02JE9ZT.8.34.D01.1.454.CMB.1.raw
  modified_base (331)..(331): a, c, t, g, unknown or other
  misc_feature (331)..(331): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggaggcgtggtccagcctgggaggtcacagagactctcgtgtgcagcctctgggttccaccttcagtaactacggcatgcacgtgggtccgccaagcctccaggcaagggatgggagtgggnggctagtttgttcatcgtggagggctaggttcgttacgaaagttgggtaattcggactaacggtacccgttacccggggtagggtaaacgggggtccccgtaaacgttttaccccgaaacccgtaacgtttaccccggttacccgtaaagggtaaaccgggtaaacccttaaaaccgtttacccccggaaaaccggggtaaaaaccctaaaacccgttaaaacggtttacgggttttaaaacggtttttacggggggaaaccgttaccccggttaaaacgggtaaaaccggtaaaccgggttaacccccggtttaaaacccggggtttaccccggttaaaccgggggttaaacggggtaaaccccgggtaaacccggggggttaaccgggtttaaaccctttaaacccgggtttaaacccggtttaacggggggttaaaaaccccgggggggtaaaacgggggggggtaaaacccgggggggggggtaaaaacccccgggtaaacgggggggttaaccccgggggggggttaaaacccggtttttaacccccgggggttaaaaaccgggtttttaaccccccggttttaccccgggttttttaaacccgggggtaaccccgggggttttaccccggggttaaacccccgggggggggg

SEQ ID NO: 76941 - DNA, 552 bp, Homo sapiens
  misc_feature: GYAE6OF02GRYP4.8.34.D01.1.454.CMB.1.raw
  modified_base (328)..(328): a, c, t, g, unknown or other
  misc_feature (328)..(328): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcacgtgggtcccgccaagctccaggcaagggattggagtgggngctagttgttcatctggaggcagtgttacaagtggtatgcagactcgtgaaggccgatcaccatctacagagacaattcagaacacaatgtattgagtctagaacagcctaagtcctagacggacgacgggtacgtatactacgtacgtaacggaagggacggggaaccgacggacgggtacgttaccgaacggtaccttaccgttagtaccggtcgtacgggg

SEQ ID NO: 76942 - DNA, 716 bp, Homo sapiens
  misc_feature: GYAE6OF02G1U65.8.34.D01.1.454.CMB.1.raw
  modified_base (214)..(214): a, c, t, g, unknown or other
  misc_feature (214)..(214): n is a, c, g, or t
  modified_base (316)..(316): a, c, t, g, unknown or other
  misc_feature (316)..(316): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgcctactctggctcccagtttcagatacccaccggagagattgtgttgacacagtctccagccaccctgttctttgtctaccgaggggaaanacgcccaccctctccctgcgacgggccagtcagtaatgtcggctccttacgaagctagtaccaacaccaaacctcggaccagcctacccgacggccccctanactctagtggtcgactactaccgaacgacgggcccaacgtcggactacgtacccacgccgtaggttcaggtcggacgtagggtaggtagtacgggtaacacggtacgttaccacgttcctaccaaccgtactacctaactcgtacgaccgtcgggaacctccgtagaagtgttacggttagtaccgttaggttttactaccgtacgttaaccaactacgttaccggtacgttacggtacccgggtcccgggttacccggggtccttaccgttttacccggggcccgttaccgggaaccgttaagggtaccggtagtaaccgtaaccgtaaaccggtacgttacgggtcgtaccgtacgtacccaaccgtcgttcggttacccgttacttacccgtacccg

SEQ ID NO: 76943 - DNA, 537 bp, Homo sapiens
  misc_feature: GYAE6OF02GWW4U.8.34.D01.1.454.CMB.1.raw
  modified_base (210)..(210): a, c, t, g, unknown or other
  misc_feature (210)..(210): n is a, c, g, or t
  modified_base (298)..(298): a, c, t, g, unknown or other
  misc_feature (298)..(298): n is a, c, g, or t
  modified_base (387)..(387): a, c, t, g, unknown or other
  misc_feature (387)..(387): n is a, c, g, or t
  modified_base (402)..(402): a, c, t, g, unknown or other
  misc_feature (402)..(402): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagngccaccctctcctgcagggccagtcagaatgttggcgcctagtatcctggtaccaacagaaacctggccaggcctcccaggccccctnatctatggtgcatccaacgacgggccacgtggccactcccagccaggttcagtggcaggtgggtatgggacagtacttcactctcaccntcatcagcctggacnccgtgaggtatggttgctagtttattacgtntaccaatatccgtacgngtcggccgtccggggcctacgtttccggccgtggaacctaagtgatacgtacgaaacgtactgtcggctgaccacatctgtctctac

SEQ ID NO: 76944 - DNA, 657 bp, Homo sapiens
  misc_feature: GYAE6OF02HAPL8.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctcgtgtgcagcctcgtgggttccaccttcagtaactacggcagtgcacgtcgggtcccgccaagcctccgaggcgaagggattgggaggtggggtggctaggtttgtttcattcgtggagggctaggttgttacgaagttggtaatggactaagtaccgttcccggtaggaacggggcccgtagttaccaccgtactcctaccgaagaacgaactaacgttacccgaacggtaaacaacgtaagttagttaagtttagggactacgtacgaacgtacgtaccttaacgtccgtagacggtaccggacgggtacgtacttaacgtacgtacggtaacgggaaggggaacggggaacgacggtacgggtaacgttaccggaacgttaccgttaccgtttagacggtcgtacgggg

SEQ ID NO: 76945 - DNA, 553 bp, Homo sapiens
  misc_feature: GYAE6OF02JEZ4Y.8.34.D01.1.454.CMB.1.raw
  modified_base (209)..(209): a, c, t, g, unknown or other
  misc_feature (209)..(209): n is a, c, g, or t
  modified_base (294)..(294): a, c, t, g, unknown or other
  misc_feature (294)..(294): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgtaagctggtaccaacacaaacctgcaggctcccagcccctnatctatggtgcactccaacagggccaactggcatcccagccaggttcagtggcagtgggtatgggacaggcttcactctccacatcatcgagcctggacgcctgaggattgtcgctagtttatacgtgtaccaatctcggtaccgaggtcggtcccgtccggggacctacgtttccgccgtacggaacctaagtcggattacacgtaaacgtaccgtaggtcggacttcgaccaccgtgtacgttcgtacttctaaccg

SEQ ID NO: 76946 - DNA, 624 bp, Homo sapiens
  misc_feature: GYAE6OF02HTT85.8.34.D01.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (443)..(443): a, c, t, g, unknown or other
  misc_feature (443)..(443): n is a, c, g, or t
  modified_base (608)..(608): a, c, t, g, unknown or other
  misc_feature (608)..(608): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagataccaccggagagattgtgttgacacaatctccagccaccctgtcttcgtctcgaaggggaaanagccaccctctcctgcgaggccagtcagaatggtgcnctagtntccgtgaccaanagaaacctggaccaggcctcccgacggccccctatactctaagttcggagccaactaccgaaacgcggacccaagtcggactactcccagccctaggttccaggtcggacgaggtgggtagtacggggaactaggtaccttcgactctacaacctatcatcacgtcgtagcgtccgnggagtagttgttagtcttaagtttattacgtacgtactaacgtagtaccgtacggtacggttacggtcccgggtaccggggtaccttaccggtttccggtcccggtacggaaccgtaaggtacgtacgtataccgaaacgtacgtaggtgtacgtacgctacgtntcgtcgttctctaccg

SEQ ID NO: 76947 - DNA, 727 bp, Homo sapiens
  misc_feature: GYAE6OF02JJ1E8.8.34.D01.1.454.CMB.1.raw
  modified_base (209)..(209): a, c, t, g, unknown or other
  misc_feature (209)..(209): n is a, c, g, or t
  modified_base (251)..(251): a, c, t, g, unknown or other
  misc_feature (251)..(251): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaaangccaccctctcctgcaggccagtcagatgtcggctctacgtntcctaggaaccaacacgaacctggaccacggcctacccgacggcccctatatctagtcggtacacctacgtaccgaacggacgggacctacggtcggactaaccgtcccgacggtaccgtaggttaccgacgggtcggacggtacgggttacgggtacgtacgggtaacctaacggttccttacctaccgttacctaccctacgtactccgtaacgtaccgacggttaccggtaggaaccggttccgtaaggtacgttacggttacgttacgttaacgtttaacgttaactacggaacgtaacctacgtaccgggttaccgacgggtcggtacccggttccgggtacccgttaccgttccggaccgtaacggtacggtaacgttacgtagtacgtaaccgtaccggtaacgttcggtacgtaccgacccgtattacccggtacttccgttacgtttcccttacgtacccttacccg

SEQ ID NO: 76948 - DNA, 524 bp, Homo sapiens
  misc_feature: GYAE6OF02FVWCG.8.34.D01.1.454.CMB.1.raw
  modified_base (171)..(171): a, c, t, g, unknown or other
  misc_feature (171)..(171): n is a, c, g, or t
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
  modified_base (360)..(360): a, c, t, g, unknown or other
  misc_feature (360)..(360): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactggtggagtcgtgggggaggcgtggtccagcctgggaggtcacagagactctcgtgtgcagcctctgggttcaccttcagtactacggcatgcactgggtccnccaagctccaggcaagggnttggagtgggtgcagttgttcatctgagggcagtgtcaatggtangcagactcgtgaggcatcacatctcaganacatcaggaacanatgtattgatctagaacagctaagtcctgaggacacgggctatactacgtaggtacggaagggacgggggaaccaggtcgggagttaccgaacgttaccgtccgtttaggacgtcgtcgggg

SEQ ID NO: 76949 - DNA, 578 bp, Homo sapiens
  misc_feature: GYAE6OF02G196K.8.34.D01.1.454.CMB.1.raw
  modified_base (310)..(310): a, c, t, g, unknown or other
  misc_feature (310)..(310): n is a, c, g, or t
  modified_base (331)..(331): a, c, t, g, unknown or other
  misc_feature (331)..(331): n is a, c, g, or t
tcagctcgcgtgtccacgaccggtgctcgatttagatcgtctgtgttgggtttggggggaagaggaagactgacggtcctgccacaggtggtgtttccattcggtgatcagcactgaacacagaggactcaccatggagtttgggctgaactgggttttcctcgttgctcttttaagaggtgtccagtgtcaagtgcaactggtggagtcgtggggggaggcgtggtccagccgtggggaggtcacagagactctcgtgtgcagcctctgggttcaccttcaagtaactacggcatgcacgtgggtcccnccaagcctccgaggcaagggnttgggagtgggtggctaggtttgtttcatctggagggcagttgttacaagtggtatgcagtacgtccgtaggaacgggccgatccaccactctcagagacataccagaacacaatgtattgagactgaacacgacctaagtccgtagacgacgacggacgtatactacgtacgtacggaagggaggggaaccaggacggtacgtaacggttaccgaacgttaccttaccgtttacggacggttcggg

SEQ ID NO: 76950 - DNA, 595 bp, Homo sapiens
  misc_feature: GYAE6OF02F9VBV.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggcctcccaggcccctcatctatggtgcactccaacgacgggcccacgtggacactcccagcctaggttcaggtggcaggtgggtatgggacaggtacttcactctacacatcatcacgctggacgcgtagaggtagtgttagcgttagtttacttacttgtactaactagtaccgtacgtaggtcggtcccggtccgggggtcctaccgtttccggcccgtacgggaaccgtaacggtacggacttacgtaccgtaaacgtacgttacggtcggtactagaccgtaccgtacttacgtcgttaccttctaccg

SEQ ID NO: 76951 - DNA, 536 bp, Homo sapiens
  misc_feature: GYAE6OF02INDFV.8.34.D01.1.454.CMB.1.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
  modified_base (399)..(399): a, c, t, g, unknown or other
  misc_feature (399)..(399): n is a, c, g, or t
  modified_base (512)..(512): a, c, t, g, unknown or other
  misc_feature (512)..(512): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctagtatcctggtaccaacagaaacctggccaggctcccaggccccctnatctatggtgcatccaacgagggccacgtggcactcccagccaggttcagtcggcagtgggtatggggacagtacttcactctcaccatcatcagcctggacnccgtggaggtatgttgcttaaggtttattacgttgtacaactactcgtacgagtcggcccgtccggggcctacgttccgccgtggacctaagtggactagtacgaaacgtacngtcgctgcctacatctgtctgtac

SEQ ID NO: 76952 - DNA, 765 bp, Homo sapiens
  misc_feature: GYAE6OF02IV6WK.8.34.D01.1.454.CMB.1.raw
  modified_base (210)..(210): a, c, t, g, unknown or other
  misc_feature (210)..(210): n is a, c, g, or t
  modified_base (249)..(249): a, c, t, g, unknown or other
  misc_feature (249)..(249): n is a, c, g, or t
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagataccaccggagagattgtgttgacacaatctccagccaccctgtcttcgtctccgagggaaancgccacccgtctcctgcagggccagtcagaatgttggcnctagtatccgtggtaccaanagaaacctggccaggctccgaggcccctnatctatggtncactccaacgaggccacgtggcctactccagcctaggttccagtcggcacggtggtacgtaggggacagtacttcgaaccgttctaccgtaacctacgtcgtaactccgtacgtaccgttcgggaaactcccggtaggtaacggtacgttcggttacggtaccgttaaggttttacgtttaaccgttacggttaaacccgtaacgttaaacggtttaacccgggtttaaccgggttaaaccgggttccggggttacccccgggttacccgggggggttaacccttaacccgggttttcccgggttaccccggtaacccgggggtaaaacccgtaaaccgggttacggtaacgttaacgttaacccggtaaaacgggttaaccggtaaacggttccggttaccgtaccggaaccgtaccgttaccgtaccgtttacgttaccgttacccgttaacccg

SEQ ID NO: 76953 - DNA, 641 bp, Homo sapiens
  misc_feature: GYAE6OF02IAFMO.8.34.D01.1.454.CMB.1.raw
  modified_base (211)..(211): a, c, t, g, unknown or other
  misc_feature (211)..(211): n is a, c, g, or t
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
  modified_base (371)..(371): a, c, t, g, unknown or other
  misc_feature (371)..(371): n is a, c, g, or t
  modified_base (402)..(402): a, c, t, g, unknown or other
  misc_feature (402)..(402): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagcccaccctgtcttcgtctccgaggggaaancgccaccctctcctgcgaggccagtcagatgtgcgcctagntctcgtacaacagaacctggccaggcctccgacggcccctnactctagtggtcacactaccgaacgacgggccagtcggcacgtcccagccgaggttcgagtcggcgtaggtgggtagnggactagacctgacctctcgacatcgatacncgcctaggcgtcggtgggtatcggtagtccttagttattcgtacgtacgactacggtccggtccgtagggtccggtaccccgggtccggggttaacccttaccgggttccccgggtaccgtaccgggggtaaacttaacggggaccgggtaataaccggtaacccgaaaccggttcgttaccgggtgtacccgtacgtccgaaccttgttcccgtacgtttactcccgttacgttcccg

SEQ ID NO: 76954 - DNA, 637 bp, Homo sapiens
  misc_feature: GYAE6OF02IU7AU.8.34.D01.1.454.CMB.1.raw
  modified_base (298)..(298): a, c, t, g, unknown or other
  misc_feature (298)..(298): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttccaccttcacgtaactacggcatgcactgggtccnccaagcctccgaggcaaggggnttgggaggtgggtggctaggtttgttcatcgtggaggctagtgttacaagtcggtatgacaggtacctccggtaggaacgggccgtattccacctactcctcgagacactaaacttccaacgaacaacaattagttatttaggacgtacagaaaccgtagtacctaacgttccgtaggaacggaccgacgggtaccgtacgttaaccgtactaaggtaacgggaaacggggtaaccgggggaaccgagggtaccgggtacggttacccgtaacggttaccgttacccggtttacggtaccggttccggtaccggggg

SEQ ID NO: 76955 - DNA, 755 bp, Homo sapiens
  misc_feature: GYAE6OF02JIKFY.8.34.D01.1.454.CMB.1.raw
  modified_base (210)..(210): a, c, t, g, unknown or other
  misc_feature (210)..(210): n is a, c, g, or t
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanacgccacctctcctgcagggccagtcagaatgtggcgctacgtancctggaccacagaacctggccaggcctcccgaggccccctnaacgtcctaagttcggtcgacctacgtccaaacgtacgggccctacgtcgggccaacgttccccgaagcccgtaacgggtttccaacgggtcggtacccgaaggggtttaggggttaacgtacgggggaacctacggtaacctttaccgaacccgttccgtaacccaacccctagttccacgttacgacggtacccgtagggtaaccgtcccgtagggacgtacgttgttacggtcttaacggtttactttacgtacgtactaacgtatacccgggttaccgagggttacccggtacccgggttacccggggggtaccccttaccggttttacccgggaccccggttaacggggaaccgttaacgggttacgggtacttaacggtacccgtaaacggtacgttcggtaccggacgttcgaccctacgtaccgttacgttccgttacgttcccttaaccg

SEQ ID NO: 76956 - DNA, 696 bp, Homo sapiens
  misc_feature: GYAE6OF02F56F2.8.34.D01.1.454.CMB.1.raw
  modified_base (262)..(262): a, c, t, g, unknown or other
  misc_feature (262)..(262): n is a, c, g, or t
tcagctcgcgtgtccacgaccggtgctcgatttagatcgtctgtgttgggtttgggggaagaggaagactgacggtcctgccacaggtggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctntggttcaccttcagtaactacggcatgcactgggtccacaagctcaggcaaggggattgggagtgggtggcaggttgtttcatcgtggagggctaggtcgttcaagtggtatgacagaccgtccgtaggaacgggtccgtagttacacctatcctaccgagacgtaacctaagttacccgaagggaaaccaacgtaaagttacgttaagttttacgggacggtactacggaaaccgtaacgtacccgttaaagttacccgtaggtaacgggtaacgaaccggggtacgttaacgtaaccgttacgtacggtaaacgggtaaaacggggaacgggggggtaaaccctaacggggtaaccgggttaacggttaacccggtaacggtttaacccgttacccggttttaaccggtaccggttacgggtacccgggggg

SEQ ID NO: 76957 - DNA, 566 bp, Homo sapiens
  misc_feature: GYAE6OF02F28MW.8.34.D01.1.454.CMB.1.raw
  modified_base (210)..(210): a, c, t, g, unknown or other
  misc_feature (210)..(210): n is a, c, g, or t
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (294)..(294): a, c, t, g, unknown or other
  misc_feature (294)..(294): n is a, c, g, or t
  modified_base (389)..(389): a, c, t, g, unknown or other
  misc_feature (389)..(389): n is a, c, g, or t
tcagctcgcgtgtccacgaccggtgctcgatttagatcgtctgtgttggggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctntcctgcagggccagtcagatgttggncctagtntcctggtaccaacagaaacctggccaggctcccaggcccctnactctatggtgcatccaacagggccactggcatcccagcctaggttcagtgcaggtggtatgggacagacttcactctcacatcatcagcctggncctgagatgtgctagtttatctgtcagcagtcgtagtaacgtcgtcctttcgtaccgtttcggcccttagggtaacctaaaggtcggtacttaacgtaaccgaaaaccggtaacggttacggtacggtaccgtacgaccctaacccgtagttcccgttcggtttaccttactaccgg

SEQ ID NO: 76958 - DNA, 793 bp, Homo sapiens
  misc_feature: GYAE6OF02IN7AF.8.34.D01.1.454.CMB.1.raw
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
  modified_base (313)..(313): a, c, t, g, unknown or other
  misc_feature (313)..(313): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaaancgccaccctctcctgcagggccagtcagaatgttggcgcctagtatcctggtaccaacagaaacctggaccaggctcccaggccccctnaatctactgggtcncaactcccgaaacgcgggcccaacgtcggaccaactccccgaacggcccgtaagggtttccaaggtcggaccgtaagggttcggggtaagttacgggggaactaagggtaacctttcgaaccttcccgttaccaaacccctaagtttcccgaaacttccgaacggtcccgtttagggggaaaccgtccccgttagggaaacgggtaactttacgggtttgtaaccgtttaaggtttttaaactttaacccgttacggttaacctaaaaccgttacgttacccggttaaccggtaagggttacccgggtccccgggttacccgggggggtcccctttaaccgttttcccggggaccccggtttacgggaaacccgttaaacggttcgggaattaaccggttaccgaaaaaccggtacttacgggtacggtacgttacgaccgtaacctaacgttcgttacgttaccgttacttaaccccgg

SEQ ID NO: 76959 - DNA, 653 bp, Homo sapiens
  misc_feature: GYAE6OF02ISHYI.8.34.D01.1.454.CMB.1.raw
  modified_base (116)..(116): a, c, t, g, unknown or other
  misc_feature (116)..(116): n is a, c, g, or t
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (647)..(647): a, c, t, g, unknown or other
  misc_feature (647)..(647): n is a, c, g, or t
tcagctcgcgtgtccacgaccggtgctcgatttagatcgtctgtgttgggtttgggggtagggaactgcgtcagttaggacccagagggaaccatggaagccccagctcagcttcncttcctcctgctactctggctcccagtttcagtataccaccggagagattgtgttcgacacaatctcagccaccctgtcttcgctccgagggaaacagccaccctctcctgacacgggccngtcagaatggttcggccncctacgtatcctaggtaccaagacgaaacctggaccacggctcccacggcccctgacttcgtaacttgggtcgccataccgaacgacgggcccaacgttcggcgaacctccctaacggcctacgggttcacggttcggcctaaggttgggtaccgttaggggcaacggtcttacaacctctaccgaccaagctatcgacgtacctaggacgcctaggagggtactggttacgcgtaagtttagttaacttcggtacaaacgtctacggtaacccgagtaccggccgtaccggggcctaaccgtttccgcccggttacggaaccgtaaggttaccggattaataccggaaacgtaacgtggtcgcgtacgtcacctagtcctcgttaccgttntaaccg

SEQ ID NO: 76960 - DNA, 588 bp, Homo sapiens
  misc_feature: GYAE6OF02GM3N1.8.34.D01.1.454.CMB.1.raw
  modified_base (297)..(297): a, c, t, g, unknown or other
  misc_feature (297)..(297): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttccaccttcagtaactacggcatgcacgtgggtccnccaagctccaggcaagggattgggagtggggtgctagttgttcatcgtgagggctagtgttacaagttggtatgacaggtacctccggtagaacgggccgtattccaccatcctaccagagacaactaccgaggaacaacaattagtagttaggagtcgtagaacagtacctaacgtcctaggacgacgacggacgtacgtacgtacgtggtaacggaagggaacgggggaaccgaggtacgggtagttaccgaaggttaccgttaccgtttacggtacggtcgtacgggg

SEQ ID NO: 76961 - DNA, 569 bp, Homo sapiens
  misc_feature: GYAE6OF02FJZHS.8.34.D01.1.454.CMB.1.raw
  modified_base (474)..(474): a, c, t, g, unknown or other
  misc_feature (474)..(474): n is a, c, g, or t
tcagctcgcgtgtccacgaccggtgctcgatttagatcgtctgtgttgggtttggggggaagaggaagactgacggtcctgccacaggtggtgtttccattcggtgatcagcactgaacacagaggactcaccatggagtttgggctgaactgggtttttcctcgttgctcttttaagaggtgtccagtgtcaagtgcaactggtggagtctgggggaggcgtggtccagcctggggagtcacagagactctcgtgtgcagcctctgggttcaccttcagtaactacggcatgcacgtgggtcccgccaaactccaggcaagggattggagtggggtgcagttgtttcatctgagggcagtgttcaagtggtatgctgacgccgtgaacgggccattcacatctccagacgacaactccaggaacacaatgtattggacctagaacagtacctaagtcctagaggacacgggtntatactacgtagtacgaagggacgggggaaccgaggacgggacgttaccgaacgtacgttaccgtttaggtacgtcgtacggggccgtaacgggg

SEQ ID NO: 76962 - DNA, 839 bp, Homo sapiens
  misc_feature: GYAE6OF02I13FM.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggcctccagtttcagatacccaccggagagtattgtgttgacacaatctccagccacctgtcttcgtctccgagggaagcgcccacctctccgtgcgacgggcctagtcaagaagttggttcggccgtcctaacggtactcccgtaggtaaccaacacgaaaccgtggaccgacggcctaccccgacggtcccctagtactctacgtggtcgactacgtaccgaacggacgggacctacgtcggacctacgtaccccgacgtccgtaaggttcgagggtcggacgtagggttacgggtagtacgggacacgttaccttacgaccttccgtaccaacctactctacgtaccgaccgtacccgttgggaacccgttcccggttagggaacggtacgttcggtttaccggtaaccgtttaaggtttttaactttacctcggttaaacctaaaccgttccggttaacccgggttaaccggtacgggtttaccccgggtaccccgggggtttaccccgggggtaacccttttaaccccggggtttcccggggtacccccggttaacggggtaaaccccgtaaggggttaccgtaacgttaaccggttaacccggtaaaaaccgggttaccggttcgggttaaccggtacccgtaccggtaacccaaccgtttacggttacccgtttacggttttaccctacgtttaacccccgg

SEQ ID NO: 76963 - DNA, 725 bp, Homo sapiens
  misc_feature: GYAE6OF02HAFAJ.8.34.D01.1.454.CMB.1.raw
  modified_base (210)..(210): a, c, t, g, unknown or other
  misc_feature (210)..(210): n is a, c, g, or t
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (358)..(358): a, c, t, g, unknown or other
  misc_feature (358)..(358): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagcccaccctgtctcgtctccgaggggaaancgccacctctcctgcagggccagtcagatgttggcgcctagtancctggtaccaanagaaacctggcaggcctccgacggcccctagatctagtggtgacactaccaacgacgggccacgtggcactcccgagccgtaggtcctaggnggacgaggttgggtaagtcggggaactacgacgttcacgttcgccaacctagtctaactacgacgtaccgtgggtacgccgtaggaacgggtagttacggttagtacggttaagttttaacgttaacgttacgtaacgtaacctaacgtaccggtaaccggtaacgggttccgggtaccccgggttcccggggggtaacccttaccgggttttacccgggtccccggtaacgggtaaacccggtaaacggttacgggtaacgttaacggtaaccgtaaaacccgggtaacgttaccggggttacggaccgtttaacggacccgtaacccgtaggttacccgtcggtttacccttacgttaaccccgg

SEQ ID NO: 76964 - DNA, 653 bp, Homo sapiens
  misc_feature: GYAE6OF02H9ANV.8.34.D01.1.454.CMB.1.raw
  modified_base (253)..(253): a, c, t, g, unknown or other
  misc_feature (253)..(253): n is a, c, g, or t
  modified_base (338)..(338): a, c, t, g, unknown or other
  misc_feature (338)..(338): n is a, c, g, or t
  modified_base (370)..(370): a, c, t, g, unknown or other
  misc_feature (370)..(370): n is a, c, g, or t
tcagctcgcgtgtccacgaccggtgctcgatttagatcgtctgtggttgggtcgtgggacgaggacgcccagcactagaagtcggcggtgtttccattcggtgatcagcactgaacacagaggactcaccatggagtttgggctggaacttggggttttcctcgttgctcttttaagaggttgtccagtgtcaagtcgcaactggtggagttccgtggggggagccggtggtccaggcctggggaggtcacgngagactcgtcctgtgcagccctgtgggttcaccttcagtacgctacggcatgctacgtgggtcccaccaaactccaggcaagggnttgggagtgggtgctaggtttgttcagttcgnggacgggtcaggttgttacaagttggtatggactggaccgccggtaggaacgggccgtagtcaccacgtctcagacgacaactccgaagaacacgaatgtagtttggacctagaacacgacctacgtccgtaggacggtaacgtacgggtagtaacgttacgtacgtacggtaacgggaacggggtaacggggggaaccgtaggggaccgggttaaccgttaccggtaaacggttaccgttaccgtttacgggtaccggttaccgggtacggggtaacccggg

SEQ ID NO: 76965 - DNA, 500 bp, Homo sapiens
  misc_feature: GYAE6OF02HT2IN.8.34.D01.1.454.CMB.1.raw
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
  modified_base (390)..(390): a, c, t, g, unknown or other
  misc_feature (390)..(390): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (441)..(441): a, c, t, g, unknown or other
  misc_feature (441)..(441): n is a, c, g, or t
  modified_base (493)..(493): a, c, t, g, unknown or other
  misc_feature (493)..(493): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccncaagctccaggcaaggntggagtgggtgctagttgtttcatcgtgagggtcagtgttcaagtggtatgctgacgcgtgaggtccgatcacatcncagagacactccagaacacatgtattgactnacnactagctgagacaggtnatacatgtacgagggagggaacaggagtagtccgagtctcttagacgttcgngggtccg

SEQ ID NO: 76966 - DNA, 631 bp, Homo sapiens
  misc_feature: GYAE6OF02I8MS7.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccagggaaagagccaccctctcctgcagggccagtcagaatgttgcgcctacgtatcctggtaccaacagaaacctggccaggcctccccaggccccctcactcctagtggtcgcactccaacgagggcccacgtggcctactaccccagcctaggttcacggttggccaggtggggtacgtaggggacaaggtacttacaccgtctccgaacccagttaccatccacgtcccgtgggacgcccgttggaggtatcggttacgctaaggttttattacgtgtaccaactacgtacgtacgagtcggcccgtaccgggccgtacgtttccgacccggtcggaacctaacggttggactttacgtaaccgtaaaaccgtacgtacgggtcgtacgtacgaccgtacctacgttaccgttcgttacttactacccg

SEQ ID NO: 76967 - DNA, 659 bp, Homo sapiens
  misc_feature: GYAE6OF02JKGZJ.8.34.D01.1.454.CMB.1.raw
  modified_base (328)..(328): a, c, t, g, unknown or other
  misc_feature (328)..(328): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtggggaggtcacaggagactctcgtgtgcagcctcgtgggttccaccttcacgtaacacggcagtgcacgtgggtcccgactaagcctcgaggcgaagggtnttggagtggggtggactagttcgtttcagttcgtggaggctaggttgtacaatggtatgcagacttccggtaggaacgggccgtattaccactacgttcctacgaggtaagactaacgttacccggaaaggaaccctaacgtaattacggttagtttaggaacggtccgtacgaacgtaacgtacccgtaaagtcccgagggtaaccgaaccggtaccggacgttactacgtaccgttaggaacgggtaaggggtaaccggggaaaccgacggtacgggtaacgttacccgtaaggtacccgtttcggttcggaacggttccggtacgggg

SEQ ID NO: 76968 - DNA, 514 bp, Homo sapiens
  misc_feature: GYAE6OF02GINCK.8.34.D01.1.454.CMB.1.raw
  modified_base (209)..(209): a, c, t, g, unknown or other
  misc_feature (209)..(209): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (401)..(401): a, c, t, g, unknown or other
  misc_feature (401)..(401): n is a, c, g, or t
  modified_base (435)..(435): a, c, t, g, unknown or other
  misc_feature (435)..(435): n is a, c, g, or t
  modified_base (493)..(493): a, c, t, g, unknown or other
  misc_feature (493)..(493): n is a, c, g, or t
  modified_base (511)..(511): a, c, t, g, unknown or other
  misc_feature (511)..(511): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctcccaggcccctnatctatggtgcatccaacngggccatggcatcccagccaggttcagtggcagtgggtatgggacaggacttcactctcaccatcatcagctggacgcctgagtntgtgctagtttatacttgtacaactatcgtacgngtcggccgtccggggcctcgttcggccctgggaccaagtgatactacgaacgactggngctgcacactctcgtctntac

SEQ ID NO: 76969 - DNA, 668 bp, Homo sapiens
  misc_feature: GYAE6OF02H12SU.8.34.D01.1.454.CMB.1.raw
  modified_base (172)..(172): a, c, t, g, unknown or other
  misc_feature (172)..(172): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagnggtgtccagtgtcaagtgcaactggtggagtcgtggggggagcgtggtccagcctgggaggtcacagagactctgtggtgcagcctcgtgggttcaccttcagtaaactacggcatcgctacgtcggggtcccaccgaaagcctaccgaggacaaaggggtattggggaggttgggtaggctaggtttcgtttacatcgtggaggggtactaggttgttacaagttggtactgcagacgttcgaggaacggccgatcacatctccagagacaaacgttccaaggaaacctaagtaactagttacttagggagtcgtagaacgtaacgtaccgtaaacgtccctaggtaaggaccgacggtacgtaacttaaccgtaacgtaggttaacgggaaacggggtaacggggggtaaaccgacgggtaaccggggtaacggtttaccggtaaaccggttaccgtttacccggtttaggtaccggttaccgggttaccgggg

SEQ ID NO: 76970 - DNA, 709 bp, Homo sapiens
  misc_feature: GYAE6OF02F9MMC.8.34.D01.1.454.CMB.1.raw
  modified_base (301)..(301): a, c, t, g, unknown or other
  misc_feature (301)..(301): n is a, c, g, or t
  modified_base (350)..(350): a, c, t, g, unknown or other
  misc_feature (350)..(350): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggaggcgtggtccagccgtgggagtcacagagactctcgtgtgcagcctcgtgggttccaccttcagtaactacggcatgcactgggtcccnccaagctccgaggcaagggattgggagtggggtggctaggtttcgtttnagttcgtaggacgggcaggttcgtttacgaagttggtaatgacgtaacggtaccgtccggtagggaacgggtccgtaattccgaaccgtacgtacctacccgaggaacgtaacctaaacgttacccgaacggaaacctaacaaagtttacgttaagtttagggacgtccgtaacgtaaacgtaacgtaccgttaaacgttcccgtaggaacgggtaaccgaccggggtacgttactaaccgttacgttacggtaacgggaaaggggtaacggggggaaaccgtaagggtaccgggtaacggttacccggaaacggttacccgttaccgtttacggtaccggttccggttaacccggggg

SEQ ID NO: 76971 - DNA, 628 bp, Homo sapiens
  misc_feature: GYAE6OF02IE2B3.8.34.D01.1.454.CMB.1.raw
  modified_base (203)..(203): a, c, t, g, unknown or other
  misc_feature (203)..(203): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtcgttacccacccagttacgcctggtaaccaacacaaacctggccaggctcccacggcccctcatctttgatgcactccatcgagggccacgtcggccatcccgacgccgaggttcaggttggaccgtaggtcggggtctggggaccagtaccttcactctaccaccactcagcgacgcctagacgcctagaacgtacttttgacgttaagttttacttacttcgtactaacgtacgttaccgtaccgtagtccggtccggtccggggacccttccgtttccggtcccggtacgggaaccttaaagttcgaagtactacgaacgtagttacggtaggtccgtacgtctaaccgtagttccttacgttccttacctaccgttccctccccgtaccg

SEQ ID NO: 76972 - DNA, 661 bp, Homo sapiens
  misc_feature: GYAE6OF02JFAPI.8.34.D01.1.454.CMB.1.raw
  modified_base (395)..(395): a, c, t, g, unknown or other
  misc_feature (395)..(395): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcagggccagtcagagtcgttaccaccctagttacgcctaggtaccaacacaaacctggccaggctcccacggcccctcatctttgatgcactccatcgaggccacgtggcactccagccaggttcagtggcgaggtgggtctgggacacgtacttcacttctccacacnctagcacgccttaagacgtctaggaacgttagtttcgacgttagttttaacttacgttacgttacctaaaccgtacttacccggttaccggacggttccgggtacccggttcccgggggtaccttaacccggttttcccgggacccggttaacgggaaacccttaaaagttcgggaaccgtacgtaaccgtaaaccggtaacgttacgggttcggtacctcggtaccgacctacgttccgttcgttcctttaccgactttccccgg

SEQ ID NO: 76973 - DNA, 675 bp, Homo sapiens
  misc_feature: GYAE6OF02H0ZRP.8.34.D01.1.454.CMB.1.raw
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccaccggagagattgtgttgacacaatctccagccaccctgtcttcgtctccaggggaaangccaccctctcctgcagggccagtcagatgttggcncctagtatcctggtaccaacagaaacctggccaggcctcccaggcccctnatctatggtncatccaacgagggccactggcactcccagccaggttcaggtcggcaggtgggtatgggacagtacttcactctacacctatccatcacgccgtaggacgtccgtaggaggtacgttggttcgtacgttaacgttttaacgtttacgttacgttaccaaactacgtaccggttaacccgtaacggttcgggtaccccgggttcccgggggtacccttacccggttttcccgggaccccggttacggggtaaacccgtaaacgggttcggtaacttaacgttaaccgtaaaaccggttaaccggttcggttacgggtaccgttacggaccctacccgttaacgttccgttacgtttaccgtttccgtaacccg

SEQ ID NO: 76974 - DNA, 754 bp, Homo sapiens
  misc_feature: GYAE6OF02I70G0.8.34.D01.1.454.CMB.1.raw
  modified_base (331)..(331): a, c, t, g, unknown or other
  misc_feature (331)..(331): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacagagactctcgtgtgcagcctcgtggttcaccttcagtaactacggcatcgcacgtgggtcccgaccaaggcctaccgagggaccgaaaggggnttgggaggtggggtcgctaggtttgtttcagttcgtggaggggactaggttgttacaaagttggtaatcggacgtaggtaccgtccggagggtaacgggtccgtacgttacccgaaccctacgtccctaccgaacggtaacgaacgtaaaccgttacccgaaacgggtaaacctaacgtaaacgttaggttaacgtttagggtaacggtacgttaacggaaccgtaacggtaacccgttaaacggttacccgtaagggtaaccgggaaccggtaaccggggtaaccgttaagttaaccgttacgttacgggtaaacgggaaaggggtaaccggggggaaccgtaacggggtaccgggtaacggttaacccgtaacggtttaccgttacccggtttaacggtacccggttacgggttaccgggg

SEQ ID NO: 76975 - DNA, 548 bp, Homo sapiens
  misc_feature: GYAE6OF02FOXPS.8.34.D01.1.454.CMB.1.raw
  modified_base (316)..(316): a, c, t, g, unknown or other
  misc_feature (316)..(316): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctggggagtcacagagactctcgtgtgcagcctctgggttccacttcagtaactacggcatgcactgggtccgccaagctccgaggcaagggnttggagtgggtgctagttgttcatctgaggcagtgttacagtgtatgcagctcgtagaggccgatcacatctcagagactatccaggaacacaatgtattgagtctagaacagacctaagtcccgtagtacggacgacgggtcgtactacgtactaggtaacgggaagggagggggaaccgaggacgggtagttaccgaagttaccgtccgtttcggaccgtcggtaccggg

SEQ ID NO: 76976 - DNA, 670 bp, Homo sapiens
  misc_feature: GYAE6OF02G15YR.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagaatgttgcgcctacgtatcctggtaccaacagaaacctggccaggcctccccgaggccccctcactctagtggtgcatccaacgagggccacgtggcactccccgagcctaggttccaggttcggcagggtgggtagtggggacaggtaccttacgaccgttctaccacctatccaacttcacgtccctagggacgccgtagaggattggttcgcgttagttttattacgttgtacctaaacgtcttaccgtaccggtacggttcgggtcccggttcccgggggtccttaaccggttttccgggaccccggttacgggaacccgtaaagggtcggtaacgttacgtaaccgtaaacggtaaccgttcggtacggtaccgtacgacccgtaaccgttaccttacccgtttacggttacctttaccgtaacccg

SEQ ID NO: 76977 - DNA, 667 bp, Homo sapiens
  misc_feature: GYAE6OF02GPU05.8.34.D01.1.454.CMB.1.raw
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (291)..(291): a, c, t, g, unknown or other
  misc_feature (291)..(291): n is a, c, g, or t
  modified_base (313)..(313): a, c, t, g, unknown or other
  misc_feature (313)..(313): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcaggccagtcagaatgtgcnctagtntcctggtaccacagaaacctggccaggctcccaggccccctnatcctatggtgcactccaacgngggcccacgtggcaatcccagccaggttcagtgcaggtgggtatgggaccagtaccttcacgttctaccaccattccatccacgtccgtacgggagcccgtggacggatggttgtacgtaggttttacttacttggttacctaaactacgttaccgttaaccgacggttccgggtcccggttcccgggggtacccttaccggttttcccgggaccccggttacggggtaaacccgtaaacgggttacgggtacgttaaccgttaaccgaaaaccggtaaccggtttcgggtacggtaccgtttacggacccgtaaccgtaaccgttccgttacgttcccgttaccgttaacccg

SEQ ID NO: 76978 - DNA, 613 bp, Homo sapiens
  misc_feature: GYAE6OF02IP0YE.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaaataggcatgcactgggtccgccaagctccgaggcgaagggattgggagtgggtggctagttgttcatcgtagacgggcagtgttacaagtggtaatgcagtactccggtagaagggtccgagttccgacctatcctaccagaacgactaagttacccgaaggaacctaacgtaatagttaacgtttaggacgtacgtcgaacaacgtaccttaaggtcctaggacggacgacgggaccgttacgtactacgtacgtaacggaacggggaacgggggaaccagggtaccgggaaggttaccgtaacggttacttacccggttaggtacggtcgtacgggg

SEQ ID NO: 76979 - DNA, 839 bp, Homo sapiens
  misc_feature: GYAE6OF02HO9RG.8.34.D01.1.454.CMB.1.raw
  modified_base (304)..(304): a, c, t, g, unknown or other
  misc_feature (304)..(304): n is a, c, g, or t
tcagctcgcgtgtccacgaccggtgctcgatttagatcgtctgtgttgggtctgggagaggagcccagcactagaagtcggcggtgtttccattcggtgatcagcactgaacacaggaggactcaccagtggtaggtttgggctagaacgttgggttttccctcggttgcttacgttttaaaggaggttcgtccgtaggttgtacgtaaaggttcgaccaagttggggtggacggttcggtgggggggagcggttcggtccaggtccggttggggacggtccagacggacgtcctcgtcggtgngccacgtccgtcgttcgggttacctaccgtttacgacggtaaacctcgggactagtcggtccgtaccggttccggggtacccgacccgtaaacggccgttaccccggaaggggtaccgtaaaggggtgtttacggggagggtttccggggtggcgtttaacggtttcggttttaccgaagttcggtacgggaggggtaccttaggtacggtttacgaagttcggtaagtcggaacgtacggtaccgttccggagggtaaccgggtccgtacgttaccgacctacgtaccgtaccgtaagtaacgtaactaacgttacccgaaagtaacctaacgtaagttacgttacgttacgtacgtacgtaggaaccgtacggtaccgtaacgtccgtaaggacgtaaccggtacggtaacgttactaccggtacgtaacggtaacgggtaacggggaacggggtaaccgacgggtaaccgggtaacggttaccgtaaccggttaccgttacccggtttacggtaccggtacggtacccgggg

SEQ ID NO: 76980 - DNA, 764 bp, Homo sapiens
  misc_feature: GYAE6OF02JYJNH.8.34.D01.1.454.CMB.1.raw
tcagctcgcgtgtccacgaccggtgctcgatttagatcgtctgtgttgggtttggggggtaaggaggaagactgacggtcctgccacaggtggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccgagccgtgggaggtcacagagactctcgtgtgcaggtcctctggttcaccttcagtaactacggcatgcacgtggtacccgccaagcctaccgacggtaccgaagggtacttggggaaggtggggtcggagtacggtttgtttacgacttccgtaggtacgggcctaggttacgttacctaaagttgggttaatcgggtacaggttaaccgttcccggtagggtaacggggtaccccgtacgtttaccgaaccccgtaacgttacccgtacccgtaacgaaccggtaaccctaacgtttaaccccgaagggtaaacccaacgtaacgttaggtttaagttacgggtaggtaccgttagtaaaccgtacgtaaccgttaacgtaccggtaggtaaccggtaaccggaccggtaccgttaagtacccgttacgtaggttaccggaaacggggtacggggtaaccgaccgggtacgggtaccgttaccgaaccggtaccgttaccgtttaccggtaccgttcgggttaacccgggg

SEQ ID NO: 76981 - DNA, 588 bp, Homo sapiens
  misc_feature: GYAE6OF02GM0Q8.8.34.D01.1.454.CMB.1.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
  modified_base (377)..(377): a, c, t, g, unknown or other
  misc_feature (377)..(377): n is a, c, g, or t
  modified_base (397)..(397): a, c, t, g, unknown or other
  misc_feature (397)..(397): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttgaagctggtaccaacacaaacctggccaggctcccaggccccctnactctatggtgcatccaacagggccacgtggcactcccagccaggttcagtcggcagtgggtatgggacagtactcactcncaccatcatcagcctggacnccgtagaagtatgttgctagtttacttacgttgtacaactactccggtacgtaggtcggtacccggtcccgggggaccttaccggtttccgggcccgtacgggtaccgtaagggtcggagtacgtaccgaaacggtaaccgtaggtacggtacgttagacctaccgtacgtacgtacgttccttactaccg

SEQ ID NO: 76982 - DNA, 590 bp, Homo sapiens
  misc_feature: GYAE6OF02IYTAP.8.34.D01.1.454.CMB.1.raw
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (445)..(445): a, c, t, g, unknown or other
  misc_feature (445)..(445): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagccctctggggttcaccttcagtaactacggcatgcacgtgggtcccnccaagcctccgaggcaagggnttggaggtgggtggctaggttgttcatctggagggcagtcgttacaatggtatgcagactccggtggaacgggccgattcacctatctccagagacaattccaagaacacatgttattggagntagaacacgtacctaagtccgtagacggaacgacgggtacgtacgtactacgttaggtaacggaaggggaacgggggaaccgaagggccgggtaagttaccgtaacggttaccgttaccgtttacggtacggttccgtacggggg

SEQ ID NO: 76983 - DNA, 644 bp, Homo sapiens
  misc_feature: GYAE6OF02IJBTP.8.34.D01.1.454.CMB.1.raw
  modified_base (298)..(298): a, c, t, g, unknown or other
  misc_feature (298)..(298): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagacctctcgtgtgcagcctctgggttcaccttcagtaactacggcatgcactgggtccnccaagcctccaggcaagggattggagtgggtgctaggttgttccatcgtggaggggcaggttgttcaaagttggtaatacgagaccttccggtaggaacggggccctaattccaccgtatcctaccgaagtacgaaactaacttccgaacggaaacaactaaagttcgttaatttggacgtactagaaacgacgtaccttaagtccgtagaacgggaccgacgggtacgttaacgtaccgtaacgtacggtaacggaaggggaacgggggaaccgagggtaccgggtaacgttacccgaacggttaccgttaccgtttacggaaccggttcggtaggggtacccgg

SEQ ID NO: 76984 - DNA, 596 bp, Homo sapiens
  misc_feature: GYAE6OF02HEUF4.8.34.D01.1.454.CMB.1.raw
  modified_base (209)..(209): a, c, t, g, unknown or other
  misc_feature (209)..(209): n is a, c, g, or t
  modified_base (297)..(297): a, c, t, g, unknown or other
  misc_feature (297)..(297): n is a, c, g, or t
  modified_base (394)..(394): a, c, t, g, unknown or other
  misc_feature (394)..(394): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctcccaggcccctnatctatggtgcatccaacagggccactggcatcccagccaggttcagtggcagtgggtatgggacagacttcaactctcaccatcatcagcctggancctgaggatgttagctagtttattacgttagttacaactactcgtaccgtaaggtcggtcccgtccgggggcctaccgtttccggtccccggtagggtaaccctaaacgggttcgggtacttaacgtaccgtaaaccggtaactaggtaccgggtacttacggtacgacccgtaacttaccggtcgttacgttcctaacccg

SEQ ID NO: 76985 - DNA, 773 bp, Homo sapiens
  misc_feature: GYAE6OF02HZV6U.8.34.D01.1.454.CMB.1.raw
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggtttcctgttgcttctttaagaggtgtccagtgtcaagtgcaacgtggtggagtcgtgggggaggcgtggtccaggccgtgggagtcacgagagactctcgtgtagcagtcctcgtcgggttccaccgttnaagtaacctacggcatgcacgtgggtccnccaagcctccgaggactaagggacttgggaggtgggtacggcttaggttcgttacgagttcgtacggaggggtcctagggttgttacgtaagttcgggtaatcgggactaacggtaaccgttccggtaggggaaaccggggtccgttaacgtttcccgaacccgtaccgtttccgacccgtaaggtaaacgtaaccgttaaacttacccggaaaacggtaaacaaaccgttaaattagggttaacttacgggtacacgttaacggaaacgtaaccgtacccgtaaacgtacccgtaacggaacggtaccggtaacgggtaccgttaacgttaccgtaccggttaacgggtaaaccgggaacgggggtaacgggggaaccgtaacggggtaccggtaaccggttaccggtaaccggttacccgtttaccggtttaacggtacccgggttacgggtaaccccggggg

SEQ ID NO: 76986 - DNA, 674 bp, Homo sapiens
  misc_feature: GYAE6OF02GBI3V.8.34.D01.1.454.CMB.1.raw
  modified_base (311)..(311): a, c, t, g, unknown or other
  misc_feature (311)..(311): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagatgtgcgctacgtatcctggtaccaacagaaacctggccaggcctccccacggccccctcatcctatcggtcnctactccaacgagggcccaacgtcgggctactcccgacgccgtaggttcaggttcggaccagggtcgggtataggggacaggtacttcgactctacacctatcactcaacggccttggacgcccgtaggaggtagtggttacgcttaagttttactacgttcgtaactaacgtagttccggttaccgaggtaccgggtcccggtacccgggggtaccttacccggttttccgggacccgtttacggggaacccttaaagggtcggtaacgtacggtaaccgtaaaaccgggtacttacgggggtacggtcgtaccggaacccgtaccgtacgttcccgttacggttccccttagttacccccg

SEQ ID NO: 76987 - DNA, 585 bp, Homo sapiens
  misc_feature: GYAE6OF02JHA9S.8.34.D01.1.454.CMB.1.raw
  modified_base (209)..(209): a, c, t, g, unknown or other
  misc_feature (209)..(209): n is a, c, g, or t
  modified_base (390)..(390): a, c, t, g, unknown or other
  misc_feature (390)..(390): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcttcgtaagctggtaccaacacaaacctggaccaggctcccaggccccctcactctatgggtgcatccaacgacgggccacgtggcactcccagccgaggttccagtcggcaggtgggtaatggggacagtacttcgacttcncacatcatcagcctggacgtcctgaacgatgttgctagtttattacgtgtacaactagtacgtacgaggtcggcccggttccgggggcctaccggtttccgggacccgtcgggaaccgtacggttacgggacgtacgtaaccgaaacggtaccgtggtaccggactcgccactacgtcctcgttccttactaccg

SEQ ID NO: 76988 - DNA, 620 bp, Homo sapiens
  misc_feature: GYAE6OF02F9Y3P.8.34.D01.1.454.CMB.1.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
  modified_base (399)..(399): a, c, t, g, unknown or other
  misc_feature (399)..(399): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagataccaccggagagattgtgttgacacagtctccagccacctgtctttgtctccaggggaancgccaccctctcctgcagggccagtcagagtgttaccaccagttagcctggtaccaacacaaacctggaccaggctcccaggcccctnatctttgatgcatccatcagggccacgtcggacactccccaagtcccaggttcaggtggctaggtcgggtctgggacagtacttcactctacaccatcagcagcctaganctagaagtatttgacttagtttactacgttgtacaactacgttacgtaccgtagtccgggtacccgttcccgggggtacccttaccggttttccggccccggttacggggtaaacccttaaaacgttgaacgtaactacgaaaccggtaacgttggtcggaccgttcggacctacccgtagttccgttgttaccttactactttcccgttaccccgtaccg

SEQ ID NO: 76989 - DNA, 745 bp, Homo sapiens
  misc_feature: GYAE6OF02G81K3.8.34.D01.1.454.CMB.1.raw
  modified_base (211)..(211): a, c, t, g, unknown or other
  misc_feature (211)..(211): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagngccaccctctcctgcaggccagtcagaatgtgcgcctacgtatcctggtaccaacacgaaacctggccaggcctcccacggccccctcactctatggtgcatcccaacgacgggccacgtggcactacccacgcccgaggttcaggtcggcctagggtggggtagtacggggacaacggtacttccgaaccgttcctaccgtaacctactcctaacgttccgaacggtccccgtaggggaccgtacccgttaggaaaaggtacgttgggtttacggtaaccgttttaaggtttttaaacttttaccgttacgtttacctaaaaccgttacgtttacccggtaacccggttaggttcccgggtccccgggttccccggggggtaccctttaacccgggttttccccgggaccccggttacgggaaacccggttaaggggtaccggtaaggtaaccgtaaccggaaaccggttaaccgtgggtaccggtaccgtcggaccgtacctacgttccgttacgttaccttaccgtacccg

SEQ ID NO: 76990 - DNA, 617 bp, Homo sapiens
  misc_feature: GYAE6OF02G7LOG.8.34.D01.1.454.CMB.1.raw
  modified_base (321)..(321): a, c, t, g, unknown or other
  misc_feature (321)..(321): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctcgtggttccaccttcaagtaacctacggcatgcacgtgggtcccgacaagcctccaggcaagggnttgggaggtgggtcggactaggtttcgtttacagttcgtggaggggtctaggttcgttacaagttgggtatggacaagtccgtcggtaggaacgggccgtattacgacctatctaccgagacgacgtaacttaccgaagaacaactaagttacgttaattggacgtactagaacgacgtacctaagttcgagacgacgacggtactattacgacgtaggtaacggaacgggtacggggaaccgtaggacggtagttaccgtaacgttccgtaccgttacggtaccggtagtccggg

SEQ ID NO: 76991 - DNA, 565 bp, Homo sapiens
  misc_feature: GYAE6OF02HGZB1.8.34.D01.1.454.CMB.1.raw
  modified_base (209)..(209): a, c, t, g, unknown or other
  misc_feature (209)..(209): n is a, c, g, or t
  modified_base (297)..(297): a, c, t, g, unknown or other
  misc_feature (297)..(297): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctctcctgcagggccagtcagaatgttggcgcctacgtatcctggtaccaacagaaacctggccaggctcccaggccccctnatctatggtcgcatccaacgacgggccacgtggccactccccagcccgtaggttccaggtcggcaggttgggtatggggacaggacttcactctcaccatcatcacgcctggacgcctggagatgttgcgtagtttattactgtacaactagtcgtacgaggtcggcccgtccgggggcctacgtttccgggcccgttacgggaacctaaggtcggatacgtacgaaacgtacgtggtcgacgtgacctacgatcgtcgttcctctac

SEQ ID NO: 76992 - DNA, 788 bp, Homo sapiens
  misc_feature: GYAE6OF02F3C8L.8.34.D01.1.454.CMB.1.raw
  modified_base (216)..(216): a, c, t, g, unknown or other
  misc_feature (216)..(216): n is a, c, g, or t
  modified_base (349)..(349): a, c, t, g, unknown or other
  misc_feature (349)..(349): n is a, c, g, or t
tcagctcgcgtgtccacgaccggtgctcgatttagatcgtctgtgttggggttgggggaggaactgctcagttaggacccagagggaaccatggaacgccccagctcgagcttctcttcctccgtgctactcgtggctcccagtttcagactaccgaccggagagattgtggttgacacaatcctccgagccacctgtcttcgctccggagggaangccaccgtctccgtgcgaggccagtcagatgttcggcgtcctacgtatccgtaggtaccaacacgaaccgtcggccacggtcctacccgacggcccctagactactacgtcggtcgcgtacgtaccgaacggngggaccctacggtcggactaccgtaccccgacggtaccggtacggttacgtacggtacggtacgtacggggtttacgggtaagtacgggaacgtaacggttaccgttacgtaaccgtacccgttaacccgtaacctactaccgtaactaccgtaaaccggtccgttacgggaaccgttccggtaagggtacgttaacgttcggttactacggtttaagttttacgtacgtacgtactaacgtaccgttaccgggtaccgtagggtcccggtacccgggtacccggggtaccgtttaccgtttcccggggacccgttaagggtaaaccgtaagggttaccgtagttaaccggaacccggttaaacggtacgttacgggtaccggtactaccggaccttaaaccgtttcgtaaccggtttcgttaccctccgttaacccgg

SEQ ID NO: 76993 - DNA, 789 bp, Homo sapiens
  misc_feature: GYAE6OF02ITD8G.8.34.D01.1.454.CMB.1.raw
  modified_base (211)..(211): a, c, t, g, unknown or other
  misc_feature (211)..(211): n is a, c, g, or t
  modified_base (267)..(267): a, c, t, g, unknown or other
  misc_feature (267)..(267): n is a, c, g, or t
  modified_base (302)..(302): a, c, t, g, unknown or other
  misc_feature (302)..(302): n is a, c, g, or t
tcagctcgcgtgtccacgaccggtgctcgatttagatcgtctgtgttgggtttgggggaggaactgctcagttaggacccagagggaaccatggaagcccagctcagcttctcttcctcctgctactctggctcccagtttcagataccaccgggagacgattgtgttgaacactaatctccagccaccctgtcttcgctccaggggaaancgccacccttctctgcagggccagtcagatgtgcgtctagtatccgtggtaccaanacgaacctggccacgggcctaccgaggcccccttnacttcgtacgtggtacgacactacccgaacgcgggtaccacgtcgggccaacttccccgagccggtaggttaccagggtcgacggtaacgttcggggtagtccggataacggaacctttcgaaaccgttcgttaacccaccgtaaatttacccgtaagtaccgtaccggtaccgttacggaaccgttccggtacgggtaacgtacggtttacgttaccggtaccgtttaacggttttaactttaccggtacgtttaaccgtaaaccgttaacgtttacccgggtaaccgttaacgggttaccccgggttaccgggttaccccgggggggttaccccgtttaaccggtttacccggggttaccccggtaccggggttaaaccgtaaacggttacgggtaaccgttacgtaaccgtaaaccgggttaaccgtacggtacgtaccgtacggacccgttaacgcgttacgttcggtaccttacgttaaccg

SEQ ID NO: 76994 - DNA, 776 bp, Homo sapiens
  misc_feature: GYAE6OF02JXQFU.8.34.D01.1.454.CMB.1.raw
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (325)..(325): a, c, t, g, unknown or other
  misc_feature (325)..(325): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtccttcgtctccgaaggggaaacncgcccaccctntcctgcagggccagtcagatgtgcnctagtncctgaccanagaacctgccagcctccgacggcccctanatctatggncctatccaacgtcgggcctacgnggaccactccccgagcccgtaggttccaggtcggactagggttcgggtagtaccggggaactacggtacctttacggactttccgaaccgaaccctagttccaagttaccgaacggtcccgtacgggacctcccggttagggaacggttacgttcggttacgacgtttaacgttttaagtttaccgtacgtaaccgtaaaccgttacggttacccggttaaaccggtcggggttacccgggtacccccggggtttacccgggggtaccccttttaaccggggttttacccccgggtcccggtaaacgggtaaacccgttaaggggtttccggtaacgttaacggtaaacccggtaaaacgggttaacccgtttgggttaccgggtacccggttacgtacccgtaaccggtaccgtttaccggtttccggttaccctttaccggttaacccg

SEQ ID NO: 76995 - DNA, 750 bp, Homo sapiens
  misc_feature: GYAE6OF02IAYPU.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagaatgttggcgcctagtactccgtcggtaccaacgagaaacctggaccacggcctacccgacggccccctcgtaattccgtagtcggtcgacctactacccaacgacgggcccaacgtccgggacaacgtccccgaacggtccgtaagggtttccgagggttcggaccgttaagggtcgggggttaagtacggggaacctaaggtacctttccaacgttcctacccaaccgtattctaactaccgacgtccggtagggtaccgtacccgtagggacggtagttcgggttcgtacgttagtttttacttacgttactacgtaacctaagtccggttaaccggtacgggttcccgggtcccggtccccgggggtaccctcccggtttttacccgggcccggttaacgggaaacccgtaacgggttccggattaaccggtaaccgaaaacggttacgttagggaccgtacggtctaaccgaccttagttaccggttcgtttacccgtattacccg

SEQ ID NO: 76996 - DNA, 744 bp, Homo sapiens
  misc_feature: GYAE6OF02JNC0C.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctctgggttcaccttcagtaactacggcatgcacgtgggtccgccaagcctccgaggcaagggtattgggaggtgggtggctaggttcgtttcatcgtggagggctaggttgttacaagttcggtatgactaggtacctcggtaggaaacgggtcccgtaattccgaccctacttcccgtaccgtaagaacgaaccgtaaatttacccgaacgggaaacctaaccgtaaaacgttcggttaaacgttttcggggtaacggtaccgttaacgaaaccgtaccggttaacccggtaaacggttccccgtaagggaaccgggtaaccggaaccggggtaccgttaacgttaacccttacggttaaacggtaacggggtaaaccggggggaacggggggtaaacccggaacgggtaccgggggttaaccggttaacccgtaacggttaaccccgttaccggttttacggtacccggttaccgggtaccggggg

SEQ ID NO: 76997 - DNA, 674 bp, Homo sapiens
  misc_feature: GYAE6OF02I7KDZ.8.34.D01.1.454.CMB.1.raw
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
  modified_base (394)..(394): a, c, t, g, unknown or other
  misc_feature (394)..(394): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagcgccaccctctcctgcacggccagtcagatggtggcncctacgtatccgtgtaccaacacgaaacctggccaggcctcccgacggccccctnactctagtggtcgcactccaacgcgggccacgtcggcctaccgtcccaggacccgtagggttccaggtcggcaagggtgggtaatgggaacnggtacgttctacgtcctaccaaccgctcgactcacggtcctaggacgtcctagacggtagttcggttcgcttacgtttaagtttcctaggttaacctaacgtactaccggttacccggaggttccgggcccgggttcccgggggcccttaccgggtttcccggaacccgggttacgggtaacccaaaggggttcgtacgttaacgtaaccgaaaacggttaacggtgggttaccggagttcggaccctacgtagttcccgtacgtttacctcctaacccg

SEQ ID NO: 76998 - DNA, 576 bp, Homo sapiens
  misc_feature: GYAE6OF02HBHT1.8.34.D01.1.454.CMB.1.raw
  modified_base (210)..(210): a, c, t, g, unknown or other
  misc_feature (210)..(210): n is a, c, g, or t
  modified_base (408)..(408): a, c, t, g, unknown or other
  misc_feature (408)..(408): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtctttgtctccgaggggaaanagccaccctctcctgcagggccagtcagaatgttggcgccttgaagctggtaccaacacaaacctggccaggctcccaggccccctcatctatggtgcatccaacagggcccactcggcactcccagccaggttcagtggcagtgggtatgggacagacttcactctcaccatcatcacgcctggacgcctagaagtntgttgcttagtttattactgtcaactntcgtacgngtggcccgtccggggcctacgtttccggcccgtacgggacccgtaagggtcggacgtacgtaccgaaaccggtaaccgttaggtcggtaccgttacggaccgtaccgtattccgttcggttccttactacccg

SEQ ID NO: 76999 - DNA, 782 bp, Homo sapiens
  misc_feature: GYAE6OF02HMKXD.8.34.D01.1.454.CMB.1.raw
  modified_base (296)..(296): a, c, t, g, unknown or other
  misc_feature (296)..(296): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccagggaaacgagccaccctctcctgcagggccagtcagaatgtggcgtcctacgtatcctggtaccacagaaacctggccaggcctccgaggccctnactctatggtgcatccaacgcgggccacgtggaccatacccgagccgtaggttccaggttcgacgtaggttacgggtacgtcgggggaactacggtaacgtttaccgaaccgttccgttacccaaaccccgtagtttcccggaaatttaccccggtaaacgtcccggtttaacgggaccgtccccgtttaagggaacgggtaacggtttagggttaccggtaccgtttaaacggtttttaacttttaaccgggttacgttaaaccgtaaacgttaaccgtttacccgggtaacccggttacggttaccgggtaccccggttcccggggggtacccttaacggttttcccggacccggtacggtaacccgtaaggttcgtaacgttacgtaacccgtaaacggtaccgttacgggttaaccggacgtaaccggtaccctaaccggttaaccgttacccggttacgtttaccccgtacgttaacccgg

SEQ ID NO: 77000 - DNA, 596 bp, Homo sapiens
  misc_feature: GYAE6OF02FH5ZR.8.34.D01.1.454.CMB.1.raw
  modified_base (209)..(209): a, c, t, g, unknown or other
  misc_feature (209)..(209): n is a, c, g, or t
  modified_base (300)..(300): a, c, t, g, unknown or other
  misc_feature (300)..(300): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccacctctcctgcagggccagtcagaatgttggcgcctacgtatccgtggtaccaacagaaacctggccaggcctccccgaggccccctnactctatggtgcactccaacacggggccactcgggcactccccgagcccaaggttcaggtggcaggtgggtatgggacaggacttcacgtctcgacctatcatcacgccgtggacgctagaagatgttagcttagtttattacttgtacaactagtcgtacgtacgtacggtcccgtccggggtcctaccgttccgggcccgtacgggaccgtaaggggtcggtagacgtacgaaacggtaacttcgggtacggtaccgtacggacaccgtacgttcgttcgttccgttactaccg

SEQ ID NO: 77001 - DNA, 796 bp, Homo sapiens
  misc_feature: GYAE6OF02JR182.8.34.D01.1.454.CMB.1.raw
  modified_base (271)..(271): a, c, t, g, unknown or other
  misc_feature (271)..(271): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaactgggttttcctcgttgctcttttaagaggtgtccagtgtcaagtgcaactggtggagtcgtgggggagcgtagtccagccgtgggagtcacagagctctctgtgcagcctgtcggtcaccttcagtanctacggcatcgctacgtcggtacccgcctaaacctccgaggacgaaggggtcttgggacggtggggtcggtacgttaggtttcgttcgacgttcgtaggtacgggtacgtaggttagttaacgtaacgttgggttacgtacggtcgtacggtaccgggtaccgggtacgggaaccggggtcctaacgtttaccccgaacctacgttacccgtacccggaaacggtaaccgtaaacccgttaaacccggtacccggaaacggtaacccgtaaacgtaacgtttaaccgttacgttttaaccgggacccttaaaggaacccgtaacggttaacccgttacggtacccggttaaggtaaccgggtaccggtaacgggttacgttaaccgttaaccgtaacggtacgggtaaacgggaaacggggggtaaccggggtaaacggacggggtaaccgggttaaccggttaaccgtaacggttacccggttacggtttaccgggtaccggttaccggtaccgggggtaccgg

SEQ ID NO: 77002 - DNA, 634 bp, Homo sapiens
  misc_feature: GYAE6OF02IC58P.8.34.D01.1.454.CMB.1.raw
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
  modified_base (329)..(329): a, c, t, g, unknown or other
  misc_feature (329)..(329): n is a, c, g, or t
  modified_base (391)..(391): a, c, t, g, unknown or other
  misc_feature (391)..(391): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcggtggtccagccgtgggaggtcacagagactcgtcgtgtgcagcctcgtgggttccaccttnagtaactacggcatcgcacgtcgggtccnccaagcctaccgaggcgaagggtnttgggaggtggggtgcgtagtttgttcatcgtggacgggctaggttgttacaagttggtaancggactaggtaccgtccggtagggaacgggccgtattccaccactctacgagtacgaactaactaccgaaggaacaactaatgttacttaggacactagtaacacgtacctaacgtccgtaggacgacgacggtcgtaataccgtagtacggtaacgggaacggggtaacggggaacgtacgggaccgggtacgttaccgtaacggttaccgttaccgtttacggaccggttcggtaccgggg

SEQ ID NO: 77003 - DNA, 575 bp, Homo sapiens
  misc_feature: GYAE6OF02IDALL.8.34.D01.1.454.CMB.1.raw
  modified_base (209)..(209): a, c, t, g, unknown or other
  misc_feature (209)..(209): n is a, c, g, or t
  modified_base (447)..(447): a, c, t, g, unknown or other
  misc_feature (447)..(447): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggcctccccaggccccctcactctatggtgcatccaacgagggccactggcatcccagccaggttcagtggcagtgggtatgggacagacttcactctcaccatcatcagtcctggacgcctgaggatgttgctagtttattactgtactaactactacgtaacgnggtacggcccgtccgggggccctacggtttcccggcccgtacgggaaccgtaacgtggtactacgtacgaaacgtacgtacggtacggtcgtacgacctaccgtacttaccgtcgttaccttctaccg

SEQ ID NO: 77004 - DNA, 586 bp, Homo sapiens
  misc_feature: GYAE6OF02I2MRK.8.34.D01.1.454.CMB.1.raw
  modified_base (254)..(254): a, c, t, g, unknown or other
  misc_feature (254)..(254): n is a, c, g, or t
  modified_base (353)..(353): a, c, t, g, unknown or other
  misc_feature (353)..(353): n is a, c, g, or t
  modified_base (445)..(445): a, c, t, g, unknown or other
  misc_feature (445)..(445): n is a, c, g, or t
tcagctcgcgtgtccacgaccggtgctcgatttagatcgtctgtgttgggtttggggggaagaggaagactgacggtcctgccacaggtggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacgagagactcncgtgtgcagcctcgtgggttcaccttcagtaactacggcatgcacgtgggtcccgccaagcctccgaggcaagggattggagtgggtgctagttgtttnagtctggaggcgagtgttacagttggtatgcaggacctcggtagacgggccgtagtacacctatctaccgagacgactacttacgagaacanaatgtattggactcgtacgaacgactaccgtaacgtccgtagacggtaaccgacggtacgtacgtactacgtagtacggaagggacggggaacgacggacggtacgtacgtacgtaccgtcgttaggtacgtcggtacggg

SEQ ID NO: 77005 - DNA, 580 bp, Homo sapiens
  misc_feature: GYAE6OF02F5ZPM.8.34.D01.1.454.CMB.1.raw
  modified_base (209)..(209): a, c, t, g, unknown or other
  misc_feature (209)..(209): n is a, c, g, or t
  modified_base (288)..(288): a, c, t, g, unknown or other
  misc_feature (288)..(288): n is a, c, g, or t
  modified_base (309)..(309): a, c, t, g, unknown or other
  misc_feature (309)..(309): n is a, c, g, or t
  modified_base (378)..(378): a, c, t, g, unknown or other
  misc_feature (378)..(378): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangcccaccctctcctgcagggccagtcagatgtgcgccttgagctgtaccaacacaactggccaggctcccaggcccctnatctatggtgcactccaacgngggccacgtggcactcccagccgtaggttcagtggacaggtgggtatgggacagtactcactcgtcacntacatcgacgcgtggacgtcctagagtagttgtgacttagtttatacgttgtacaactacgtacgtacgtagtccggtcccggtaccggggtccttaccggtttccggacccgtcgggtaaccgtaagggtcggagtacgtacgtaaacggtacgtcggtacggcgtacgaccgacttacgtcgtcgttccttacgtacccg

SEQ ID NO: 77006 - DNA, 694 bp, Homo sapiens
  misc_feature: GYAE6OF02JOTT9.8.34.D01.1.454.CMB.1.raw
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagatacccaccggagagattgtgttgacacatctccagccacctgtcttcgtctccgagggaagacgccacctctcctgcagggccagtcagacgtgttcggcgacctacgtactccgtcgtaaccaacaacgaacctggaccagccgtccacggcccctntactctaatcggtgcctacnccaacgacgggaccacgnggaccactcccagaccgtaggttccgaaggtcggccgtagggttgggtacgttacggggactacggtaccgttacaccgttcctaccgacctaacgttaccacgtacgaacgtcccgaacgggtacgcccgttaggaggtacttcggttagtaccgttagtttacttacgttgacctaacgtacgtccgtaacgtccggtcggtaccccgggttccgggtacccgtaaccggttttcccggacccggttacgggaaccgtaagggtcggtaacgttacgtaaccggaaacgtaccgttacgggtcgtccgtacggaccgttacgtaaccgttcgtcgttaccgtacgtaccg

SEQ ID NO: 77007 - DNA, 680 bp, Homo sapiens
  misc_feature: GYAE6OF02H47HX.8.34.D01.1.454.CMB.1.raw
  modified_base (332)..(332): a, c, t, g, unknown or other
  misc_feature (332)..(332): n is a, c, g, or t
  modified_base (392)..(392): a, c, t, g, unknown or other
  misc_feature (392)..(392): n is a, c, g, or t
  modified_base (427)..(427): a, c, t, g, unknown or other
  misc_feature (427)..(427): n is a, c, g, or t
tcagctcgcgtgtccacgaccggtgctcgatttagatcgtctgtgttgggtttgggggaagaggaagactgacggtcctgccacaggtggtgtttccattcggtgatcagcactgaacacagaggactcaccatggagtttgggctgaacttgggttttcctcgttgcttacttttaagaggtgtccagtgtcaagtgcaactggtggagtcgtgggggagcgtggtccagcctgggagtcacagagactctgtgtgcagcctgtggttcaccttcagttaactacggcatgctacgtcgggtccaccaagcctaccgaggccgaaggggtnttgggagtgggtgctagtttcgttcagtcgtggacgggtctaggttcgtacaagtggtangactagtacctcggagaacgggtctagttccactntcctacgagacgactaactaccgaagtaacaacgtaattacgttagtttacgagtaactacgaaacctacgtaccgttaaacgtccgtaggtaacggaaccggaaccgggttacgttaacgttaaccgttaccggttaacggtaacggggaaaggggaaccgggggtaaccggaacgggtaccgggttaacgttacccggtaaacggttacccgtttaccggtttacggtaccggttacgggttacccggggg

SEQ ID NO: 77008 - DNA, 764 bp, Homo sapiens
  misc_feature: GYAE6OF02GTLTH.8.34.D01.1.454.CMB.1.raw
  modified_base (208)..(208): a, c, t, g, unknown or other
  misc_feature (208)..(208): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaanagcgacccacctcctcgtgacggacggactacgtacgaagtagtggttcggccgtaccgtacgtacgtcgtacgaaccaacgaacgaacgtcggacgaccgtcctaccgaccgtaccctatactactagtggacactacgtaccaacggacgaccgtacgacgaccaccgtaccgaccgtacgtacgtacgtacggtcggacgtaggggttaggtacgggacgtaacgtaacggtaccttaaccgtacctcctaacccgtaacctacgtaactacctaccggtaacgtccgggttagacccgttacggagggttaacgtggtttacgtaggttacctttaagttttacgaccgttagaaaccctagtacccgttacggtaacggttcgggccccgggttacccgggtaccgggtaccctttttaccgggcccggtaacccgggtaaagggaaaccgtttaggtacggtaacttaaccgggtaaaccttaaacgggtcgttacggaccggttagtaacccgtaacttaccgtacttcggttaccttaccttaacccg

SEQ ID NO: 77009 - DNA, 721 bp, Homo sapiens
  misc_feature: GYAE6OF02HGGY6.8.34.D01.1.454.CMB.1.raw
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacgagagacctcgtcgtgtgcagcctcgtggttcaccttcagtaactacggctagtgcacgtgggtcccacaagcctaccgagcgaagggtnttgggagtgggngctaggttgttacagtcgtagngggcaggtgttacagttggtatcgactacgacgttacggtagacgggtccgtacgttaccacgtactcctacgaagtacgaacctaacgtaccgaacggtaaacctaaccgtaaagtttacggttaagttacgggtaacgtaccgttacgaaaccgtaccgtaacctttaacggtacccgtaaggtaccgggaaccgtaacccgggtacgttaaccgttacgttaccggttacggtaaaccggggaaacgggggtaaccggggggtaaccgtaaacggggtaccggggttaacggtttacccggtaaacggtttacccgttacccggtttacggttacccggttaacgggttacccggggg

SEQ ID NO: 77010 - DNA, 572 bp, Homo sapiens
  misc_feature: GYAE6OF02GUKT1.8.34.D01.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (382)..(382): a, c, t, g, unknown or other
  misc_feature (382)..(382): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcncctacgtatcctggtaccaacagaaacctggccaggcctcccaggccccctcatctatggtgcatccaacgagggccacgtggcactcccgagccaggttcaggtggcaggtgggtatgggacagacttcactcncacatcatcacgcctaggacgccgtagaggtatgttgactagtttacttacgtgtacaactactaccgtacgaggtcggtaccggtcccggggtacctaccgtttccggcccgtacgggaaccgtaacggtgactacgtacgaaacggtacgtcggtacggctagaccacctatactcgttctactaccg

SEQ ID NO: 77011 - DNA, 703 bp, Homo sapiens
  misc_feature: GYAE6OF02JI6JU.8.34.D01.1.454.CMB.1.raw
  modified_base (211)..(211): a, c, t, g, unknown or other
  misc_feature (211)..(211): n is a, c, g, or t
  modified_base (379)..(379): a, c, t, g, unknown or other
  misc_feature (379)..(379): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagactaccaccggagagtattgtgttagacacaatctccagcccacctgtcttcgtctccgaggggaanacgcccaccctctcctgcgacggcccagtcaggaactggttgccgtacctacgactccgtacggtaccaactacgaaacctggaccaggacctcccgacggtcccctcgaatcctaacgtcggtcactactaccgaacgcggtcctaacgtcggcaccgtcccgtacnccgtacggtttacaggtcggcgtaggtacgggtacttacggggaccttacggtaaccctttcgacctttccgacccacgtacttaccagtaccacgtcccgtacggacgtccgtagtacggtagttcggtacgaccttaagttttacgttacttacgaacctaacgtactaccgtacggtacggtcccggtacccgggtcccggggttaccttaccgggtttcccgtacccgggtacggtaaaccgtaaggtcgtaccgtataccggaaacgtgtacggtggtaccgttcgaccctagtaccgttacgttcgttcctatacccg

SEQ ID NO: 77012 - DNA, 758 bp, Homo sapiens
  misc_feature: GYAE6OF02HYFB4.8.34.D01.1.454.CMB.1.raw
  modified_base (211)..(211): a, c, t, g, unknown or other
  misc_feature (211)..(211): n is a, c, g, or t
  modified_base (303)..(303): a, c, t, g, unknown or other
  misc_feature (303)..(303): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagngccaccctctcctgcagggccagtcagtaatggttggcgccttcgtaagctaggtaccaacacaaacctggaccaggcctcccaggcccctnactctagtggtgcactaccaacgacggccacgtcggccaactcccgacgaccgtacgggtttacaggttacgggccgtaaggtttgggggtaagttacggggggaactaacggtaacctttacgaacccgtttccctaacccaaccctaacgttcctaacgtttaccgaaccggtcccgttagggggaaacctcccggttaaggaaacgttacgttaggtttcgtaacttaagtttttaacgttacgttacgtaactaaacgtacgtaccgttaacggcggttaccgggccccgggttccgggggacccttaaccgggtttcccgggacccggttacggggaaacccgtaagggggtaccgtaaggtaccgtaaccggaaaacggttaccgttgggaccgggtacgtaccggacctaaccgtacttccggttacgtttacccttaccgtaacccg

SEQ ID NO: 77013 - DNA, 605 bp, Homo sapiens
  misc_feature: GYAE6OF02JZQTL.8.34.D01.1.454.CMB.1.raw
  modified_base (246)..(246): a, c, t, g, unknown or other
  misc_feature (246)..(246): n is a, c, g, or t
  modified_base (274)..(274): a, c, t, g, unknown or other
  misc_feature (274)..(274): n is a, c, g, or t
  modified_base (384)..(384): a, c, t, g, unknown or other
  misc_feature (384)..(384): n is a, c, g, or t
  modified_base (429)..(429): a, c, t, g, unknown or other
  misc_feature (429)..(429): n is a, c, g, or t
  modified_base (447)..(447): a, c, t, g, unknown or other
  misc_feature (447)..(447): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (482)..(482): a, c, t, g, unknown or other
  misc_feature (482)..(482): n is a, c, g, or t
  modified_base (492)..(492): a, c, t, g, unknown or other
  misc_feature (492)..(492): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtgagtctgggggagcggtggtccaggcctgggggaggtcacgagagactntcggtgtgcagcctcgtggtctaccttnagtaactacggcagtgactacgtcgggtcccacgaacggtctacccgaggtccgaaaggggtatttgggaacggttggggcggtacgtaggtttcggtttcagtttccgnggtaagggcaaggttgtttcaagttggtatgtcgataacgtccgngtaagggccgtatccacntcnccanacgacactacagtaacacatgtattagntgagaactanccgtaagcctagtaagacgtacggacgatacgtactacgtaggaaccggtaaggaacggggtaaccgaaggacgggtacgtaccgtaaagtacccgtagttcggacgttccgg

SEQ ID NO: 77014 - DNA, 799 bp, Homo sapiens
  misc_feature: GYAE6OF02HAA9C.8.34.D01.1.454.CMB.1.raw
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaangccacctctcctgcagggccagtcagatgttggcncctacgtatcctaggtaccaacagaaacctggcccaggcctccccgaggccccctcacttctatcgggtcgcactccgaaacgcggggccacgtggcctaactccccaggcctagggttcaggttcggctagggttgggtagtacgggggacacggtaccttacacgttcctaccgaacctaacttccgaacttaccgtacgtaccccggttggggaccgtacccggtagggtaacgggtaacgtttcggtttacggtaccgtttaaggtttttaaactttacgttaccgttaaccgtaaacttacgtttacccgggttaaccggtaacgggttcccgggtcccgggtttaccccgggggggttcccgtttaacccgggtttccccggggttacccggttaccggggaaacccgttaaacggggttcgggtaaccggtttaacgttaaacccggaaaaccgggtaaaccgtttaccgggttacggtaaccggtttaccgaccgttaacccggtaacgttcctttaccggtttacccgtttacccgttaacccg

SEQ ID NO: 77015 - DNA, 741 bp, Homo sapiens
  misc_feature: GYAE6OF02H5BIF.8.34.D01.1.454.CMB.1.raw
  modified_base (156)..(156): a, c, t, g, unknown or other
  misc_feature (156)..(156): n is a, c, g, or t
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggtttttccncgttgcttcttttaagaggtgtccagtgtaccaagtgcaactggtggagtcgtgggggagcgtggtccagcctgggagtcacagagactctcgtgtgcagcctntggttcaccttnagtaactcggcatcgcacgtcgggtccgacgtaagcctaccgaggccaaggggtattgggagttggtacggctaggttgtttcatcgtggacgggctaggtgttacaagttggatcggacaaggtcctacccggtaggaacgggtccgtagtaccaccgtacgtcctaccgaggacgtaacgtaacgttcccgaaggaaacctaacgtaaagttacggttaacgtttagggacgtacgttaggtaaacctaacggtaccgttaaacgtcccggttaacggaaccgggtaaaccggtaccgggtaaccgttaacgttaacccggtaccggttacggtaaaccggggtaaaggggtaacccggggggtaaaccgtaacggggtaaccggggttaaccgtttacccggttaaaacggtttcccggtttaacccggtttaacgggttacccgggttacggttaccccgggggg

SEQ ID NO: 77016 - DNA, 680 bp, Homo sapiens
  misc_feature: GYAE6OF02FK6QU.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctggggttcaccttcagtaactacggcatgcacgtggtccgccaaggcctccaggccaagggattgggagtggggtggcagtttgtttcattctggagggcaggttgttcaagtcgggtatgactacggacgtccggtaggaacgggccgtactttcgaccatcctaccgagaacgaacctaacgttacccaacggaaaccacgtaaagttagttacgtttaggagtaccgtacgaaccgtaagtacccgtaaagttacccgtaggaacgggaaccggacgggtaaccgttaacgtaaccgttacgttacggtaacgggtaaacgggggtaaccggggggaaacccgtaaggggtacccggggtaacgttacccggtaacggttacccgttaccggttttaccggtacggttccggtaccggggg

SEQ ID NO: 77017 - DNA, 793 bp, Homo sapiens
  misc_feature: GYAE6OF02I13V8.8.34.D01.1.454.CMB.1.raw
  modified_base (113)..(113): a, c, t, g, unknown or other
  misc_feature (113)..(113): n is a, c, g, or t
  modified_base (154)..(154): a, c, t, g, unknown or other
  misc_feature (154)..(154): n is a, c, g, or t
  modified_base (169)..(169): a, c, t, g, unknown or other
  misc_feature (169)..(169): n is a, c, g, or t
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
tcagctcgcgtgtccacgaccggtgctcgatttagatcgtctgtgttgggtctgggagaggagcccagcactagaagtcggcggtgtttccattcggtgatcagcactgaacncagaggactcaccatggagtttgggctgaactggttttccncgttgctctttaagngtgtccagtgtcaagtgcaactggtggagtcgtgggggagcgtggtccagcctggggagtcacagagactcgtcgtgtgcagcctntggtcaccgttnagttaacgcggcagtcgctacgtcgggtcccacgaagtccgtccgaggccgtaaagggcttgggagttggggtcgtacgtaggtttcgtttaccgaagttccgtaggtaacggggtctaacggttggttaccaaaggtttcggttaacgtcgggtaccaaggtaaacccggttcccggtaagggaaaccggggtcccgtaacgtttacccgtaacccgtacgttacccgtaccggtaacggtaaccgtaaacccgtaaacgtttaaccccgaagggttaaacccgaacgttaaacggttacggttaaaccgtttacggggtaaaccgtaccggttaacggtaaaccgtaacggttaaccccgttaaaccggtaccgttaggaaccggtaaccgtacgggtaccgttaacgttaccgtacgttacggtaaccggaaacgggtaccggggtaaccgtaacggtaccgggtacgttaacccggaacggttacccgtaccggtttacggttaccggtaccggtaccgggg

SEQ ID NO: 77018 - DNA, 687 bp, Homo sapiens
  misc_feature: GYAE6OF02I7TE0.8.34.D01.1.454.CMB.1.raw
  modified_base (210)..(210): a, c, t, g, unknown or other
  misc_feature (210)..(210): n is a, c, g, or t
  modified_base (297)..(297): a, c, t, g, unknown or other
  misc_feature (297)..(297): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaangccaccctctcctgcagggccagtcagaatgttggcgtcctacgtatcctggtaccaacagaacctggccaggctcccaggcccctnacttcttgatgcatccatcgagggccacgtggcactcccagcctaggttcaggtgcaggtgggtctgggacacgtacttcgactctacacctatccagcacgcctaggacgccctagtaacgttatttcgtaccgttaagttttacgtttaaccttcgttaaccgtaaacctacgttacccgttaaccggtaacgggtcccgggtacccgggttccccggggggtaccccgttacccgggttttacccgggtaccccggttacggggtaaacccgtaaaggttaccggtaacggtaactaaccggtaaacccggtaacgttacgggttacggtaccgttacggtacccgtacccgtacgttccgtttacggttacctttaccgttacccg

SEQ ID NO: 77019 - DNA, 656 bp, Homo sapiens
  misc_feature: GYAE6OF02FIWFZ.8.34.D01.1.454.CMB.1.raw
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcncctacgtatccgtggtaccaacacgaaacctggccaggcctcccgaggccccctnactctatggtgcactccaacgacgggccacgtggacactcccagccgtaggttcaggtcggacaggtgggtatgggaacagtacttcactctacaccatcatcacgccgtgggacgccgtaggaggtagttggttgcgttaagtttacttacgttacgtacctaactacgttaccggtaaccgtaggtcggggtcccggttacccgggggtacccttaccggtttacccgggtccccgtacggggtaacccgtaacgggttacggtaactaacgtaaccggaaaacggtacgtacggggttacgaccgttacgacctaacccgttagttcccgttacggttaccttactacccg

SEQ ID NO: 77020 - DNA, 625 bp, Homo sapiens
  misc_feature: GYAE6OF02HX3VZ.8.34.D01.1.454.CMB.1.raw
  modified_base (208)..(208): a, c, t, g, unknown or other
  misc_feature (208)..(208): n is a, c, g, or t
  modified_base (341)..(341): a, c, t, g, unknown or other
  misc_feature (341)..(341): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaanagccaccctctcctgcagggccagtcagaatgttggcgcctacgtatcctggtaccaacagaaacctggccaggctccccaggccccctcatctatcggtgcatccaacgacgggccacgtcggccatccccngccaggttcgaggtggccgaggtgggtagtgggaacaggtacttcactctccaccatcatcacgtcctggtacgccgtggacgtatggttgacttagtttaacttagttcgtactaaacgatccggtacgtagtaccgggacccggtccgggggtaccctacggtttccgtacccggtacgggaaccgtaaaggtcggtacgttaacgtaaccgtaaaacggtacgttacggtcggaccgttagaccctaccgtacgttaccgttcgttaccgttactaacccg

SEQ ID NO: 77021 - DNA, 679 bp, Homo sapiens
  misc_feature: GYAE6OF02FMAD5.8.34.D01.1.454.CMB.1.raw
  modified_base (298)..(298): a, c, t, g, unknown or other
  misc_feature (298)..(298): n is a, c, g, or t
  modified_base (352)..(352): a, c, t, g, unknown or other
  misc_feature (352)..(352): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctcagccaccctgtcttcgtctccgaggggaaagagccaccctctcctgcagggccagtcagaatgttggcgcctacgtatcctggtaccaacagaaactggccaggcctcccaggccccctnatctatggtgcatccaacagggccacgtggcactcccagccaggttcagtcggnacggtgggtatggggacaggaccttcacgtctcaccgtatcactcgaagccgtggagccgttagggaggtaagttggttacggaccttaggttttaacttaaccgttcgtacctaactacgtttaccggtacccggtaaggtccggggtaccccgtacccggggggtacccttaacccgtttttcccgggccccgttaggggtaaaccccgtaaagggttcggtaacgttacgtaaccggtaaaaccggtaaccgttacggttaccggtcggtaccggacctaacccggtaccgtttaccgttacggtttcccgttacgttaacccg

SEQ ID NO: 77022 - DNA, 644 bp, Homo sapiens
  misc_feature: GYAE6OF02F7VI8.8.34.D01.1.454.CMB.1.raw
  modified_base (211)..(211): a, c, t, g, unknown or other
  misc_feature (211)..(211): n is a, c, g, or t
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagngcccaccctctcctgcgagggccagtcagatggttgccgcctacgtactccgtaggtaccaacacgaaaccgtcggaccaggcctcccacggccccctanactctatggngcactccgaacgcgggaccacgtggacactcccgagcctaggttcaggtcggacgaggtgggtagtcgggacaggtactacactcctacgactactcatcacgctaggcgcctaggagtagtggttacgcgttaagtttactacttcgtaccaacgtacgtaccggtaccgtacggtaccgggtcccggtacccgggggtcccttaccggtttcccgggacccggttacgggaacctaagggtacggacttacgaaccgtaaacgtacggtacgggtcggacgtaccgactaccgtattaccgtcttaccgttacttaccccg

SEQ ID NO: 77023 - DNA, 511 bp, Homo sapiens
  misc_feature: GYAE6OF02FTKMR.8.34.D01.1.454.CMB.1.raw
  modified_base (294)..(294): a, c, t, g, unknown or other
  misc_feature (294)..(294): n is a, c, g, or t
  modified_base (370)..(370): a, c, t, g, unknown or other
  misc_feature (370)..(370): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggtttttcctctgctcttttaagaggtgtccagtgtcaagtgcaactggtggagtctgggggaggcgtagtccagccctgggagtcacagagactctcctgtgcagcctctggttccacttcagtagctacggcatgcactgggtccnccaaaactccaggcaaaggggattgggagtggggtggcagtttgtttcattctgagggcagtgttacaagtggtangctggacgccggtgaagggccgattcaccatctccagagacaactcagacacaatgtattgactgaacagctaacgtcctagagacaggtgtatactatgagaggaaggggacagcggagtcagtctcttgcgtcgtggcg

SEQ ID NO: 77024 - DNA, 570 bp, Homo sapiens
  misc_feature: GYAE6OF02GEXD7.8.34.D01.1.454.CMB.1.raw
  modified_base (208)..(208): a, c, t, g, unknown or other
  misc_feature (208)..(208): n is a, c, g, or t
  modified_base (296)..(296): a, c, t, g, unknown or other
  misc_feature (296)..(296): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaanagccaccctctcctgcagggccagtcagaatgttggcgcctacgtatcctggtaccaacagaaacctggccaggctcccaggcccctnatctatggtgcatccaacagggccactggcatccccagccaggttcaggtgcaggtgggtctggggacagacttcactctcaccatcagcagcctagacgcctagaacgtatttcgctacttttattactgtacagcagtcgttacgtaacgttggtacctttcgtaccgtttccggcccttacgggaccctaaagtcggtaacttataaccgtaacgtaaccgttagtggtcctagaccacctagttccttacgttaccttctagtttccccg

SEQ ID NO: 77025 - DNA, 738 bp, Homo sapiens
  misc_feature: GYAE6OF02ILXKS.8.34.D01.1.454.CMB.1.raw
  modified_base (207)..(207): a, c, t, g, unknown or other
  misc_feature (207)..(207): n is a, c, g, or t
  modified_base (709)..(709): a, c, t, g, unknown or other
  misc_feature (709)..(709): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccagggaanagccaccctctcctgcagggccagtcagaagtgttggcgcctagtactcctaggtaccaacgaacaaccgtggccaggcctacccgacggccccctacactctagtggtacgcactaccaacgacggccacgtggccactcccgagtccgtaggttcaggtcggcgtaggttagggtagtgggacctaacggtacttccgtaactcccgtacaacccgattaccagttaccgacgtacccggtttacgggaacgtcccgtaggtagggtacgtttacggttcggtaacgttacgttttaacgttccgttacgttaaccctaaacgtaccgtaccgggttaacccgtagggtttacccgggccccgggttacccgggggtccctttaacccgggttttcccgggccccgggttaaagggtaaacccgtaaagggttccggtacgtttaaccgtaacggtaaaacgtaccggttcggttaacgggcctaccgtactaacccgtntttaccgtcggtttaccttaccgtacccg

SEQ ID NO: 77026 - DNA, 787 bp, Homo sapiens
  misc_feature: GYAE6OF02F7DC2.8.34.D01.1.454.CMB.1.raw
  modified_base (210)..(210): a, c, t, g, unknown or other
  misc_feature (210)..(210): n is a, c, g, or t
  modified_base (425)..(425): a, c, t, g, unknown or other
  misc_feature (425)..(425): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagccaccctctcctgcgagggccagtcagaatgttggcgtcctacgtatccgtggtaaccaacacgaaacctcggaccaaggcctcccgacggcccctagactctactgggtagccataccaaacgcgggccacgtcggcactcccgagccgtaggttccaggtcggacagggttgggtatacggggacagtacttcgacttctaccaaccgtancctactcgaaccgtccgtacggacgtccgtaggtaagggtacgttaggtcgtacgtttaaggttttaacgtttacgttacggttaaccgtaaaccgttacgtttacccggtaaccgggttaacggtacccggggttaccccgggtaccccgggggggttacccttaaacccgggttttccccgggggtacccccggtttaaacggggggaaacccgtttaaaacggggttacggggtaaaccttaaccgggttaaacccggtaaaaacccggttaacgggttacccgggttacgggtaaccgttacgggaaccccgtaacccgttaagtttcccgttacggttaccctttaccgttaacccg

SEQ ID NO: 77027 - DNA, 629 bp, Homo sapiens
  misc_feature: GYAE6OF02IYGA1.8.34.D01.1.454.CMB.1.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
tcagctcgcgtgtccacgaccggtgctcgatttagatcgtctgtgttggggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaagngccacctctcctgcagggccagtcagaatgttggcncctacgtatcctggtaaccaacacgaaacctggacccagcctccccaggcccctnactctatggngacntccaacgagggccacgtgcactccagccaggttcagtgacagttgggtatgggactagtaccttacgacctctaccacctatactatcacgccgtaggcgtcctaggacgagttaggttcgtacgttaacgttttaagtttacgttgttaaccaactaaccgttaccggtaaccgtaggttacggtccccgtacccggggggcctaaccgtttccgggaccctcgggtaaacccgaagggtacgtagtaactaacggaaaccgtaacgtggtacggtacgtcgaccacctagtcctacggtaccttcctaaccg

SEQ ID NO: 77028 - DNA, 647 bp, Homo sapiens
  misc_feature: GYAE6OF02IESYE.8.34.D01.1.454.CMB.1.raw
  modified_base (211)..(211): a, c, t, g, unknown or other
  misc_feature (211)..(211): n is a, c, g, or t
  modified_base (385)..(385): a, c, t, g, unknown or other
  misc_feature (385)..(385): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (437)..(437): a, c, t, g, unknown or other
  misc_feature (437)..(437): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtccttcgtctccgaggggaaangccaccctctcctgcagggccagtcagactgttggccgcctacgtatcctggtaccaacaagaaaccctggccaggcctccccgaggccccctcatcctagtcgggtcgactactccaacgacgggccaacgtggaccactcccaagccgtaggttcagtcggcaggtggtagnggacagtactcactcncacntcatcgagtccgtaggactccggtagacggtnttcggttcgtactaggttttattaccgtagtaactaacgtacgtacggtaccggtacggttaccgggtccccggttaccgggggtcccttacggtttccgggtacccgtacggggtaacctaaacgggttcgacttaagtaacccgaaacggtaccgttaggtcggaccgttgacccgtactacgttcctcggtttaccctcgttaaccg

SEQ ID NO: 77029 - DNA, 663 bp, Homo sapiens
  misc_feature: GYAE6OF02I067P.8.34.D01.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (303)..(303): a, c, t, g, unknown or other
  misc_feature (303)..(303): n is a, c, g, or t
tcagctcgcgtgtccacgaccggtgctcgatttagatcgtctgtgttgggtttggaggaggaactgctcagttaggacccagagggaaccatggaagccccagctcagcttctcttcctcctgctactctggctcccagtttcagataccaccggagagattgtgttgacacaatctccagcccaccctgtcttcgtactccaaggggaaancgcccaccctctcctgcagggccagtcagatgtgcncctagtatccnggtaccaagacgaaacctggccaaggcctcccgaggccccctanattcagtggtcaccatacccaagacggtcccacgtggacctacgtcccagtccgtaaggttccaaggtcgggactagggtcgggtaagtcgggaactcggacttcgacgtctaccgaccattccgactacgacgccgtagcgaccgtgaaggtcgtggtacgtcgtacgttttaagtacgttacgtacctaactagttaccggtaccgtacgtcgggtacccggttacccggggtaccttaccggtttcccgggacccgttaacgggtaacccgtaaggttacggaacgttaacgtaaccgaaacggtacgtacggtacggtacgtacggcctaaccgtactaccgttcgttccttaccg

SEQ ID NO: 77030 - DNA, 622 bp, Homo sapiens
  misc_feature: GYAE6OF02H2NN2.8.34.D01.1.454.CMB.1.raw
  modified_base (300)..(300): a, c, t, g, unknown or other
  misc_feature (300)..(300): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccaccggagagattgtgttgacacaatctccagccaccctgtcttcgtctccgaggggaaagagcccaccctctcctgcagggccagtcagaatgttggcgcctacgtatcctggtaccaacagaaacctggccaggcctcccacggcccctnatctatggtgcactccaacgacggccacgtggcactcccagcctacggttcaggtcggcaggtgggtagtggggacaggtcttcactctccactatcctatcacgcctgggactccgtaggagtagtgtcgtacttagtttattacgtgtacctaactactaccgtacgacgtcgggtcccggtcccgggggtaccctaccggtttcccgggacccggttagggaaacccgtaaaggtcggtagttacgtaaccgtaaacgtaaccgttggtacggtaccgtacgacccgtaacgtacttcgttacgttccgttctaacccg

SEQ ID NO: 77031 - DNA, 630 bp, Homo sapiens
  misc_feature: GYAE6OF02G9NZ5.8.34.D01.1.454.CMB.1.raw
  modified_base (209)..(209): a, c, t, g, unknown or other
  misc_feature (209)..(209): n is a, c, g, or t
  modified_base (299)..(299): a, c, t, g, unknown or other
  misc_feature (299)..(299): n is a, c, g, or t
  modified_base (322)..(322): a, c, t, g, unknown or other
  misc_feature (322)..(322): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaancgccaccctctcctgcagggccagtcagaatgttggcgcctacgtatcctggtaccaacagaaacctggccaggcctacccaggcccctnactctatcggtgcactccaacgngggccacgtggacactcccgagccaggttcagtggcgagtggtatgggacagacttnactctacacntacatcacgtccgtaggacgtcctaggaggtattcggttgacgttagttttacttacgttacgttacctaacgtacgttccgtaacggacggtaccgggtcccggtacccgggggtaccttaccgtttcccgggccccgttacggggaacctaagggtcggtaactacgtaaccgtaaacggtaacgttcgggtacggtacgtccgacctaccgtacgttccgtacgtttcttacccgtac

SEQ ID NO: 77032 - DNA, 901 bp, Homo sapiens
  misc_feature: GYAE6OF02HN594.8.34.D01.1.454.CMB.1.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgagggaaangccaccctctcctgcagggcctagtcagaatgttggcgcctacgtatccgtggtaccaacagaaaccgtggaccaggcctccccgacgccccctcactctagtggtcgactacgtaccaacgacgggaccacgtcggacactcccaggtcccgaggttcgaggttcggacgtagggtgggttaagtcgggaaccgtaggtaaccctttcgaaccgttccctaaccgaacccttataccgaacgttaccgacggtacccggttacgggaacgtcccggttacgggtaaggtacgttcgggttttaacggaccgtttaaggtttttaacgtttaccgtttacggttaaaccgttaaacccgttaaacggtttacccgggtttaaacccggtacggggtttacccggggtaccccccggggtttacccggggggttaaccccctttaacccgggggttttttacccccgggtaaccccccggggtttaaacggggttaaaaccccgggtttaaaaacgggggttaccggggtttaaacccgtttaaccggttaaaaaccccgggttaaaaccgggtaaaccccgggtttcggggttaacccggggtacccggtttaacccggaaccccgtttaacccggtttaaccgtttaccccgggtttttaacggttaccccgtttaaccgtttacccccgg

SEQ ID NO: 77033 - DNA, 774 bp, Homo sapiens
  misc_feature: GYAE6OF02JXVZ1.8.34.D01.1.454.CMB.1.raw
  modified_base (151)..(151): a, c, t, g, unknown or other
  misc_feature (151)..(151): n is a, c, g, or t
  modified_base (165)..(165): a, c, t, g, unknown or other
  misc_feature (165)..(165): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgactggtttccncgtgctctttaagngtgtccagtgtcaagtgcaatggtgagtctggggatcgtggtccagcctgggagtccacgagacgaccttcgtcggtgtgctaaggtccctcgttgggttacacccgtttagaggttaacctcgggcctagtcgcaacggtcggttcccacgaagcctaccgaggccgaagggtcttagggcgttgggcgcgtagttttggttaccatttccggagtacggggtcctaaggtcggtttacaaaggttcggtaatcggacgtaggtacccgttccggtaggaaacgggtccctaagtttccggaaacctgtttaacccgtccgaaaggttaacgaaccgttaacgttaccccggaaaggtaaccctactaaacggttggtttaaacgtttcgggaaacgttcccggttaaagtaaccgaaaccggtccgtttaaaacggtccggttacgggaaaacggtcccggtaaaccgggtacggtttaactacccgtttaccggacgggtaaaccgggaaccggggttaaacggggaccctaaacggggtccgggttacgttaaccccgtacggttaacccgtttccgggtttcggaaccgttcccgggttcgggg

SEQ ID NO: 77034 - DNA, 747 bp, Homo sapiens
  misc_feature: GYAE6OF02FHILE.8.34.D01.1.454.CMB.1.raw
  modified_base (339)..(339): a, c, t, g, unknown or other
  misc_feature (339)..(339): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtggggggaggcgtggtccagcccgtgggagtcacagagacctctcgtgtgcagcctcgtgggttccaccttcagtaacctacggcatgccacggtgggtcccgaccgaacgcctacccgaaggcgaaaggggtntttggggaaggttcggggtaggactagggttttcgtttacagtttccgtagggacgggtctaaggttggtttacaaaggttggttaactcgacaacgggtaccgttacccgggtagggaaaccgggcccgtaactttacccgaaccctacgttccccgtaacccgaaggtaaccgtaaacccgtaaccgttacccgaaacggtaaacctaaccgtaaacgttaggtttaacgtttgggaacgtacgtaacgaaacctacggtaaccctaaacgtcccgtaaggacggaacgaccgggtacgttaagtaccgtacgtacggaacgggaaaggggacgggggaacccagggtaccgggtacgttaccgaacggttacccttcggttacggtaccggttccggtaccgggg

SEQ ID NO: 77035 - DNA, 555 bp, Homo sapiens
  misc_feature: GYAE6OF02H8AHO.8.34.D01.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccaccggagagattgtgttgacacaatctccagccaccctgtcttcgtctccaggggaaangccaccctctcctgcagggccagtcagaatgttggcncctagtatcctggtaccaacagaaacctggccaggctcccaggccccctcatctatggtgcatccaacagggccactggcatcccagccaggttcagtggcagtgggtatgggacaggacttcactctcaccatcatcagcctggagccgtgaggatggttgctagtttattactgtacaactatacgtaccgagttcggccgtccgggggcctacgtttccggcccgtcgggaaccgtaaggtcggagtacgtacgaaacgtaacgtggtacggtctcgcaaccgtactcgtcgttccttcttaacccg

SEQ ID NO: 77036 - DNA, 751 bp, Homo sapiens
  misc_feature: GYAE6OF02GPY2X.8.34.D01.1.454.CMB.1.raw
tcagctcgcgtgtccacgaccggtgctcgatttagatcgtctgtgttgggtttgggggaagaggaagactgacggtcctgccacaggtggtgtttccattcggtgatcagcactgaacacagaggactcaccagtggagtttgggctagaacttgggttttcctcgttgcttacttttaagaggtgtccagtgtcaagtgcaactggtgacgtcgtgggggagcgtggtccagccgtgggacgtcacgagtagactcgtcggtgtacgcacgtcccttcgttgggttcccacctttacgaagttaaacctacgggctagtcgacctacggtcggggtcccacaaggcctaccgaggacgaagggtattgggagttgggtcgaccttaggttttcgttcagttcgtaggagggcctaggttgtttaacgaagttcggtatcgtcgtacggaccgtccggtaaggaacgggtcctacgttaccgaccgtatccgtaccgaagaaccgtaaccgtaacgtacccggaaacggaaacctaaaccgtacgtttagttacgtttaacgggaaccttacggaaccgtaaccggttaccgttaagttacccgtacggtaacggtaccgttaaccggtagttaacctaccgttaacgtacgggttaacggaacgggggtacggggtaaacctaggggtaaccggtacgttaacgtacgttaccggttcccgttaggccgttaccgggtaggtaccccggg

SEQ ID NO: 77037 - DNA, 548 bp, Homo sapiens
  misc_feature: GYAE6OF02FIZY7.8.34.D01.1.454.CMB.1.raw
tcagctcgcgtgtccacgaccggtgctcgatttagatcgtctgtgttgggtttggggggaagaggaagactgacggtcctgccacaggtggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcactgggtcccgccaaactccaggcaagggattgggagtggggtggctaggttgtttcatctgagggcaggttgttcaatggtatgctgacgccgtgaacgggcgattcaccatctcagagacactccaggaacacatgtatttgacctgaacacgacctaagtcctaggacggacgacggtagtactactacgtagtacggaagggacgggggaacaggcggagtaccgagtctccgttgacgttcgtgggtaccg

SEQ ID NO: 77038 - DNA, 772 bp, Homo sapiens
  misc_feature: GYAE6OF02HXCRW.8.34.D01.1.454.CMB.1.raw
  modified_base (176)..(176): a, c, t, g, unknown or other
  misc_feature (176)..(176): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacgttgggttttcctggttgcttcttttaaaggnggttgtccagtgtacaagtgacaacgtgggtgtagtcgtggggggagcggtggtccaggccgtggggacgtcacgagagacttcgtcgtgtcgactcgccttgtcggttacaccttcgaacgttaacncggntagtcgctcggtcggggtcccacgaagtcctaccgaagggaccgaaagggtcgtttggggagggttggggtgtcgttaggttttgtctacggttcgtggtacggggctagttcggttacgtaaaggtggggttaaactcgaacgtaccgttaccggttccgggtacggggaaaccgggtccggttaacttccgtaaaccgtactttacccacgacggtaaacgtactaaaaccgttcggaaaagaaccgaaacttaagttacgtttaggttacggtactcgaaacgtaaccgaacgttaccgtaacgttaccggtacggaacgtaaccgggacggtacttaacgttaacgttacgggtaacggttaaccgggaggggtaaacgggggaccgaacgggtaaccgggttaaccggttacaaccggttccgttaccggttacggtaccgggttcggttaacccgggg

SEQ ID NO: 77039 - DNA, 774 bp, Homo sapiens
  misc_feature: GYAE6OF02GEJ4Q.8.34.D01.1.454.CMB.1.raw
  modified_base (239)..(239): a, c, t, g, unknown or other
  misc_feature (239)..(239): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtgggggagcgtgggtccaggccgtgggagtcacngaagactctcgtgtgcagcctcgtggtccaccttcagttaactacggcatcgcacgtgggtccgcctaaggcctccgaggacaaacggggtattgggaacgtggggtcgaccgtaggttttcgtttcgagttcgtggaagggtctaggttcggttacaagttacgggtatcggtacgtaagtacccgttaccgggtagggtaaacgggtccccggtaacgtttaccggtaacctaacgttacccgttacccgaacggtaaacgggtaaacctaaaccgttacccggtaaacggtaaaccgttaaacgtaaacgtttacgtaacgtttttacgggaaacggtaccgttaaacggaacccgtaacggttacccgttaaacggttacccgttacgggaacggtaccggaacgggtacgttaacgttaccgttacgtaacggtaacgggtaaacgggaacgggggaaccgtaacgggtacgggtaaccgttaccgtaaggttaacccgtccggtttacggtaccgtacggttaccgggg

SEQ ID NO: 77040 - DNA, 847 bp, Homo sapiens
  misc_feature: GYAE6OF02H7CUE.8.34.D01.1.454.CMB.1.raw
  modified_base (207)..(207): a, c, t, g, unknown or other
  misc_feature (207)..(207): n is a, c, g, or t
tcagctcgcgtgtccacgaccggtgctcgatttagatcgtctgtgttgggtttgggggagaactgctcagttaggacccagagggaaccatggaagccccagctcagcttctcttcctcctgctactctggctcccagtttcagataccaccggagagattgtgttgacacaatctccagccaccctgtcttcgtctcgagggaaancgccacctctcctgacacgggccagtcagaagtgttcggcgcctagtactccgtaggtaccaacaacgaaaccgtcggaccgacggacctcccgacggtccccctctacttctagtcggtcgacctacgtacccaacggacggaccctaacgtcggacctaaccgtccccgaacggacccgtaggttaccgaacggttacggaccggtaaggttgggggtaacgtacggggaactaacggtaacctttccgaaaccttccgaaccgtaacctaacgtttacctaaacgtccgtaaccggtcccgttaaacgggacccgtacccggttaagggtaacgggttacgtttacgggtttacggtaacgttttaacggttttaacgtttaaccgtttacggaaccttaaacggtacgtaccggttaaaccgggtacgggttaacccgggttccccggggtaccccggggggttaccctttaccgggttttaccccgggaacccgggttaacggggtaaacccgttaaacgggtacggtaaaccgtttaaccgtaaccggtaaaaccggttaacggtcgggtaaccggttaccgtaccgtaccgtaccgtacgtttacgtttccggttaccgttaccttaacccgg

SEQ ID NO: 77041 - DNA, 581 bp, Homo sapiens
  misc_feature: GYAE6OF02ICLGW.8.34.D01.1.454.CMB.1.raw
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
  modified_base (445)..(445): a, c, t, g, unknown or other
  misc_feature (445)..(445): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaactgggttttcctcgttgctcttttaagaggtgtccagtgtcaagtgcaactggtggagtcgtgggggaggtcgtggtccagccgtgggagtcacagagactcgtcgtgtgcagcctcgttcggttcaccttcgagtaacctacggctatcgctacgtcggtccgaccagcctcgaggacgaagggtatggagtgggtgctgtttgtcatcgagagggntagtgtacaagtgtanganacgacgtcgaggacgcctatcgacntcacaganactaagtccaagacacgtatcgtagttcgagtnacgaatacgacctaggtccaagggcgaaccgacgggttatacgtacctacgggttcgaacggggaacgggaacggggtaccaagggtccggtaagttcccgaagtttccgtcgtttacggccggtggtacccgggg

SEQ ID NO: 77042 - DNA, 593 bp, Homo sapiens
  misc_feature: GYAE6OF02FHQ7Z.8.34.D01.1.454.CMB.1.raw
  modified_base (210)..(210): a, c, t, g, unknown or other
  misc_feature (210)..(210): n is a, c, g, or t
  modified_base (307)..(307): a, c, t, g, unknown or other
  misc_feature (307)..(307): n is a, c, g, or t
  modified_base (584)..(584): a, c, t, g, unknown or other
  misc_feature (584)..(584): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccgggagagattgtgttgacacaatctccagccaccctgtcttcgtctccaggggaaangccaccctctcctgcagggccagtcagatgttggcgcctacgtatccgtggtaccaacagaaacctggccaggctcccgaggcccctcatctatggngcataccaacacgggccacgtggcactcccagccaggttcagtggcagtgggtctgggacagtaccttcactctccaccatcacgcagcctagacgcctagaagtatttcgactagtttacttactgttacaactacgtacgtaccggtagtcggtaccgtccgggggcctaccgtttccggacccgtacgggtaaccctaaagttacgacgtacgtaaccgaaacgtaaccgtgtacgggaccgttacgacctaccgtactcgtacgttcttaccnctttccccg

SEQ ID NO: 77043 - DNA, 794 bp, Homo sapiens
  misc_feature: GYAE6OF02JMP5R.8.34.D01.1.454.CMB.1.raw
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
tcagctcgcgtgtccacgaccggtgctcgatttagatcgtctgtgttgggtttgggggaggaacgtgcgtcagttaggacccagagggaaccatggaagcccagctcagcttctcttcctcctgctactctggctcccagtttcagataccaccggagagattgtgttgacacaatctccagccaccctgtcttcgtctccaggggtaaanagccaccctctcctgcagggccagtcagaatcgttggcncctacgtatccgtaggacctaacacgaaacctcggacctaggcctacccgacggccccctcgaatcctaagtcggtcgacctactacccaaacgtacggggaccccaacgttcgggacctaacgttccccgaacggtcccgtaagggttaccgaggttaccgggacgtacggttagggggttacttacggggaacgacgttaaccgtttaccgaaccttccgttaaccgacccgtaagtttccaacttacccgtaacggtacccgttacgggaccgtacccgtacggtaacgggtagttacggtttcgaccgtttaagtttacttaccgttacgtacctaacgttaccaccgggttaccgtaacggtccgggttacccgggttacccggggtacccttaaccggtttcccgggtaccccggttacgggtaaaccgtaaccgggttacggtacgtttaaccgtaaccggttaaaccgacgtttacgggtaaccgtacggtacggttaccaccggtacttacggtacgttacgtttacctacccgg

SEQ ID NO: 77044 - DNA, 658 bp, Homo sapiens
  misc_feature: GYAE6OF02ITIQX.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagccgtgggagtcacagagactctcgtgtgcagcctcgttgggttccaccttcaacgtaactacggcagtcgccacgtcgggtacccaccgaagccgtaccgagggcgaaggggtattgggagtggggtgtctaggttttcgttacattcgtaggacgggctaggttcgttacaaggttggtatcgacgtagtccgtacggtaggaacgggcctacgttccgaaccatccgtacgagtacgtactaacgttccgaagaacaactaagtgttaacgtttacggacgtcgtaagaacctacgtaccgtaacgttccgtaaggacggtaaccgtacgggtacttagtaaccttagtaacggtaacgggtaagggaacggggtaccgtagggcgggtacttaccggaacgttccgtaccggttcggtacgtcggtaccggg

SEQ ID NO: 77045 - DNA, 756 bp, Homo sapiens
  misc_feature: GYAE6OF02FOF6B.8.34.D01.1.454.CMB.1.raw
  modified_base (175)..(175): a, c, t, g, unknown or other
  misc_feature (175)..(175): n is a, c, g, or t
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtntccagtgtcaagtgcaactggtggagtctgggggagcgtggtccagcctgggaggtcacagagactctcgtgtgcagcctcgtggttccaccttcagtagctacggcatgcacgtgggtcccnccaaactccgaggcaagggtnttggagtgggtggctagttgttcattctaggagggtctaggttcgttacaaagttcggttaatggcctaggaccggtccggttaggaacggggtccgtacgtttaccgaaccgtacttcccgttacccgaacggtaccggtaaacctaaacccgttacccgaaacgggtaaaccctaaaccgtaaacgtttacggtttaacgttttacgggaacccgttacggaaacccgtaacgtacccgttaaacggttacccgtacggaacggtaaccgtaaccggggttagttaacgttaccgttaaccgttacgggtaaaccgggtaacggggtaaccgggggggtaaacccgtaacggggaccggggttaacgtttaacccggtaacggtttaccgttacccgtttacggacccgggtttaccggtacggggtaaccccgg

SEQ ID NO: 77046 - DNA, 656 bp, Homo sapiens
  misc_feature: GYAE6OF02ITIXD.8.34.D01.1.454.CMB.1.raw
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
  modified_base (310)..(310): a, c, t, g, unknown or other
  misc_feature (310)..(310): n is a, c, g, or t
  modified_base (320)..(320): a, c, t, g, unknown or other
  misc_feature (320)..(320): n is a, c, g, or t
  modified_base (427)..(427): a, c, t, g, unknown or other
  misc_feature (427)..(427): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcncctacgtatccgtggtaccaanagaaacctggccaggcctcccacggcccctcatctatggtnacatccaacncgggccacgtggacactcccagccaggttcaggtcggcaggttgggtagtagggacagtacttcactctacaccatacatacgacgtctggacgtccgtaggaggtntgtgacttaggtttacttacgtgttacaactacgttaccgtacggtaggttacgggtcccggtacccgggggtacccttacggtttcccggggtcccgtacggggaaaacccgtaagggttcgggaccttaacggttaaccggtaaaaccgggtaaccgttagggtacggtaccgttcgaacccgtaacccgttattcccggtttacggttaccctttaccgtaacccg

SEQ ID NO: 77047 - DNA, 590 bp, Homo sapiens
  misc_feature: GYAE6OF02I67C4.8.34.D01.1.454.CMB.1.raw
  modified_base (389)..(389): a, c, t, g, unknown or other
  misc_feature (389)..(389): n is a, c, g, or t
  modified_base (479)..(479): a, c, t, g, unknown or other
  misc_feature (479)..(479): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggcctacccgacggcccctcatctagtggtgcatccaacgagggccactggcactcccagccaggttcagtcggcaggtgggtatggggacaggtacttctaccgtcncctaacctagtcactacgacgtccctgggacgtccgtgggagtattgttaggacttaagttttattacttgtactaactatccgtacggnggtcggcccggtccggggccgttaccgttccggtcccggtacgggaaccaagtggactagtaccgtaaacgacgttggtacggtctagaccactagtctgttcctcgtacc

SEQ ID NO: 77048 - DNA, 743 bp, Homo sapiens
  misc_feature: GYAE6OF02HF8KO.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggaggcgtggtccagcctggggaggtcacaggagactcgtcgtgtgcagccttcgttgggttccaccgttcaacgtaactcggcatgcacgtcggggtcccaccaagccctccgaagggcgaaagggtattgggaggttggggtggcgtaggtttcgtttcagttcgtggacggggtctagggttcgttacaagttgggtaatggacctaaggtaccgttcccggtagggaacgggtcccgtaacgttccgacctactccgtaccgagtaacgaactaaacgttacccgaacggaaacctaacgtaacgttagttacgtttacggagtacgtacgtaaaccgtacgtaaccgttaacgtccgtacgggtaacggtaaccggtacgggtaacgttaaccttaccgttacggttaacggttaaccgggaaagggggtaaccggggggtaaaccgaaggggtaccggggtaacggtttacccgtaacggtttaacccgtttaccggtttacgggtaccggttccgggtaccggggg

SEQ ID NO: 77049 - DNA, 597 bp, Homo sapiens
  misc_feature: GYAE6OF02JBH1M.8.34.D01.1.454.CMB.1.raw
  modified_base (210)..(210): a, c, t, g, unknown or other
  misc_feature (210)..(210): n is a, c, g, or t
  modified_base (455)..(455): a, c, t, g, unknown or other
  misc_feature (455)..(455): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagngccaccctctcctgcagggccagtcagaatgttggcgcctacgtatcctggtgccaacagaaacctggacccagggcctccccgacggcccccctacactctagtgggtcgcatccaacgacgggcccactcggcactccccagccaggttcaggtggctaggtgggtatgggacagtacttcactctcaccatcatcacgccgtggacgcctggacggtagtgttgacttagtttacttacgtntacaactgtaccgtacggaggtcggtccggtccggggacctccgtttccggccgtacgggaacctaagggtgtaacgtacgtaccgaaacgtacgttggtcggtaccgtcggacctacccgtattccgttacgttccttacc

SEQ ID NO: 77050 - DNA, 699 bp, Homo sapiens
  misc_feature: GYAE6OF02H1XQ9.8.34.D01.1.454.CMB.1.raw
  modified_base (205)..(205): a, c, t, g, unknown or other
  misc_feature (205)..(205): n is a, c, g, or t
tcagctcgcgtgtccacgaccggtgctcgatttagatcgtctgtgttgggtttgggggaggaactgctcagttaggacccagagggaaccatggaacgccccagctcagcttctcttcctcctgctactctggcctcctagtttcagactaccacggagagattgtgtgacacaatctcagccacctgtctcgtctcgagggaancgccacctctcctgcgacgggccagtcagtaatggttcggctcctacggtactccgtagtaaccaacgaacgtaaacctggcctaacggcctccccgaacggtccccctactacttaccgtagttcgggtcgacctaccgttaccgaacgacgggcccacggtcggacctacctacccgacgtcccgtagggttcaggtcggccgtaggtgggtaagtcgggaacacgttactcgtaactcgtaccactacgtacacgtacgacgtaccgtggacgtaccgtaggtacgtagttcggtcgtaacgttttatttaacgttacgttcgtaacgtaacgtacgtaccggtaacggacggtccggtcccgggtcggggtacccttacggtttcccggccgtaacgggtaaccaagggtacgacgttacgtaaccgaaacggtcgttacggtaggaccttaggaccctacgtacgttcgtacgttaccgttaccctccg

SEQ ID NO: 77051 - DNA, 563 bp, Homo sapiens
  misc_feature: GYAE6OF02IU5U9.8.34.D01.1.454.CMB.1.raw
  modified_base (157)..(157): a, c, t, g, unknown or other
  misc_feature (157)..(157): n is a, c, g, or t
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (368)..(368): a, c, t, g, unknown or other
  misc_feature (368)..(368): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagataccacgganagattgtgttgacacaatctccagccacctgtcttcgtctccgagggaaancgcccaccctctccgngcagggccagtcagatgtgcnctagntctgacanagaacngcagcnccngccctnatcatggncatccacnggccacgtgacactcccgagccgagttcaggtcgactaggtcggtaagtggacagacttcacgtctacaccgntcactcagcgtaggcgtccgtagaggagttgtacgacgttagtttactgttacgtactaacgtacgtaccgtaacgtcggtacggtcccggtaccggggtccttaccggttccgccgggtagtaaccgtaagtcgtataactaccgtaaacgtcgtcgtacgcgcgtacctactcttacgtcgttactacctccg

SEQ ID NO: 77052 - DNA, 703 bp, Homo sapiens
  misc_feature: GYAE6OF02I8O8E.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacgagagactcgtcgtgtgcagcctcgtggtacttccaccttcgaacgttaacgtacggctagtcgaccgtacgttcgggtcccgacctaacggcctaccggaggaccggtaaaggggtcgtttaggggtaagggtcggggtcgtacgttaggttttgttaccgagtttcgtagggacgggtcgttagtttcggttaactaaggttcggtaatcgaccgagtacccgttcgggtaaggtaaccgggtccgttaacgttcccgaaccttacgtacctacgaagaacgtaactacgtaccgaacggaacctaataacgttgttaagttacggagtacgtagaacgtacgtaccgtacgtcgtaggaacggtacgacggtacgtactacgttaagtacggtaacgggaacgggaacggggacgtacggtacggtacgttacggtaacgttccgtacggttaccgtacggtcgg

SEQ ID NO: 77053 - DNA, 837 bp, Homo sapiens
  misc_feature: GYAE6OF02H4B42.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaacgagcccaccctctcctcgcgacggcctacgtcaagtaatcggtcggccgtaccgtacgttactccgtacggtaacccaaacacgtaaaccgtcggaccgacggccctaccccgaccggtccccctactactaccttaggtcggtacgacctaaccgtacccgtaaaccgggacgggtacccctaaccggtcggaccctacccgtaccccgaacggacccgttacggttaccgacgggttcggacggttaggggtacggggttaggtacggggaactaacgttaccgttacctaccgtttacccacccgtaacctacttacctacgtacccgacgtacccggtacgggtaccgtaccggtagggtaacgttagttcggttacgtagttttaacgttttaactttaacgtacgttaaccaacgttaccgttaccgggtaaccggtggggttccccgggtaccccgggttacccggggtaccgtttacccggtttccccgggtacccggtaacgggttaaacccggtaagggttacgtacgttaacgtaaaccgaaaccggttacggttacggtacggttaccgaccgtacctaccgtagttccgtttacgttcccgttaccgttacccg

SEQ ID NO: 77054 - DNA, 709 bp, Homo sapiens
  misc_feature: GYAE6OF02JRWCA.8.34.D01.1.454.CMB.1.raw
  modified_base (298)..(298): a, c, t, g, unknown or other
  misc_feature (298)..(298): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaactgggttttcctcgttgctcttttaagaggtgtccagtgtcaagtgcaactggtggagtcgtggggagcgtggtccaggcctgggagtcacgagagactctcgtgtgcagcctctagggttcaccttcagtaactacggcatgcacgtcgggtccnccaagtctccgaaggcaagggatgggagtggggtgcgtacggtttgtttaccagttcgtaggtacggggtctaaggttggttaccgtaagttcgggttaagtcggactaacgggtaaccgttcccgggtaagggaaaccggggtcccgtaacggttaccctaaccgtaacgttcccgttacccgaacggtaaacgtaaccgtaaagtttaccccgaaaggtaaaccaaacgtaacgtacgttaagtttacggacggtacgtacgtaaacgacgtacccgtaagtaccgtaggaacggtacgtaaccgggtcgtaacgtacgttacgtacggtaacggaacggggtaacggggaacgacgggtacggacgttaccgacgttaccttaccgttacgtaccggtggtaccgggg

SEQ ID NO: 77055 - DNA, 557 bp, Homo sapiens
  misc_feature: GYAE6OF02GJM1S.8.34.D01.1.454.CMB.1.raw
  modified_base (315)..(315): a, c, t, g, unknown or other
  misc_feature (315)..(315): n is a, c, g, or t
  modified_base (429)..(429): a, c, t, g, unknown or other
  misc_feature (429)..(429): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggnttggagtggggtggcagttgtttcatctgagggcagtgttcaatggtatgcagtactccgtgaagggccgattcaccatctccagagacaattccagaacacaatgtattgganctagaacagacctaagtccctagacggacgacgggacgtaatacgtactaggtaacggaagggaacggggggaaccagggacgggtagttaccgaacggttacctaccgtttggaccgtcgtccgggg

SEQ ID NO: 77056 - DNA, 692 bp, Homo sapiens
  misc_feature: GYAE6OF02FYFAE.8.34.D01.1.454.CMB.1.raw
  modified_base (180)..(180): a, c, t, g, unknown or other
  misc_feature (180)..(180): n is a, c, g, or t
  modified_base (210)..(210): a, c, t, g, unknown or other
  misc_feature (210)..(210): n is a, c, g, or t
  modified_base (319)..(319): a, c, t, g, unknown or other
  misc_feature (319)..(319): n is a, c, g, or t
  modified_base (526)..(526): a, c, t, g, unknown or other
  misc_feature (526)..(526): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctccctagtttcagactaccgaccggagagattgtgttgacacatcncagccacctgtcttcgtctccgaggggaancgccaccctctcctgcgagggccagtacagaatggttcggccgtcctacgtactccgtacggtaaccaacaaccaaaccgtcggaccaggcctacccgacggccccctnacgtctacgttcgggtcgactaccgtaccgaacgacgggccacgtcggacacgtccccaagccgtacggttaccgaggttcggacgtagggtagggtacgtgggaacctaggtaccttacacttccgtaccactactcaactcacggtccgtggaacgtccgtaagaacgtgttcgtgtacttagtttactacgttgtaactacgtntaccggtacgtacggtcggtcccggtccggggtaccttccgggttccgggacccgtacgggtaaccgaggggtacgtacgtacgtaacgaaacggtaccggttacggtacggtacctcgtacccgtaccgttacgttcccggttactttcccgttacgttaccccg

SEQ ID NO: 77057 - DNA, 894 bp, Homo sapiens
  misc_feature: GYAE6OF02G8DVD.8.34.D01.1.454.CMB.1.raw
  modified_base (154)..(154): a, c, t, g, unknown or other
  misc_feature (154)..(154): n is a, c, g, or t
  modified_base (169)..(169): a, c, t, g, unknown or other
  misc_feature (169)..(169): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctggactggttttccncgttgctctttaagnggtgtccagtgtcaagtgcaacgtggtggagtcggtgggggagcgtggtccagccgtgggagtcacgagagacctcgtcgtgtcgctacggccttcgttgggtttccaccgtttacaacggttaaaccgttacggacctagttcgaccgtaccggttccggggtcccccgaaccgtaacggtccgttaccccgggaaggtaacccggtaaagggggtacgtttccggggtaaggggttcggggttcggacgtttaacgggtttacgttttacccgagttccggtaggggtaaccggggtactagggttaacggtttactaaaggtttgggttaactcgacgtaacgtccgttaccggagggtaaccgggtacccgtacgttacccgtaaccgtcttacccgtaccgtaagtaaaccggtaaccttaaaccttaccggaaacgttaacgtaaacttaagttaacgttaacggtttaccggaacccgtaaggtaaaccgtaaccgggtacccgtttaaacggtacccgttaacggggtaaccggttaaccgggtaaccgggtttaacgtaacgtttaaacggttaccgtaacgggttaacggggaaccggggtaacggggggtaaacccgtacggggtaaccgggttaaccggtttaaccggtaacggtttacccggttaaccggttttaccggtaaccgggtttacggggtaccgggtaacccggg

SEQ ID NO: 77058 - DNA, 786 bp, Homo sapiens
  misc_feature: GYAE6OF02IJEFK.8.34.D01.1.454.CMB.1.raw
  modified_base (335)..(335): a, c, t, g, unknown or other
  misc_feature (335)..(335): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtggtccagcctgggagtcacgagagactcgtcgtgtgcagcctgtgggttccaccttcagttaactacggctatgactacgtcggggtcccaccaaaacgtccgaagggacaaaggggtnttagggaggtgggtgactaggtttcgttcagttccgtaggacggtctaggtttcgttacgaagttggtatcggtctaggtaccggccggttaggaaccggggtccctaagtttacccgaaccgtacgttacccgttaaccgaacggtaacgtaacccgtaaaccgtacccggaaacggtaaaccaaccgttaaacgtttaggttaaacgttttaccggaaccttaacggaaaccgtaacgtaacccgttaaacggtacccgttaagggaaccgggtaaccgggtaaccgggttacggttaaaccgttaaccgttaacggtacggtaacgggaaacgggggtaacggggggaaaccctacggggtaccgggttaaccgttaaccgtaaacggttacccgtttaccggtttacggacccgggtttccggtaccgggggtacccgtaaccgggg

SEQ ID NO: 77059 - DNA, 739 bp, Homo sapiens
  misc_feature: GYAE6OF02GIIJE.8.34.D01.1.454.CMB.1.raw
  modified_base (211)..(211): a, c, t, g, unknown or other
  misc_feature (211)..(211): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagngcccacctctcctgcgacggccagtcagaatgttggccgcctacgtatccgtaggtaccaacaacgaaaccgtcggaccacggcctaccccgacggccccctacactctatggtcgcactaccaacgacgggaccacgtcgctacgtcccagcccgtaggtcaggtcggtacgagggtgggtagtcgggaacacggtacttccaccgtctaccaacctacgtacactacgacgtccgtaggtacgtccggtaggaaggtacttggttacgtacgttaacggtttaacttacgtacgttaacctaacgtccttaccgggtaaccgtacgggttaccgggtccccgggttaccgggggccccgtttaaccggggtttcccggtaccccggttaacggggaaacccgtaacggtcggtaacgttaaccggtaacccggtaaaacggttaaccggttagggtacccgtacggttaccggtacccttaaccgggtacctttccggttacgtttacccgttacgttaacccccg

SEQ ID NO: 77060 - DNA, 824 bp, Homo sapiens
  misc_feature: GYAE6OF02FVM9S.8.34.D01.1.454.CMB.1.raw
tcagctcgcgtgtccacgaccggtgctcgatttagatcgtctgtgttgggtttgggggaagaggaagactgacggtcctgccacaggtggtgtttccattcggtgatcagcactgaacacagaggactcaccatggagtttgggctgaactgggttttcctcgttgctcttttaagaggtgtccagtgtcaagtgcaaactggtggagtcgtgggggagcgtagtccagcctgggaggtcacagagactctcctgtgcagccttcgtgggttccaccttcgagtagctacggcatgccacgtcgggtcccgaccaaactccgaaggccaaggggactttgggagtggggtgcgtaggtttgtttcagtcgtaggacgggctagttcgttacaaagttgggtactggtactacggaccggtccggtaagggaacggggtcccgtacgtttacccgaacccgtaacgtcccgtaacccgaaggtaaccgaaacccgtaaacccgtacccggaaaccgggtaaaaccgtaaaccgtaaagtttaacgggttaacgttttaaccgggaacccgttaacggaaaacccgtaaccggtaacccgttaaacggttccccgtaagggtaaaccgggtaacccggtaaccggggtttagtaaaccgttaaccgttaaccggttacgggtaaaccggggtaaacggggggtaaccgggggggtaaacccgtaggggtaacccgggggttaaccgtttaacccggtaaacggttacccggtttaccccggtttacgggtaacccgggtttaccgggtaccgggggtaacccccgg

SEQ ID NO: 77061 - DNA, 965 bp, Homo sapiens
  misc_feature: GYAE6OF02FXP50.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagttcggtggggggaggcggtggtcccagccgtggggacggtcacgagagacctcgtcggtgtcgcgacgccgtcgttggggttcctacctttctaacgttaaacgtaaccggctagtagcctacgtcggggttcccgacccgaaggcctacccgacgggaccgaaaggggtacgtttagggacgggttgggggtcgggacgttaggtttcgttttacgtagttccggttgggtaacggggtcgtaacgggtttcggtttaccgttaaaggttgggttaacgttaggtacgtaacggttaacccgttagggttaacccccccccggggtaaagggggtccccggttaacgtttaacccgtaacccgtaacgttaccccgttacccggaaacgtaaaccggtaaaccgtaaaccgttttaacccggaaaccgggtaaaccctaaaaccgttaaacggtttaacggtttaagttttacggggaacggtaccgttaaaccgtaaaccgggtaaaccggtaacccgtttaaaccgtttacccggtaacgggtaaccgggtaaacccggtaaacccgggggttaccgttaacgtttaacccgtttaccgtaaccgggttaaaccggggaaaaggggggtaacccggggggtaaaacccggaaccgggggtaaccggggttaaccggtttaacccggtaaacccgggttttaacccgtttacccgggtttaacccgggtaacccggttaccggggtttaaccccggggggg

SEQ ID NO: 77062 - DNA, 604 bp, Homo sapiens
  misc_feature: GYAE6OF02GGJ9I.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagacctctcgtgtgcagcctctgggttcaccttcagtaactacggcatgcacgtgggtccaccaagcctccaggcaagggattggagtgggtggctagtttgtttcagttcgtggaggggcaggttgttacgaaagttggtaatggacaagaccttccggtggaacgggccgtattcaccatcctccgagagacaacttccgaagaacacaatggttattggatactagaacacgtacctaagtccgtaggacgacgacgggtactatactacgtacggtaacggaaggggtacggggaaaccgagggaccgggtaacgttaccggaacggttaccgttaccgtttcggaccggtcggtaccgggg

SEQ ID NO: 77063 - DNA, 988 bp, Homo sapiens
  misc_feature: GYAE6OF02F3K1R.8.34.D01.1.454.CMB.1.raw
  modified_base (122)..(122): a, c, t, g, unknown or other
  misc_feature (122)..(122): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggacncaccatggagtttggctgactggtttcctgttgctctttaagagtgtccagtgtcaagtgactaagtggtggagttcggtggggggagtcggtggtccgagcccggttaggggacggtcaacgagagtactccgtcggttgtacgcgaacgtccgttcgttaggggttccctaccgttttacgaacggttaaaccgtaccgggtacaaggttcggcctaaccggttccgggggttaccccgaaccccgtaacgggacccttccccggaacggggtaccggaaaaccggggtagtttacggggaaacggggtttcgggggttacggtaccgggttaaggtttttccggttttaccgtaagttacccggtttaggggaaccgggtcgttaagggtttaccggtttaaccgtaaaaggtttcgggttaagtacggtaccgttaacggtcccgtttaacccggggtagggtaaaccgggtcccgtacgtttaacccgtaccgtaaagtccccctttaccggaaggaacgttaaacccgtaaagttcccgggaaacgttaaaccgaacgtaaagttttccggttaaacgttttcggggaaacgttacccgttaagtaaacccggtacggttaaccgtttaaaccgggttacccgacggggttaaacgggtaccgaaaccgggggttaaccgtttaaccgtaaccgttaaacgggtttaccgtaaacggggggttaaaccggggggaaacccgggggtaaaacccgttcgggggtaacccggggttaaaccggttaaccggtttaacgggttaaaccctttttacccccgggtttacgggttaaccggggtagtttaaccccccgggggggg

SEQ ID NO: 77064 - DNA, 682 bp, Homo sapiens
  misc_feature: GYAE6OF02FS2JO.8.34.D01.1.454.CMB.1.raw
  modified_base (312)..(312): a, c, t, g, unknown or other
  misc_feature (312)..(312): n is a, c, g, or t
tcagctcgcgtgtccacgaccggtgctcgatttagatcgtctgtgttgggtctgggagaggagcccagcacctagaagtcggcggtgtttccattcggtgatcagcactgaacacagaggactcaccatggagtttgggctgaactgggttttccctcgttgctcttttaagaggtgtccagtgtcaagtgcaacgtggtggagtcgtgggggaggcgtggtccacgcccgtgggacggtcacagagactctcgtgtgcagccgtcgtgggttccaccttcagttaacctacggcatcgcacgtcgggtccncaagcctccgaggcaagggattcggagtgggtgcgtagttgtttcatcgtgagggtctaggtgttacaagttcggtatcgcagtaccgtccggtaggaacgggtccgacgttaccaccgtacgtccgtacccgtagacgaaccgtaacttacccgaacggtaaaccgaacggtaaacgttacgttaagtttacggacgtacgtacgaaccgacgtaccgttaacgtccgtacggacggtaccgacgggtacgtaacgttaccgtacgtacggtaaccggaacggggtaacgggggaacccgtacgggtaccgggaggttacccgtaacggttacccttacccggtttacggtacccgttcggtaccgggg

SEQ ID NO: 77065 - DNA, 732 bp, Homo sapiens
  misc_feature: GYAE6OF02H2533.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttccctcgttgcttcttttaagaggtgtccagtgtcaagtgcaactggtggagtcgtgggggagcgtagtccgagccgtgggaggtcacagagacctctcctgtgaccacgccttacgttcgggttcctaccgttcagttacgccgtacggcagttcgcctacgtcgggtaccccgaccaaaaccgtcccgaaggccgtaaagggtcgttagggaggtggggtgcttagtttgtttccatcgtgacgggtctaggtgttacgaagtggtactcggtcgtacgaccgggtaccgtagggaacgggttccctagtttacccaaccgttacgtacccgtaccgtaaagaccggtaaacccaaacccggttacccgaaacggtaaacccgtaacgttaagttaccgtttaagtttaccgaaccgttaccgaaacgtaccgtaaccttaacggttcccgtaggaccggtaagtaccgggtataaccgtactacgtacgggtaaaggaaggggaccgggtaacgcgggtaacggtaccgttacgtaacgttaccgttcgttacggtaccggtcggtcgggtaacccgg

SEQ ID NO: 77066 - DNA, 798 bp, Homo sapiens
  misc_feature: GYAE6OF02GTPZ6.8.34.D01.1.454.CMB.1.raw
tcagctcgcgtgtccacgaccggtgctcgatttagatcgtctgtgttgggtctgggagaggagcccagcactagaagtccggcggtagtttccattcggtgatcagcactgaacacagaggactcaccatggagtttgggctgaacgttgggtttttcctcgttgcttctttttaagaggtgtccagtgtcaagtgcaacgtggtgagtcgtgggggagcgtggtccagccgtgggagtcacgagagactcgtgtgtgcagcctcgtggttcctacttcgagtaactacggcatgacacgttcggcccaccgaagccgtccgaggaccgtaaagggtcgttgggagggttgggtacggtcgttaagggttttctttcgagttccgttaggacggggacttagggttacgttacgaagttacgggtatacggactacggtacccgttacggtagggtaaccgggtccgtacgttaccgtaccgtacgttaccgtacccgaggtaacgaacgttaaccgttacccgaaacggaaaaccttaacgtaaagtttcggtttaacggttacggaacgtaccgttaacggaaaccctaacgggttacccgttaaaccggttccggaagggttaacccgggtaaaccggtaaccgggttaccttaacgtaaccgttacggttaacgggtaaccgggaaacgggggaacccggggtaaaccggaacgggtaacccgggtacgtttaacccggtaacgtttaacccgttacccggttttaacggtaccggttacccgggtaaccgggg

SEQ ID NO: 77067 - DNA, 585 bp, Homo sapiens
  misc_feature: GYAE6OF02HKJWL.8.34.D01.1.454.CMB.1.raw
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (413)..(413): a, c, t, g, unknown or other
  misc_feature (413)..(413): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgagggaaagagccaccctctcctgcagggccagtcagaatgttgcgcctagtatcctgtaccaacagaaacctggaccagcctccgaggcccctnactctatcggtncgtataccaacgacggccacgtggcactcccagccaggttcgagtcggacgtaggtggtagtggggacagtacttcactctaccgaccatcatcgagtccgtggacnccgtagaagtatgttacgacgttaagtttactacgtcgtaacaacgtagtacccgtacgtacggtccggacccggtccggggactccgttccgacccgtaggaacctaaggtgatacgtaacgaaaccgtaacgtgtacggactagtaccactactcgtacgttctactacg

SEQ ID NO: 77068 - DNA, 917 bp, Homo sapiens
  misc_feature: GYAE6OF02GYV5A.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactagaacacagagactcaccagtggtaggttggcgtgtaacgttcggttttccttcgttcgtcgttacgttttaaggtaggtcgtccgtagtgtactaagtacgacgtagtggtaggtaggtcgggtaaaaaaaaaagggggtgggtcggtcggtaccgtacggtccgggtggggtacggtacgacgtaacgtacgtaccgtcgttcggtcggtcgacgtaccgtcccgttcggttcgggttaccttacccgttaccgtaacgttaaaccgtacggtactacgtcgtccgtaccggtccgggtacccgaccgtaaccgcccgtacggacggtacggtaagggtacggttagggtacgggtggggtcggtacggttacggttttacgtttacgtacgttcggttaggtacgggtacgttaggttagttaacgttaaggttaggttaacgtacggtacgtacggtaccggttaccggtaacggtaaccgggtacctaccgtaaccctaacgtaccttaccggtaacgaacgtaaccgtaaacctaaccggttaaccggaacttaaaacgtacgttaacgttaggtttaagtacggtaccgtaagtaacgtaaaccggttaaccgttacccgggtaacttacggtaaaccgggaccggtaaccggtaccggttaaatacccgttacggtaacgggttaacggggtacggggaaacggggtaaccggggttaacgaaccgggttaacccggttacgttaaccgttaacccggttaccggtttcccggtaaggttcccggggaccgttacccgggg

SEQ ID NO: 77069 - DNA, 830 bp, Homo sapiens
  misc_feature: GYAE6OF02GK8V3.8.34.D01.1.454.CMB.1.raw
  modified_base (209)..(209): a, c, t, g, unknown or other
  misc_feature (209)..(209): n is a, c, g, or t
  modified_base (534)..(534): a, c, t, g, unknown or other
  misc_feature (534)..(534): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagataccaccggagagattgtgttgacacaatctccagcccacctgtcttcgtctccgagggaancgccaccctctcctgcacgggccagtcgaagaagttggttcggccgtacctacgtactccgtacggtaacccaacgaacgaaaccgtcggaccacggtcctaccccgaccggcccccctacacttaccgttagttcgggtacggacctaccgttaccccgaaaaccggacggggtaccccaacggttcgggacctaaccgttccccgaaccggcccgtaacgggtttcgaacggttcggacgtaggggttacggggtacgtaggggaaccaggtacctttaccgacctcctaccacctactacacttccgacgtccgtagggacnccgttaggaacggtattcggttacgacgtttaacgttttaacgttacttacggttaacaactaccggttaccggtaacccggtgggtacccgggtcccgggttaccccgggggtaccttacccgggtttcccgggacccggttaacggggaaacccgttaaacgggtcgggttaaccttaaccggttaaaccggtaaaacccggttaaccggtttaggggtacccgggtaccgtacggaacccgttacccgttacgtttacccggtttaccgttttacccgtaccgttaacccccg

SEQ ID NO: 77070 - DNA, 635 bp, Homo sapiens
  misc_feature: GYAE6OF02GFUJZ.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtggggggaggcgtggtccagcctggggaggtcacagagactctcgtgtgcagcctctgggttccaccttcagtagctacggcatgccacgttcggggtcccaccaaacgtccaggcgaaagggattgggaggtgggtggctaggtttgtttcagtcgtggagggcaggttgttacaagtggtatgcgtcggaccgccggtagaacgggccgtagttaccactactcctaccgagacgaaccaacctaccgaacggaacaactaagttagtaacgttacgacctaggaaccagtacctaagtccgtaggacggacgacgggtataacgtactacgtaggtacggaagggaacgggggaaccgagggaccgggtaacgttaccgaacggttaccgttaccgtttacgggtaccgttcggacggggtacccgg

SEQ ID NO: 77071 - DNA, 671 bp, Homo sapiens
  misc_feature: GYAE6OF02FRL7P.8.34.D01.1.454.CMB.1.raw
  modified_base (297)..(297): a, c, t, g, unknown or other
  misc_feature (297)..(297): n is a, c, g, or t
  modified_base (355)..(355): a, c, t, g, unknown or other
  misc_feature (355)..(355): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacagagactctcgtgtgcagcctctgggttcaccgttcagtaactcggcatgcacgtgggtccncaagctccaggcaagggattggagtgggtggcctagttgttcatcgtggaggctagtntacagtggtatgcagactccggagaacggtccgtacttcacctactacctacacggaacgactaacttacccgaaaggtaaccaacaagttacgttaagttcgggaacgtcgtaacgaacgtaccgtaccgttaacgtccgttacgggaacggtaaccggtacggggacctttaacgttaaccgttacggttaacggtaaccgggtaaagggggtaaccggggggtaaacccgaggggtaccgggttaaccggttacccggtaacggttaacccggtttacccggtttacggtacccggttacggtacccgggggg

SEQ ID NO: 77072 - DNA, 746 bp, Homo sapiens
  misc_feature: GYAE6OF02HA07W.8.34.D01.1.454.CMB.1.raw
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (301)..(301): a, c, t, g, unknown or other
  misc_feature (301)..(301): n is a, c, g, or t
  modified_base (314)..(314): a, c, t, g, unknown or other
  misc_feature (314)..(314): n is a, c, g, or t
tcagctcgcgtgtccacgaccggtgctcgatttagatcgtctgtgttggggtttgggggaggaactgctcagttaggacccagagggaaccatggaagccccagctcagcttctcttcctcctgctactctggcctcccagtttcagataccaccggagagattgtgttgacacaatctccagccaccctgtcttcgtctccaggggaaacagccaccctctcctgcagggccagtcagatgtggcnctacgtntccgtgtaccaacagaacctggccaggcctaccccgacggccccctnactcgtagtggtncctactacccaacggacgggaccacgttcgggactaccgtccccgacgcccgtaggttcacggttcggcgtaggggttcgggtaggtacggggacctaaggtacctttcaccgttccaccaaccctataccaacgtaccgaccggtacccgttagggaacccgtccggtaggagggttacgtttcggtttacggactttaaggttttaacgtttacgttacgtaacctaacgtacgttacccgggtaacgttacgggtaccgggtccccgggttaccggggtacctttaccgggtttcccggtacccggtacgggtaaaccgtaacggggtacggtacgttacgtaaccggtaaaccggtacggttcggtaccgggtaccgttaccggacctaacccgtagttacccgttacgtttccgttaacgtaccccg

SEQ ID NO: 77073 - DNA, 704 bp, Homo sapiens
  misc_feature: GYAE6OF02G1Q89.8.34.D01.1.454.CMB.1.raw
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctcgtgtgcagcctgtgggttccaccttcacgtaacacggcatgctacgtcgggtcccaccaagcctccgagggacaaggggattgggaggtggggtcgngtaggtttgttacattcgnggagggtctaggttcgttacaagttcggtatcgcgtagtaccgttccggagggtaacgggccgtattacccgacctacgttcctaccgaagaacgtacctaacgttacccgaagtaaaccgaacgtaaagttcgtaacgttagggaacgtacgtacgaaaccgtacgtaacccgttaacgtacccgtagggaaccgggtaaccgtacgggtaacgttaacgtaaccgttaccggtacggtaaacgggaaacggggaaccgggggtaaaccgacggggtaaccgggtacgttaaccggtaacggtaccgtttaccggttcggtaccggttccggtaaccgggg

SEQ ID NO: 77074 - DNA, 693 bp, Homo sapiens
  misc_feature: GYAE6OF02F9IIZ.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctcgtgggttccaccgtttcagtaacctacggcatgcacgtgggtcccgccaagcctccgaggcaaggggacttgggaggtgggtggcgtaggtttgtttccgattcgtaggagggtctaggttcgtttacaagttcgggtaagtcgactacggtacctcccggtagggaacgggtccgtaacgttaccgacctactccgtccgaacgaacgtaacgtaacgttacccgggaacctaacgtaaattaggttacgtttggacgtacgtacgaaaccgtagtacccgttaacgttcccgtaaggaacggaacgtaccgggtacgttaacgtaccgtacgtacgtaacgggaacggggaacgggggaaccgacgggaacgggtacgttaccgtaacggttaccgttaccggttacggtaccggttcggtacggggtacccgg

SEQ ID NO: 77075 - DNA, 757 bp, Homo sapiens
  misc_feature: GYAE6OF02FPBP4.8.34.D01.1.454.CMB.1.raw
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (324)..(324): a, c, t, g, unknown or other
  misc_feature (324)..(324): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattggtgttcgacacaatctccagcccaccctgtcttcgtctccgaggggaaagngcccaccctcnccctgcgagggccagtccagatggttggcncctacgtnttcctggtaccaacacgaacctggaccaggtcctccgaggcccctacactctagtcggtcncacgtccgaacgacgggcccacggtcgggccacgttccccgaggccctaagggttcaggtcggcgtagggttgggtacgttaggggaacacggtacttcgaaccgtccgtaccaccctagttacacgttaccacgtccgtggaccgtaccgtgggtacgggtattacgggttacgtacgttaaaggtttttaactaccgtttacgtaccgtaaacgttacgtaacccggttacccgggttagggtcccgggttacccggggttcccgggggttacccttaaccggttttcccgggaccccggtttaggggaacccgttaaagggtacggtaaccgttaaacgttaaaccgggtacgttcgggttacggggacctaccggtacccaaccggtcgtttaccttaacggtttcctttaccgtacccgtttacccgg

SEQ ID NO: 77076 - DNA, 782 bp, Homo sapiens
  misc_feature: GYAE6OF02IKYQ0.8.34.D01.1.454.CMB.1.raw
  modified_base (293)..(293): a, c, t, g, unknown or other
  misc_feature (293)..(293): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggtttcctgttgcttcttttaagaggtgtcagtgtcaagtgcaactggtggagtcgtgggggagtcggtggtccaggtccgtagggacggtcacgaggtaacgaccgtcgtcgtcgtgccgagccttacgtgggttactcccgttanaacgttaacgtacggctaagtcgacgacgttcgggtcccgaccgaagtccctaccgacgggtaccaagggacgttgggaagttcggggtgggtacctaggtttacggtttcaacgttcggtaggtacggggtacagggtttacgttaccgtaaaagttggactttaggggaccctaagggtaaacccttcgggtagaaaccgggggttcccggtaacgtttacgaaccttaacgttacccgtaccgtaggtaaacgaacgtaaacttacgaaaccggtaaaccgaaccgtaaacgttacgttaacgttagacgtcgtaacgtaaccgacggtaaccgtacgttaacgtacgtacgggaacgtaccggaacggtacttacgttacgtaacgttaaggtaacgggtaaccgggggaaggtaaccgggtaacgggtaccggtacggttaaaccggtaccgttaacccgtttgtttacgggaccgttacgggg

SEQ ID NO: 77077 - DNA, 713 bp, Homo sapiens
  misc_feature: GYAE6OF02F3MF4.8.34.D01.1.454.CMB.1.raw
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccaccctntcctgcagggccagtcagatgttggcgcctacgtatccgtggtaccaacagaacctggccaggcctcccaggcccctcatctatggtcgcatcccaacgcgggccacgtggcactcccagcctaggttcaggtggcaggtgggtatggggacagtacttcacttcaccactatacatcgacgtcccgtggacgccgtaggacggtacttggttcgtacgtttaacggttttaactttaccgtttcggttaacctaaaccttacgtttaccccggttaaccggtacggttcccgggtaccccgggtttccccgggggggtaccctttacccgggttttcccgggaccccggttacgggggtaaacccgttaaacggggttcgggtaacttaccggttaaaccgtaaaacccggttaaccggttacgggtaccgggtccgttaaccggaccgtacccgttaacgttccgtttaccggtttcccttaccgttaacccg

SEQ ID NO: 77078 - DNA, 248 bp, Homo sapiens; identical to SEQ ID NO: 76492
  misc_feature: GYAE6OF02I8ORZ.8.34.D01.1.454.CMB.1.raw
  modified_base (246)..(248): a, c, t, g, unknown or other
  misc_feature (246)..(248): n is a, c, g, or t

SEQ ID NO: 77079 - DNA, 600 bp, Homo sapiens
  misc_feature: GYAE6OF02FOCQO.8.34.D01.1.454.CMB.1.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (441)..(441): a, c, t, g, unknown or other
  misc_feature (441)..(441): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcnctacgtatcctggtaccaacagaaacctggaccaggcctaccccagggcccccctacactccgtaatcgggtgctaactccaaacacggggtcccacgttcgggccaacttccccaggcccaggttccaggtcggactaggtgggtatggggacaggtactcgaactctaccacctatcagtcacgcctggacnccgtggaggtcgtgttgcgtagtttagttacttgtacactataccgtacgtagtacggccggtcccggggtcctcgtttcggccgtcggaccaagtaggactacgacgtaaacgaacgtcggtagccgtggaccaccgtatcgtacgttacttctaccg

SEQ ID NO: 77080 - DNA, 738 bp, Homo sapiens
  misc_feature: GYAE6OF02HQO0J.8.34.D01.1.454.CMB.1.raw
  modified_base (212)..(212): a, c, t, g, unknown or other
  misc_feature (212)..(212): n is a, c, g, or t
  modified_base (258)..(258): a, c, t, g, unknown or other
  misc_feature (258)..(258): n is a, c, g, or t
tcagctcgcgtgtccacgaccggtgctcgatttagatcgtctgtgttggggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaancgccaccctctcctgcagggccagtcagaatgtgcgcctagtatcncggtacaacagaaacctggacaggctacccaggcccctacatcctagtcggtcacaactcccgaaacgcgggacccacgtcggacctacgtccccgaagccccgtaagggttccaggtcggtacgtaggggtacgggtaacgtcggggaacctaaggtaccgtttacccaacttacccgtacctaacctaacttaccaacgtttaccgaacgggtacccggttagggaaacgtcccgtaagggaggtaacttcggtttacgaccgtttaagttttaagaccttacgtaaccaacgtacgtacggtaccgtagggtcccgggtcccgggtaccggggtacccttaccggtttacccggggacccggttaacgggaaccccgttaagggggtcgtaacgggtaaccgttaaacggaaaccgggtacgttggtaccgggtacctacgactaccggactttcggtaccgttactacttaacccg

SEQ ID NO: 77081 - DNA, 825 bp, Homo sapiens
  misc_feature: GYAE6OF02IOA5N.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagatacccaccggagagattgtgttgacacaatctccagcccacctgtcttcgtctccgagggaagcgccaccctctctgcacgggccagtcagaagttggttacggcctaccgttacgtacgttcccgtaggtaacccaaacgtaacggaaaacccgtgggacccgaacgggtccctaccccccgaacgggtcccccccttcctaacttccgttaaccgtggggttaccaccctaccgttaacccgaaaccggaacggggtcccctaacggtcggacctaccgttacccccgaacggtcccgttagggtactaggggtcggaccgtaggggtttgggtaaggtacgggaaacgtacggtactttacgacccgtcctaaccaccgtaatccgtatacgtcggtaccggtagggtaccgccggttaggtaacgtggttacggttacgtaagtttaacgttttagttaccgttacgtactaaacgttacgtaccccggtaaggtccggtccggggttacccggtccccgggggttaccgtttacccgggtttaccggggtaccccggttagggaaacccggttaagggtacgtaaacgttaccggtaaaccggaacggttacggtggtaacggtccgtaaccggtacaccggttagttccgttagttcccgttcttaacccgg

SEQ ID NO: 77082 - DNA, 747 bp, Homo sapiens
  misc_feature: GYAE6OF02IWU8S.8.34.D01.1.454.CMB.1.raw
  modified_base (348)..(348): a, c, t, g, unknown or other
  misc_feature (348)..(348): n is a, c, g, or t
tcagctcgcgtgtccacgaccggtgctcgatttagatcgtctgtgttgggtttggggggaagaggaagactgacggtcctgccacaggtggtgtttccattcggtgatcagcactgaacacagaggactcaccatggagtttgggctgaacttgggttttcctcgtttgcttctttttaaagagggtgtccagtgtacaagtgcaactgggtggagtcgtggggggagcgtggtccaggcctggggagtcacagagacctctcgtgtgcacgcctgtcggttccaccttcagttaacctcggcatgcacgtcgggtcccaccaaggcctaccgaagggcaaaggggtntttagggaggttcggggtaggactaggtttcgttcaagtcgtaggaggggctagggttcgttacgtaaagttgggtaatcggactacggtaacccgttccggtagggaaaccgggtccggtaacttcccgaacctaacgtaccctaccgaagtaacgtaaacgaacgttaacccgaacggaaaccaaacgtaattacggttaatttacggggacgtaccgtaagtaaccggaacgtaccgttaaagtcccgtaaggtaacgggaaccggacgggtaaccgttaacgttaacgttacgtaaggtaacggggaacggggtaaaccgggggaaccgtaagggtaacgggtacggttaaccgtagttaaccgttaccggttacggtacggtcggtaaccgggg

SEQ ID NO: 77083 - DNA, 819 bp, Homo sapiens
  misc_feature: GYAE6OF02GAK1F.8.34.D01.1.454.CMB.1.raw
  modified_base (238)..(238): a, c, t, g, unknown or other
  misc_feature (238)..(238): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagccgtgggaggtcacngagactctcctgtgcagtcctcgtggttccaccttcgaagtagccgtacggctatgcctacgtcgggtacccaccaaaacctccgaagggacgaacgggtagtttcggggaaggtttggggtcggtacgtaaggttttcggttttaccaagttccggtaggaacggggtcctaaggttcgttacgaaagttgggttaatcggtacttcgggacccggtaccgggttagggaaacgggggtccccggttaatttacccgtaacccgtaacgttaccgtaacccctaagggaaccgtaaaccctaaccgttaacccggaaacggtaaaccctaaaccgtaaaagtttcggtttaacgtttaacggtaaacccgtacggaaaaccgtacgtaaacccgttaacggttcccttaacgggaacggtaaaccgttacggggttacttaacgttaaccgtaccgtagggtaacgggaaacggggtaacgggggtaaacccgtagggtaacccgggttaacgttaacccgtaacggtttaccctttacccggtttaacggacccgggttcggtacccgggggtacccgg

SEQ ID NO: 77084 - DNA, 847 bp, Homo sapiens
  misc_feature: GYAE6OF02GXS3J.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagactaccgaccggagagattgtgttgacacaatctccagccctacctgtcttcgtctaccgaaggggtaaacgacgccctaacccgtctccgtcggaccgacggggccctaggtacaaggtaacgttcggttcgggccggtaccttaacggtacttcccgtaacggtaacctaaacgaacggtaaacccgtcggaccgaacggtccctaccccgaccgggtccccccttactaacgttccgttaacggttcgggtaccggtacctaaccgttaacccggaaaccgggaaccggggtacccttaccggtaccgggtaccctaaccggttaccccgaaccggtaccgttacgggtttacggtacggtaccggtacggtaagggggtttacgggtacgggtaacgggtacgtaccggtaccgttacctaaccgttaccacctaaccgtactacgtacgtccgacgtcggtaggtacctcggtagtacggtacgttcgttacgtagtttacgttacttacgttacgtaactacgtacgttacgggtaccgtgggtacccgggttacccggtcggggttacccttcccgggttacggtacccggggtaacgtaaccgttacggtacggtacgttaccgtacggtaaacgttcggtacgtcggtacctcggacttaccgtacttccggtacgtttacccactttcccgg

SEQ ID NO: 77085 - DNA, 739 bp, Homo sapiens
  misc_feature: GYAE6OF02HYWK6.8.34.D01.1.454.CMB.1.raw
  modified_base (393)..(393): a, c, t, g, unknown or other
  misc_feature (393)..(393): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtgggtggagtcggtggggggaggtcgtagtccagccgtgggaggtccagagacgactcctcctggtgcacgcctcgttcgggttccaaccttcgaggtacgccgtacggcagtcgacctacgttcgggtaccccgaccaaaacctccggaggaccgaaggggtagttgggaggttggggtcgcgtaggtttgttacngttcgtggacgggctaggttcgttacgtaaagttggtatcggtcgttcggaccgtcggacgggtaacgggccgtacgttaccaccctatccaccgagaacgaccaaccgtaccgaacgaaactaaccgtaagtttacgttaacgtttacgggaccttaacggaaccgtaccgtaaccgttaacggtaccgtagggaacgggtaccggtaacgggttactaaacgttacgtaccggttagggaaccgggaaggggggaacggggaaccggacgggaccgggttaaacggtccgttaaacgtacccgtttccgtttaggtacccggttcgggttaccgggtacccggg

SEQ ID NO: 77086 - DNA, 744 bp, Homo sapiens
  misc_feature: GYAE6OF02GHRNA.8.34.D01.1.454.CMB.1.raw
  modified_base (220)..(220): a, c, t, g, unknown or other
  misc_feature (220)..(220): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (315)..(315): a, c, t, g, unknown or other
  misc_feature (315)..(315): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagactaccgaccggagagtattggtgttgacaacaatcctccagaccaccctgtcttcgtctccgaaggggaaacncgcccaccctctcctgcgagggccagtcagatgtggcnctacgtntccgtaggtaccaacgacgaaacctggccacggcctcccgacggcccctnactctagtggtcgaccactacccgaaacgacggggacccaacggttcggacctaccgtaccccgacggtacccgtagggttacctagggtacggtaccgtagggtttagggggttaacgtacggggaacctaacggttaccttacccggtaacttcccgttaacccgacctaacttacgaaccgttccgaacggtcccgtagggtaccgtccggtaggtacggtaactggttacgctttaacggtttactacgtcgttaactaaccgtaggttacccggtaacggttacggtaccgggtcccggtccgggggtaccttaccggtttaccgggcccgagggtaaaccctaagggtcgtagtaccggtaacgtaaacggtagttcgggacgtctacggaccttaccgtagttccgtcgttacctctacccg

SEQ ID NO: 77087 - DNA, 793 bp, Homo sapiens
  misc_feature: GYAE6OF02FX1Y1.8.34.D01.1.454.CMB.1.raw
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
tcagctcgcgtgtccacgaccggtgctcgatttagatcgtctgtgttgggtttgggggaggaactgctcagttaggacccagagggaaccatggaacgccccagcctcagcttctcttcctcctgctactctggcctcccagagatcaattggagaagtgtgatgacacagtctccggtcaccctgtcttcgtttttccgnggggangtacgccctaccctctcctgtgccggccagtcagtagcgttaggactaacttagcctgtatcgagacaggtacggcctggaccaaggcctacccgagaccttcccacattacgtttcggacctaccgtttaagacggggcctaaggtacgaacctcccgagccgtaggttcgacggacggtcgacggttgggtaccgttaggggtacctttccggttaaccaccgttacttacccgaaccgtaactaaccgtaaaccgttaacccgtagtaacctaaaccttccgtacggtaaccgttaaccgtttacgaaccctttaaggttttaccgtttaccgtacgttaccgtacggttaacctaacggtttccgttaacgggaaacgttaccggttaccgggttaccctttacggtaacccgggttttacggggtacccgggttaagggggaacccgttaacggggttaccgtaaacccggttaaccgaaaaacgttaccgttcggtacggtaaccgtacggaccctaacgtaaccggtcttacggttaccttacgtaaccttcccggttaccccggtaacctcggtaccc

SEQ ID NO: 77088 - DNA, 720 bp, Homo sapiens
  misc_feature: GYAE6OF02JOYU3.8.34.D01.1.454.CMB.1.raw
  modified_base (215)..(215): a, c, t, g, unknown or other
  misc_feature (215)..(215): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagactaccaccggagagtattgtgttgacaacaatcgtccagcccacctgtcttcgctaccggagggaacncgccacctctcctgccgagggccagtcagtaactggttcggcctaccgtacgtatccgtacggtaaccaacaacggtaaccgtcggaccgacggccctacccgacggtcccccttacactactagtcggtacgactacgtaccgaacggacggacctaacgtcggtaccacctacccgacggtacccgttaacgggtccgtaaggtccggacgtacggggttacggtacgtacgggactaacggtaacttccgtaactcccgtacaccgtactacgtacgtacacgtcgaggacctcgtaggacgtgttcggttacgacgtttagtttacgttaccgtaagtaccaaacgtcggtacccggttagccgggttacccggccgggttaccgggtaccttaccggttccgaccggtacggaacgtaacggttggaccctaggtaccgaaaccgtgttacggccgtcgacgttaccgacttcgttaccgtcgttaccttaggtaccccg

SEQ ID NO: 77089 - DNA, 700 bp, Homo sapiens
  misc_feature: GYAE6OF02GWH50.8.34.D01.1.454.CMB.1.raw
  modified_base (330)..(330): a, c, t, g, unknown or other
  misc_feature (330)..(330): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagataccaccggagagattgtgttgacacaatctccagccacctgtcttcgtctccgaggggaaagacgcccaccctctcctgcgagggccagtcagtaattcgttggccaccttacgtactccgtaggtaacccaacgaacgaaaccctggaccaggcctaccacggcccctcgatctagtggtncataccaacgcggaccacgtggacactccgacgaccgtaggtacaggtcgacgtaggtgggtaggtaggtacacgtacgttactaacgtcctacaccgtactactactacgaccgtccgtagggtaaccgtccggtaggtaacggtagttacgggttcgtacgttaacgttttacgttacgttgtaaccaagttacgttacggtaaccgtacgggtacccggtccggtaccggggtaccgttaccggttccggacccggttaaccgggtaacgaaacgttcggtaaccttacggaaccgtaaaccggtaacgttcggtacggtactaccggtaccaacgttcgtacgtttacgtcggttaactaccccgg

SEQ ID NO: 77090 - DNA, 700 bp, Homo sapiens
  misc_feature: GYAE6OF02HE6PQ.8.34.D01.1.454.CMB.1.raw
  modified_base (307)..(307): a, c, t, g, unknown or other
  misc_feature (307)..(307): n is a, c, g, or t
  modified_base (319)..(319): a, c, t, g, unknown or other
  misc_feature (319)..(319): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgcccaccctctcctgcgagggccagtcagaatgttggcgcctacgtatccgtggtaccaacagaaaccgtggaccaggcctcccgacggcccctnactctagtggtncactaccgaacgacgggaccacgtcggcacgtcccgacgccgtaggttcaggtcggacaggtgggtagtgggacagtacttcactcaccaccatcactacgacgtccgtgggacgtccgtaggaggtattggtcgtagtttaacgttttacttacgtacgttaacaacttacggtacccgttaacggacggttccgggtacccgggtcccggggtaccgttaaccggttttccccggggacccggttaaacgggaaaccccggttaaaggccgggttaacgttaacgtaacccggaaaacggttaccgttacggggtacggtaaccgtaccggtacccaaccgttacgttaccggttaccgtttaccttacccttacccgg

SEQ ID NO: 77091 - DNA, 909 bp, Homo sapiens
  misc_feature: GYAE6OF02H7B3S.8.34.D01.1.454.CMB.1.raw
tcagctcgcgtgtccacgaccggtgctcgatttagatcgtctgtgttgggtttgggggaggaactgctcagttaggacccaggagggaaccatggaacgccccagctcagcttctcttcctcctgctactctggcctcctagtttcagactaccaccggagagtattggtgttcgaccactaactcctaccacgccctaacccttggttctttaccgtccgtaccggaagggggtaaaacgcgccctaaccccttcgtcctaggccgaacggggtaccctaggttccaaaggtaagtttcggttcgggccgtaccgttaacggtactttccgaacgggttaacccaaaactaacggaaacccgtggaccccgtaacgggtcctacccccggacggtccccctacgtaacctcgttaagtcgggttaccacctaaccgttaccccgaaacggtaccgggtaccccaccggttagggaccctaaacccgtcccgtaaccggacccggtaggttttaccgacggtttcggaaccggtagggttcgggttacggacgggacttacggtactttccgaactcccgtaccaaccgtactacccgacgttacgaccggtaccgttacgggaccgtacccggttagggtaacggtagtttccggggttaagtccggtttaacgttttaacgtttaccgtaacgttaacccgttaacgtaaccggtttacccgggaaccgggttacggggttacccggaccccgggggtttaccccgggtaacctttcccgggggttttaccccggacccgggttaccgggaaaacccgttagggtcggtaacgttaaccgtaacggtaaccggtaacgtcggttaacggcctaggacccttaggcttacggtgttaccctgtaaccg

SEQ ID NO: 77092 - DNA, 690 bp, Homo sapiens
  misc_feature: GYAE6OF02JV7A5.8.34.D01.1.454.CMB.1.raw
  modified_base (210)..(210): a, c, t, g, unknown or other
  misc_feature (210)..(210): n is a, c, g, or t
  modified_base (312)..(312): a, c, t, g, unknown or other
  misc_feature (312)..(312): n is a, c, g, or t
  modified_base (344)..(344): a, c, t, g, unknown or other
  misc_feature (344)..(344): n is a, c, g, or t
  modified_base (480)..(480): a, c, t, g, unknown or other
  misc_feature (480)..(480): n is a, c, g, or t
tcagctcgcgtgtccacgaccggtgctcgatttagatcgtctgtgttgggtttgggggagaactgctcagttaggacccagagggaaccatgggaagccccagctcagcttctcttcctcctgctactctggctcccagtttcagactaccaccggagagattgtgttgacacaatctccagccacctgtctcgtctccgaggggaaacncgcccacctctcctacggtcacgggtccaggtacaaggtacttggttcggccgtacctacgtactcgtacggtaaccaactaacgaaacctcgccaggtccncccgtacggcccctacgactacgtagtcggtnctaccgtacaacggacggtccaacgtcggacctactacccgacgtaccgtacggttccgacgttaccggacgtacggggttacggtacggtacgggactacggtaccttacacgtttccgacctaaccgataccgngttacgacgtacgtacggacgtacgtgggaattcgtacgttcgagttacggtttaacttacgtactaccaataccgtacggttacgcggttaggcccggtaccgggtccttaccggtccgtaccggtacggacgtaaggtcgtacgtacacgtaaccgtaaggtcgttacgtcgtcgtaccgacgtacgtacttcggtacctcgttaccg

SEQ ID NO: 77093 - DNA, 732 bp, Homo sapiens
  misc_feature: GYAE6OF02HGUGQ.8.34.D01.1.454.CMB.1.raw
  modified_base (212)..(212): a, c, t, g, unknown or other
  misc_feature (212)..(212): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagataccaccggagagattgtgttgacacaatctccagcccacctgtcttcgtctccgaaggggaaancgccaccctcctcctgcgacgggccctagtcaacggtaattcggttcgggccgtcccttaacgttcttaccgttacggtaacccaaacgaacgaaaccgtcggaccgaacggccctaccccgacggccccctactacttacgttacgtggtcgccaactaccgaaacgaccggacctacggtggcctacctccgacgccgtacggtcgaggtcgtacgaggtgggtagtacgggactacgtacgtctacgttccactactactcaactcgacgacgtacggccgacgttaggaggtacgtcgttagtacttaagtttcttactcgacttaaacggtctccggtaacgtcgggttaccggccccggggtaccgggtacccttccggttacccggggtaacccggtaaggtaaacgggttaacgttaccgtaaccgttacgaaacccggttaaagtccggttaggttacgacccggtaatacccgaacggttccgttcggtaccctttacgtacctccccgg

SEQ ID NO: 77094 - DNA, 670 bp, Homo sapiens
  misc_feature: GYAE6OF02IY7WU.8.34.D01.1.454.CMB.1.raw
  modified_base (207)..(207): a, c, t, g, unknown or other
  misc_feature (207)..(207): n is a, c, g, or t
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
  modified_base (299)..(300): a, c, t, g, unknown or other
  misc_feature (299)..(300): n is a, c, g, or t
  modified_base (311)..(311): a, c, t, g, unknown or other
  misc_feature (311)..(311): n is a, c, g, or t
  modified_base (390)..(390): a, c, t, g, unknown or other
  misc_feature (390)..(390): n is a, c, g, or t
tcagctcgcgtgtccacgaccggtgctcgatttagatcgtctgtgttgggtttggggggaggaactgctcagttaggacccagagggaaccatggaagccccagctcagcttctcttcctcctgctactctggctcccagtttcagataccacggagagattgtgttgacacaatctccagcccacctgtcttcgtctcgagggaanacgacccaccctctcctgcgaggccagtcagatggtggcncctagtctccgtagaccaacagaaccgtgacacggccncccgacggtccccnnctcgtatggcncgactccgaacgcgggaccacgtacggcctacctcccgacggaccgtacgttcgaggtggacgtagggttagggtacgngggaacacggttactctacctctaccactatccgtatcgacgtcggtaggtctccggtaggagtacgtggtttgaacgtttagtttattacgtacgtactaaccgttacggtaccgggtacggtcggtaccgggtcccgggttaccgggacccgttcgggttacccgggacccgggttaaacggaacccgttaaagggttcgaagtaccgtaaccgaaacggtacgttgggtacctacggtaccgtctaaccgttgttccgtacgtttcgtccttaaccg

SEQ ID NO: 77095 - DNA, 706 bp, Homo sapiens
  misc_feature: GYAE6OF02F05AM.8.34.D01.1.454.CMB.1.raw
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtgggggaggcgtggtccaggcctggggagtcacgagagactctcgtgtgcagccctcgtgggttccaccttcagtaacctacggcatgcacgtgggtcccncaagcctccgaggcaagggnttggagtgggtgctagtttgttacagtcgtggaggtctaggttcgttactaaggtggttaagtggaccgtaacggtacccgttaccgggtagggtaaacggggtcccggttaactttacccgaacccgtagttccccgtacccgtaaggaacgtaacctaaacgtttacccgaaagggtaaacctaacgtaaagtttcggttaacgtttagggacgtacgtaacgaaccgtagtacccgttaagtaccgtaggaacgtaccggtacgggtacctaagttaccgtacgtacgggtaacgggaagggggtaaccggggaaaccgtacgggaccggtacgttaccgtaaggttacccgttcgttacggtacgtcgggtacggg

SEQ ID NO: 77096 - DNA, 705 bp, Homo sapiens
  misc_feature: GYAE6OF02HOZXL.8.34.D01.1.454.CMB.1.raw
  modified_base (117)..(117): a, c, t, g, unknown or other
  misc_feature (117)..(117): n is a, c, g, or t
  modified_base (210)..(210): a, c, t, g, unknown or other
  misc_feature (210)..(210): n is a, c, g, or t
  modified_base (326)..(326): a, c, t, g, unknown or other
  misc_feature (326)..(326): n is a, c, g, or t
  modified_base (340)..(340): a, c, t, g, unknown or other
  misc_feature (340)..(340): n is a, c, g, or t
  modified_base (527)..(527): a, c, t, g, unknown or other
  misc_feature (527)..(527): n is a, c, g, or t
tcagctcgcgtgtccacgaccggtgctcgatttagatcgtctgtgttgggtttggggaggaactgctcagttaggacccagagggaaccatggaagcccagctcagcttctcttccncctgctactctggctcccagtttcagactaccaccggagacgattgtgttgacacaatctccagccacctgtcttcgtctccgaggggaaacncgccaccctctcctgcagggcccagtcagaattgttacggcgtacctagtactccgtaggtaaccaacaacgaaacctggaccaggtccacccgaggccccctacatcgtactggnccaactaccaacgngggcctagtcggacacgtccacgccaggttaccaggtcggacgtaaggtcgggtaagtcggggaacacgtaacctttgaacctttcaccaccgtatacgtaacgtcgaacgtcgtacgggacgtcccggtagacgggtaacttggttacgtacgttaagttttaacgttacgttacgactaaacgtnttaccggtaacgtaggtccggtacccgggtccggggtacccttaacgggtttcccggaccggttaaccgggaaccctaaagggttaccggaagttaacgtaacccgtaaaacggttaacgtcggttaacggcggttaacctacggtaccccagttaccgttagttacctacgttaccc

SEQ ID NO: 77097 - DNA, 704 bp, Homo sapiens
  misc_feature: GYAE6OF02G0JLU.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacagagactcgtcgtgtgcagtcctcgttgggttccaccttcaagtaacctacggctagtgaccgacgtcggggtacccgaccaaacggcctccgaggaccgaaaggggtagttgggacggtggggtagggctaggtttgtttacgatcgtggagggctagttgttacaagttcggtatcgactagaccgtcggtagggaacggtccgtacgtaccaaccgtactccgtaccaaggacgtaaccgtaacttacccgaacggtaaccgtaactaaagtttaggttagtttagggacgtacgtaacgtaaacgacgtaaccgttaacgtccgtagggaacgaccggacgggtacgttaacgtaacgttacgtaggtaaccgggaagggggtaaccgggggaacgaacgggtaccggggtaagttaccgaacggttaccgttaccggtttacggtacggtacggtaccgggg

SEQ ID NO: 77098 - DNA, 687 bp, Homo sapiens
  misc_feature: GYAE6OF02JOAIY.8.34.D01.1.454.CMB.1.raw
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
tcagctcgcgtgtccacgaccggtgctcgatttagatcgtctgtgttgggtttagggtgaggaactgctcagttaggacccagagggaaccatggaagccccagctcagcttctcttcctcctgctactctggctccctagtttcagactaccacggagagtattgtgttgacacaatcctccagcccacctgtcttcgtctacgagggaagngcccacctctccgngcgaggccagtcagactgttaggcgcctacgtctccgtggtaccaaacacggaaaccctggaccaggtacccgtcccacggtccccctggaacttccgtagtacgggtctcaactccaaacggacggccacgtaggacctacgtaccgcgacgtcggttacacggtaggcgtaggtcgggaacgtgggactacgtacgtcacgtctacgactatctacttcgacgtaccgacggacgccgtaggacggtacttcggtacgttacgtttaacgtttacttcgttacgttaactactacgttaccgacggttacggtcgggttacccggtccggggtaccttaccgggttcccgtaccgtaacgggtaaccgtaacggttacgtaacgtaccgtaaccgaacggttactacggggtacaccgttcggtaacccgtacggttacgtccgttagtacccgttac

SEQ ID NO: 77099 - DNA, 725 bp, Homo sapiens
  misc_feature: GYAE6OF02FQ9PJ.8.34.D01.1.454.CMB.1.raw
  modified_base (212)..(212): a, c, t, g, unknown or other
  misc_feature (212)..(212): n is a, c, g, or t
  modified_base (247)..(247): a, c, t, g, unknown or other
  misc_feature (247)..(247): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagcctaccctgtcttcgtctaccgagggaaagngccacctctcctgcgaggccagtcagaatgtggcncctacgtatccgtgtaccaacgagaacctcggccaggcctcccgacgccccctcatctagtggtcgcactccgaacgcgggccacgtcggcctacgtcccgagtcccgtaggtttccgaagggtcggtacgaggggttggggtagtcggggaactacggtacctttacgtaacttccttccgaaccctagtaccagtaccacgtccgtagggaccgtccgtaggagggtacgttaggttcggacgtttaagttttaacttacgttacgttacgtaaacgtacgtttaccggtaaccgtacgggtaccgggttaccccggtacccgggggtcccttaccggtttacccgggtacccgttaccggggaaaccgtaacgggttacgtacgttaacgtaaccggtaaaaccgttaccggtaggtcggtaccgttacggaccctaccgttaacgttccgttacggttccttacgttaccccgg

SEQ ID NO: 77100 - DNA, 604 bp, Homo sapiens
  misc_feature: GYAE6OF02G4UAZ.8.34.D01.1.454.CMB.1.raw
  modified_base (257)..(257): a, c, t, g, unknown or other
  misc_feature (257)..(257): n is a, c, g, or t
  modified_base (325)..(325): a, c, t, g, unknown or other
  misc_feature (325)..(325): n is a, c, g, or t
  modified_base (381)..(381): a, c, t, g, unknown or other
  misc_feature (381)..(381): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccaggcctgggagtcacagagactctcgtgtgcagcctntcgggttcaccttcagtaacctacggcagtgcctacgtgggtcccacaaggctccgaggccgaagggnttgggagtgggtggctaggttcgttacagtcgtgagggctaggtcgtacagtgtangacgagtacgttccggtaggaacggtccgtattccgaacctacgtctccgaagacgactaataccgagaactaacatgttattggatacgtagactagtaccgtagtccgtagacgacgacggtagtacgtacgtacgtgtaacggaacgggacggggaacgacgggtacgggtacgttaccgtacggttaccgttaccggttacgtaccgtcggtaccgggg

SEQ ID NO: 77101 - DNA, 829 bp, Homo sapiens
  misc_feature: GYAE6OF02JMT0B.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaaacacagaggactcacatggagtttgggctgaactggttttcctcgttgctctttaagaggtgtccagtgtcaagtgcaactggtgagtcgtgggggagcgtggtccagccgtggggaggtccacgagacgactcgtcgtgtgccagcccttgtcgggttcaccttcaacgttaacgtacggcatcggccacggtcgggtcccgaccaacgtcctccgaaggcgaagggatttcgggaggtggggtccggacgttaggttcggtttcatcgtagacgggctagtgttacaagttcggtatcggacgtagtaccgttcggagaaacgggccgtattcccgtaacgacttccgtaccgtaacggtaacgaacctaaccgtacccgaaacggtaaaccgtaacgttaaacgttacggtttaacgttcgggttaaaccctacggtaaaccgaaccggttaacccgttaaacggttacccggttagtaacccgggggtaaacccgttacgggggttaaaccgttaaggtttaacccgtttaaacggttaccgggtaaaaccgggggtaaccgggggtaaaccgggggggtaaaccctaacgggggttaacccgggggtttaacccggtttaacccgggtaacggttttaaccccggtttacccgggtttaaccggggtaaccccggggtttacccgggttacccggggggttaaaccccggggg

SEQ ID NO: 77102 - DNA, 857 bp, Homo sapiens
  misc_feature: GYAE6OF02HY7ZW.8.34.D01.1.454.CMB.1.raw
tcagctcgcgtgtccacgaccggtgctcgatttagatcgtctgtgttggggttggggaggaactgctcagttaggacccagaggaaccatggaagccccagctcagcttctcttcctcctgctactctggctccagtttcagactaccgacggagagattgtgttcgacacaactctaccacgaccacccgtcgtccttcgtcctaccgaagggaaaagcgacccacccttctccgtgacgacgggtccagtcgaagtaagtgggttacggacctaccgttaacgtacgttaccggtacgtaaacccgtaaaacgaacggtaaaacccgtcgggacccgtaacgggtacccctacccccggtacccggaccccccttacgtaccgttaccgttacgtcggttaccgtaccgtaaccctaacccgaaaccggtaaccgggccctaacggtcgacctaaccctcccgaacaccggttacggttaccgaggttaccggacggtaggggtacggtaggacgggaacgtacgtaaccgttccgacgttaccactacccgtactaccgtaactacggactacccgggtagacccggttacgaggtaggtaacgttcggttacgtatttaacggtttaacttacgtacgttaacaaccgtaggtaacccgttacggttaaccggtccggttcccgggtacccggggttaccctacggtttcccgggtacccggtacgggtaaacccgtaggggtaccggtaacgttaaccggtaaacggaaacccgttagggtaccgggttacgaaccgttccgaacccgttaacgtccgtttaaccgtttcgtttacccgttactaaccccgg

SEQ ID NO: 77103 - DNA, 687 bp, Homo sapiens
  misc_feature: GYAE6OF02H1JXW.8.34.D01.1.454.CMB.1.raw
  modified_base (170)..(170): a, c, t, g, unknown or other
  misc_feature (170)..(170): n is a, c, g, or t
  modified_base (196)..(196): a, c, t, g, unknown or other
  misc_feature (196)..(196): n is a, c, g, or t
  modified_base (232)..(232): a, c, t, g, unknown or other
  misc_feature (232)..(232): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (327)..(327): a, c, t, g, unknown or other
  misc_feature (327)..(327): n is a, c, g, or t
  modified_base (350)..(350): a, c, t, g, unknown or other
  misc_feature (350)..(350): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggtttcctgttgctcttttaagnggtgtccagtgtcaagtgcaactggngagtcgtgggggagcgtggcagccgtgggagtccanagagactntcgtgngcagtcctgtggtcacttnaagtaactcgnagtncagtcgggccactaagcctaccgagacgaaggacttgggaggtgggnctagtttcgttacgatcgtaggngggtactaaggtcgttacaagttggtaatcgacaaacgttccgtaccggtaagggaaccgggtacccgtatttacccgaaccgtacttccgaccgaagtaacgaaacgtaacgttaccgaacggaaacctaacgtaagttaggttagtttacgggataccgtagaaaccgtaccgtaccgtaaacggtccgtacggaacggtaaccggacggaaccgttaagtaccggtaccgttaaggtaacgggaacgggaacggggtaaccgacggggtaaccggcggtttaaccgaaccggttaccgttaaccggttccggtaccggttaccggtacccgggg

SEQ ID NO: 77104 - DNA, 689 bp, Homo sapiens
  misc_feature: GYAE6OF02G0D1B.8.34.D01.1.454.CMB.1.raw
  modified_base (211)..(211): a, c, t, g, unknown or other
  misc_feature (211)..(211): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagatacccaccggagagattgtgttgacacaatctccagccaccctgtcttcgtctccgagggaaagngcccacctctcctgcgaggccagtcagtaatgttggccgctacgtatcctggtaaccaacgtaacgaaaccgtcggacccaaggcctaccccgacggtccccctacactcgtaatcgggtcaccacttacccgaaacggtacgggcccaacggtcggacctaccgtaccccgaacggccctaaggggtttacacgggttcggacctaggggttagggtaagtcggggtaacacgtaccttacaccttcgtacacctatccgatccgacgtccgtaggacgtccgaggtacgtagttcggtagtacgttaagtttacttacgtagtaacaacgtactaccggtaccgtaggtccggtacccggtaccgggtccttacggttacccggcgtaacggaacccgtaagtcgatacgaacgtaaacggtaccgtaggtcgtacggtatacccgacgtcgttactacggtaccttacgtacccg

SEQ ID NO: 77105 - DNA, 770 bp, Homo sapiens
  misc_feature: GYAE6OF02G4KVB.8.34.D01.1.454.CMB.1.raw
  modified_base (453)..(453): a, c, t, g, unknown or other
  misc_feature (453)..(453): n is a, c, g, or t
  modified_base (462)..(462): a, c, t, g, unknown or other
  misc_feature (462)..(462): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggactgaacttgggttttcctcgttgcttacttttaagaggttgtccagtgtcaaggtgactaacgtggtaggagtcgtggggggagcggtaggtccagtccgtggggacggtcacgagacgtacctcgttcctggtacgcacggtcccgtcgttcgggttcccaccgtttacgaacggttacgcgtaccggctaagtcgaccgacggttcgggtaccccgaccaaaccgttccgaacgggaccggtaaaggggtacgttgggacgggttgggtcgggtacgttaggtttcgttacgtacttccggtaggacggggtntaacggttnttaacggagttacggtatggtaaccgttcgggaccggtccggaacgggtaacggtccgtaattacccgaacctcgtaccaccgtaagaccgtaaccaaccggttaaccggaacgtaaccgaaacgttagttacggttaacgttaccgaaccgttacggaacgtaccgttactaccgtacgtaggacggtacggtacggttataacgtactaccgtaggtacgggaacggggtacgggaaccgtacgggtacggttaaccgtacgacgtttaccgtccgttacggtacgggtacggtacggtacccggg

SEQ ID NO: 77106 - DNA, 662 bp, Homo sapiens
  misc_feature: GYAE6OF02IOALL.8.34.D01.1.454.CMB.1.raw
  modified_base (277)..(277): a, c, t, g, unknown or other
  misc_feature (277)..(277): n is a, c, g, or t
  modified_base (327)..(327): a, c, t, g, unknown or other
  misc_feature (327)..(327): n is a, c, g, or t
  modified_base (340)..(340): a, c, t, g, unknown or other
  misc_feature (340)..(340): n is a, c, g, or t
tcagctcgcgtgtccacgaccggtgctcgatttagatcgtctgtgttgggttggggagaggagcccagcactagaagtcggcggtgtttccattcggtgatcagcactgaacacagaggactcaccatgggagtttgggctgaacttgggttttcctcgttgctcttttaagaggtgtccagtgtcaagtgcaactggtggagtcgtgggggaggcgtggtccaggccgtgggaggtcacgagagtactctcgtgtgcagcctgtgggtccaccttnaagtaactacgcagtgctacgtggtccgacaagcctcgaggcaaagggtnttggacggtgggngtctagttcgttcatcgtggaggctagtgtacaagtggtatgactagcgtcgtaggacgggtcatcactatctacgagaacgtactaacgttaccgaaggtaacaacgttaaagttagttaagtttcgggaacgtacgtaacggtaaactaccggtaaccgttaaccgtccgttaacgggaacggtaaccgtaaccggggtacgtaacttaaaccgtacgtacggtaacgggtaacggggtaacggggaaccgtacggggacggtaaccggttaacgtacgttaccgttaccgttacggacgttccgggtacgggtacccgg

SEQ ID NO: 77107 - DNA, 679 bp, Homo sapiens
  misc_feature: GYAE6OF02JEXBI.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgccagtgtcaagtgcaactggtggagtcgtgggggaggcgtggtccagccgtgggaggtcacagagacctctcgtgtgcagcctctgggttcaccttgagtaactacggcatgcacgtggtcccgcaagctccgaggacgagggattggagtgggtgcgtagtttgtttcagttcgtggagggctaggttcgttacaaggttcggtaatcgactaacggtaccgtccggtaagggaacggggtccgtagttacccaacctacgttccaccgtagaacgtaacctaaacgttacccgaacggtaaacctaacgtaagttacgtttagtttaacgggacgtaccgtagaacctacggtacccgtaagtacccgtaggaacggccggtacgggtaccgttagttaaccgtacgtaaggtaccggggaaagggtaacggggaaccgagggtccgggtaagtacccgtaaggttaccgttaccgtttacgggtaccgtcgtaaccggggg

SEQ ID NO: 77108 - DNA, 695 bp, Homo sapiens
  misc_feature: GYAE6OF02INEYF.8.34.D01.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagataccaccggagagtattgtgttgacacaatctccagccaccctgtcttcgtctccgagggaaacncgccaccctctcctgcgagggccagtcagaatgtcgcnctacgtatccgtggtaaccaacgaggtaaacctggaccacgggcctaccccgacgggtccccctagaacttccgttaacgtcgggttacacctacgtaccgaaacgtcgggacctaacgtcggaccacgttaccccgaaggtcccgttaaggtccgagtcggacgtaacgggtgggtaacttcgggactaggtacttcgacgtcctcgaccatacgtactacgtacgccgtacggacgtccgtaggacgtacgtacgttcgtacgttacgtttaacgtacgttacgtactaacgtacgtaccggtacggttacggtaccggtccgtacccggggtaccttaccgggttccggtacccgtacggtaccgtaacggtacggtactacgtaacgtaacgtaacgtcggtacgtcgcgtacctacgtacttcggtacgttctcgtaccg

SEQ ID NO: 77109 - DNA, 848 bp, Homo sapiens
  misc_feature: GYAE6OF02G46LN.8.34.D01.1.454.CMB.1.raw
  modified_base (246)..(246): a, c, t, g, unknown or other
  misc_feature (246)..(246): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgacaacgtggtggagtcgtggggggaggcgtggtccagccgtgggaggtcacgaganactctcgtgtgcagcctgtcgggttccaccttcacgtaactacggcatgctactgggtcccaccaagcctccgaggcgaagggtattagggaggtggggtcgcgtaggtttcgttcacgttcgacgggagggtctaggttcggttactaaagttgggtaactcggacaaggtacccttaccgggtagggtaacggggtcccttaacgttaccctacccggtaacttcccgtaacccgaagtaaaccggtaaccctaaacgttaccccgaaaggaaacccgtaaaccgtaagtttacggttaacgttttacggggaaccgttacgtaaccggtaaacgtaccggttaaccccgtaaaagggttcccccggtaagggtaacccggggtaaacccggttaaacccggggttaacggttaaccgttaaacccggtttacccggtaacgggggtttaaacccgggggaaaaccgggggggtaacgggggtaaaccccgggttaaccggggtaccggggtttaacccggtttaacccggtaaacgggttttaccccgtttaccccgggttttacgggttacccgggtttacccggtaaccccgggggg

SEQ ID NO: 77110 - DNA, 756 bp, Homo sapiens
  misc_feature: GYAE6OF02JK6D2.8.34.D01.1.454.CMB.1.raw
  modified_base (343)..(343): a, c, t, g, unknown or other
  misc_feature (343)..(343): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgagggaaacgacgcccaccctctcctgcgacgggccagtcaagattggttcggcgtcctacgtactccgtggtaccaacgacgtaaccgtcggaccgacggccttaccccgacggtcccccttacgacttactagtcgggtacncctactacccgtaaaccggaccggggaccctaaccggttcgggaccctaaccgtacccccgaacggtaccccggtacggtttacgacgggttacgggtacctaggggtttacgggtacgttacggggacaacggtaccttacctaccgttcctaccgaccctagttaccacgtaccgaaccgtaccggttggaaccggtccgtagggtacggttacttcgggttacgtacgttacgtttactccgtacgtaccaacgttcgttacccggtacggtcggttaccgggtacccggtaccggggtcccttaaccgggtttccgaccggtaccggttaacgaaggtcgtacttaacgaccgtaaaccgtgtacggccgacgttacgaccctactcttccggtcgttctaccgttacc

SEQ ID NO: 77111 - DNA, 707 bp, Homo sapiens
  misc_feature: GYAE6OF02JOPA8.8.34.D01.1.454.CMB.1.raw
  modified_base (207)..(207): a, c, t, g, unknown or other
  misc_feature (207)..(207): n is a, c, g, or t
tcagctcgcgtgtccacgaccggtgctcgatttagatcgtctgtgttgggtttggggaggaactgctcagttaggacccagaggaaccatggaagccccagctcagcttctcttcctcctgctactctggctccagtttcagactaccacggagagtattgtgttgacaacaatcgtccagcccacctgtcttcgctcgagggaaancgcctacctctccgtgcacgggccagttcaagtatcggttcgccgtccttaagacttccgtaggtaaccaacgtacgaaaccgtcggtaccgtaacggtcccgttaccccgacggtcccccttagaacttaccgttagttagggctactaacgtaccgaaacggacggtcctaccggtcggacctacgtacccgcgtacgttacgggttacagggttcgagtacggttaggacgtggactcggtactcaacttcgcacctagtcgactcgcgtacgtcgacgtccggtagacgtagttcgcgtagttaagtttacgtaccgttgacctaagttacgtccgtaaacgtggtacccgtaccgggtaccggtaccgtttaccgggttcccgaacggttacggaacccgtaggtttacgacctttaacggtacggtaaacccgtaggtcgtacgtaccgtacgtccgaacttccgttaaacgtcccgtttataacccgttcccg

SEQ ID NO: 77112 - DNA, 742 bp, Homo sapiens
  misc_feature: GYAE6OF02HMWC0.8.34.D01.1.454.CMB.1.raw
  modified_base (295)..(295): a, c, t, g, unknown or other
  misc_feature (295)..(295): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaatggtggagtcgtgggggagcggtggtccaggccgtgggacgtcacgagaggactctcgtgtgctagccttcgtcgggttcctaccgttcaagtaacgtacggntaagtcgactacggtcggggtcccaccaaggccttccgaggtacgaaaggggtcttagggaggttgggtcgacgttaggtttcgtttacacgttgtagggacggtactaggttcctaagtaaggttggtacgtagcgtaagtaccgtccggtagggaaccggtccgtattaccgaacctactccgttaaccgaaggaacgaaccgttaacgtaacccgtaaacggaaacctaacgttaacgttagttaacggttttaacggacgtacgtaaggaaaccgtacgtacccgttaaaccgtcggttaacggaacgggtaaccgtacgggtaaccgttaagtaaccgttacgtaacgggttaacgggaaacggggtaacggggaccgtaacgggaacggtacgttacccgtaacgttaccgttaccgtttacgtacggtacggtaaccggg

SEQ ID NO: 77113 - DNA, 745 bp, Homo sapiens
  misc_feature: GYAE6OF02GBE2Q.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttctttaagaggtgtccagtgtcaagtgcaacgtggtggagtcgtgggggagcgtggtccagccgtgggagtcacgagacgactcgtcgtgtgcacgcctctgggttccaccttcagtaactacggctagtcgacgacgtggggtcccacccgaagccttccgaggacgaaggggtatttcgggagttcggggtgaccgtaggtttcgttcagtcgtaggacgggtctaggtcgtttacaaggtgtatcgacgtacgtacgtccggtaggaacgggtccgtaacgttaccgaaccgtattacccgtacgaagaacgaacgttaacttacccgaacggaaaccaacgttaaacgtagtttacggttaaggtacgaacgttaaggaaaccgtacggtaaccgtttaacggtacccgtaagggtaccgaaccgggtaacgggtacttaacgtaacccgtcgtaaggtaaacccggggtaaagggggtaaccgggaacgggtacgggtaacccgggttaaggttaccccggtaaaggttacccccggttaagttttaccgggtacccggtagggttaacccccggggg

SEQ ID NO: 77114 - DNA, 727 bp, Homo sapiens
  misc_feature: GYAE6OF02GVTDW.8.34.D01.1.454.CMB.1.raw
  modified_base (331)..(331): a, c, t, g, unknown or other
  misc_feature (331)..(331): n is a, c, g, or t
  modified_base (403)..(403): a, c, t, g, unknown or other
  misc_feature (403)..(403): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctgggagtcacagagactctcgtgtgcagcctcgtgggttccaccttcagtaaccgtacggcatgccacgtcgggtcccgacaagtcctaccgaggacgaaggggnttcgggaggttggggtcggctaggtttcgttacattcgtaggagggctaaggttgttactaagttgggtacnggtaccacggtacctaccggtggaaacgggtcccgtaagttacccaccgtaacttcccgtaccgaaggtaacgacctaaacgttacccgaacgtaaacctaacgttaaagttcgttaagtttggacgtaccgttaaggaacctaccgtaccgtaacgttccgtacgggtaacggaaccggtacggtaaccgttaacgtaccgttaacgtaacggtaaccgggaaaggggtaaccgggggaaaccgtacggggaaccgggttaacgttaaccggtaacgttaccgtttacccggttacggttaccggtacggttaaccccggggg

SEQ ID NO: 77115 - DNA, 825 bp, Homo sapiens
  misc_feature: GYAE6OF02HJBLE.8.34.D01.1.454.CMB.1.raw
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
tcagctcgcgtgtccacgaccggtgctcgatttagatcgtctgtgttgggtctgggagaggagcccagcactagaagtcggcggtgtttccattcggtgatcagcactgaacacagagactcaccatggagtttgggctgaacttgggttttcctcgttgcttcttttaagaggtgtccagttgtcaagtgcaactggtggagtcgtgggggaggcgtggtccagccgtggggagtcacagagactcgtcgtgtgcagcctntgggttcaccttnacgtaactacgcagtgacacgtcggggtccaccgaaacgtcctaccgaagggaccgaaaggggtagtttacgggaagggttcggggttacggtaccgttagggtttttacgttttccgaacgttccgtagggttaacgggggcctagggtttacgttaaccgtaaggtagggtttaagtacggacgtaacggtaaccgttaccggggtaagggtaaccggggtacccggtaactttacccgaacccgtaacttacccgtacgtaacggtaacgtaaccgtaaacttacccgaaacggaaacctaacgttaagttacggttaaggttacggtaacgtaccgtaagtaaaccgtaacgtacccgtaacgttaccggtaacggaggaacccggtaacgggtaaccgttaacgttaaccgttaccggtaacgggttaacggggaaacgggggtaacgggggaaacgttaaccggggtaccggggtaacggtaaccgttaacccggtaacgttttacccgtttacgggtacccggtttaccgggtaacccggggg

SEQ ID NO: 77116 - DNA, 1017 bp, Homo sapiens
  misc_feature: GYAE6OF02ID0C5.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggtttttcctcgttgcttcttttaagaggtgtccagtgtcaagtgcaacgtggtggagtcgtgggggagcgtggtccagccgtgggagtcacagacgactcgtcggtgtcgcacggaccttcgttcggggttacctaacccgtttcgaaacggtttaaacccgtacggggacctaagttcggacccgtaccggttaccgggggttaccccgaaccccgtaaaaggtccccgttacccggaaacggggaccgtaaaaagggggggtacgttttcgggggaaagggtttcggggggttacgggacccgtttaaggggtttttacctttaccgaacggtttcggttacggggaaacggggtccttaaagggtttccggtttaacaaaagggtttcgggtttaacgtcggggtaaccaaaccggggttaaccttacccggggtttaaggggtaaaccggggggtcccctttaaacgtttaccccggaaaacccgtttaccttaacccggttaccccgtaaagggaaaccggttaaacgttaaaacccggtttacccgaaaacgggtaaaaccctaaaaccgttaaacgtttaccgggtttaaacggtttaacggggtaaccggttaccgtaaacgggttaaaaccgtaaccggtaccccggttaaaacgttcccgggttaagggaaaccggtaaccggtaaacccgggggttaacttaaccggttaaccgttaccggtaacgggttaaaccgggggaaacggggggtaacccgggggtaaacctacgggggtaaccgggttaacccgttaaccggtaaaccggttttaccgttaccccggttttaaggtaccccgggtttggtaaccccgggggg

SEQ ID NO: 77117 - DNA, 724 bp, Homo sapiens
  misc_feature: GYAE6OF02FYMBE.8.34.D01.1.454.CMB.1.raw
  modified_base (208)..(208): a, c, t, g, unknown or other
  misc_feature (208)..(208): n is a, c, g, or t
  modified_base (383)..(383): a, c, t, g, unknown or other
  misc_feature (383)..(383): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaanagcccaccctctcctgcagggccagtcagaatggttgcgcctacgtatccgtgtaccaacacgaaacctggccaggcctcccgacggccccctcactacgtatcggtgctactaccgaacgacgggccaacgtcgacactccacgcctaggttcaggtcgacgtaggtgggtagngggacgacgtactactactccgtacctacatacactacgacgtccgtgacgtcctaggacgtagttcgttcgacgttaggttttaacttacgttacgtaaccgtaaacgttacgttacccgggttaacgttaccgggttacccgggtaccccgggttaccgggggtaccccgtttaacccgggttttccccggggacccggtttaacggggaaacccgttaaacggggttcgtaacctaacggtaacccggtaaaaccgtaacggtttacgggtaccggtaccgttacgaacccggtacccttaacggtttccttccggttttaccgtaccctttccccgg

SEQ ID NO: 77118 - DNA, 892 bp, Homo sapiens
  misc_feature: GYAE6OF02G2NJM.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcggtggtccagccgtgggaggtcacagagactctcggtgtcgcgacgccgttcgttcgggttcctaccgttccgaaggttaaaccgtaccggactagtcgtaccgtaccggttcggggtaccccgacccgaacgtcccgtacccgacggaccggtaaagggtacggtttagggacggggtgggggttcgggacggttagggttttcggttttacacgttacggtaggacggggtacgtacggttggttaccgtaagttggttagttacgacgtaacggtaccgttacccgggtaacgggaaccgggtacccggtaaccgttacccgtacccgtaacgttacccctaccggaacgtaaaccgtaaccggtaaaccttaacccggaaaccggtaaaccgttaaaccgtaaacgttaaccggttttaggttaacgggtaacgtacgttaacggtaaccgtaaacgtacccgttaaacggttaacccggttacgggtaacgggtaacccgggtaccggttaccgggttaaccgttaaccggttaacggttacgggtaaacggggttaaaccgggggaaacgggggtaaacccgggtaacggggtaaccgggttaccggtaaccgtttaaccggttaccggtttacccgggtttaacgttacccgggttcgggttaacccggggg

SEQ ID NO: 77119 - DNA, 723 bp, Homo sapiens
  misc_feature: GYAE6OF02JPEDN.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgagggaaagacgcctaccctctccgtgccgagggtccagtccagaacttgttcggcacccttacgtatcccgtggttaaccaacgtaacgaaacctggacccacgggtaccttaccccgacgggtaccccctactactcctaacgttcgggtacgcaccgttaaccaaccggaggggtacccacggtcggacaccgttcccgaacgccgtaacggggtactcggtagggtcctaagggttcgggtagtacggggaccgtaacgtaccgtttaccggaactccggttaccaaacctacgttctaaacgccgtaacggccgttacggaacgcccgtaggtaggtactggttagtcgttaacgtttacgtttacgtaccactaccgtactacggtaccgttacggcgtcccgggtccggtaccgtcgtttaccgtccgacggtaccgtaagtacggtagttacgacgtaaacgtaccttaggcgtaccgtgaccgtaccgagttacggtacgtaccttgttacccg

SEQ ID NO: 77120 - DNA, 850 bp, Homo sapiens
  misc_feature: GYAE6OF02FGWUK.8.34.D01.1.454.CMB.1.raw
  modified_base (171)..(171): a, c, t, g, unknown or other
  misc_feature (171)..(171): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctagtacgtggttttcctgtgcttacgtttaagnggtcgtccagtcgtacaagtcgactaacgtggtaggacgtcggtgggggacgtcgtcggtccagccggtgggacgtccacgaggacnctcgtcgtgtcncacgtcctcgtcggtcctaccttacgacgtaccgtacggctaacgtcgaccgtacggtccgtaccccgaccgaacgtccgtaccgaagggtaccgtaaaggggtacgtttacggggtacggttcggggttcggttaaccgttacgggttttacccgtttacgaacggttccggttacgggttacgggtacccttagggttaccgtttaacgtaacggttacggttacgtaccggaccggtaacccggttacccggtacccggggttaacgggaacccgggtaccctttaacccgttacccgaacccctaccggtttaacccaaccggtaaccggtaaccttaaacccggttaaccgaaccggaaaccgttaaacccgtaagttaacggtttacgttaaacgggtaccgtaccgtaaccgtaaaccggtacctaaccggtttacccgtacggtaccgtaacgggaccgaacgtacggtactaacgaccgtagaacggtaggggaaaccgggtcggaaccgtagggtaccgtacgttacgaccggtttaccgtcggttcccgtaggtcccgggtaacccggg

SEQ ID NO: 77121 - DNA, 653 bp, Homo sapiens
  misc_feature: GYAE6OF02F3TE0.8.34.D01.1.454.CMB.1.raw
  modified_base (347)..(347): a, c, t, g, unknown or other
  misc_feature (347)..(347): n is a, c, g, or t
  modified_base (425)..(425): a, c, t, g, unknown or other
  misc_feature (425)..(425): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcgttttaaggaggtgtccagtgtcaagtgcaactgggtggagtcgtgggggagcgtggtccagccgtgggagtcacagacgactctcgtgtgcagtccttcgtggttccacttcgaagtaacgtcggacagtcgactaccggttcgggtcccaccgtaagtcctaccgagggaccaaggggtntttacgggaggttgggtcggacttaggtttcgttacaattcggaggacggtctaaggttccttacgaagtttggtacncggtacgtagacccgtacggtaagggaacggtccgtacttacccgaccgtatccgtacgaagaacgtaacctaacgtccgaaacgtaacctaagtaacgttgttagttagactcgtaagactacggccttaaacgtcctagacgaacgcggtatatacgtacaggtacggaagggacggaacgcggacggtaagtccgaagttccgttcgtacggtacgtgtaccggg

SEQ ID NO: 77122 - DNA, 1029 bp, Homo sapiens
  misc_feature: GYAE6OF02I8J5T.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaagacgccaccctctcctgcgacgggccagtcagaattggttcggcgcctacgtactccgtcggtaccaacacgaaaaccgtcggaccgaggcctccccgacggccccctacacttccttagtcgggtacgcctaacgtacccgtaaccggaacggggcccctaaccgtacggggacctaaccgttacccccgtaacgggtccccgtaacggggttttaccaacgggtttcggggaccgtaacgggggtttacgggggttaacggttaccggggggtaacaaacggggttaccctttaaccgtaacccggtttcccgtaaccccgaaccctttaaccgtttccgaaacgtttcccggaacccgggtaaccccggttttaacgggggaacccgtccccggttaacggggaaagggttaaccggtttcggttttaaccgggaccggttttaaacggtttttttaaaccgtttaaccggtttaccggttaaaacccctaaaccgttttaaacgttaccccggggtttaaaccgggttaaaccggggtttcccgggggtaaccccccgggggttttaccccgggggggggttaaccccgtttttaccccggggttttaccccggggttaaacccccgggtttaaacggggggttaaaaccccgtttaaaaccggggtttccggggtaaacggttttaaacccggtaaccccgggtaaaaaaaccgggtttaccgtttacccggggttagggggttacccccttaagggtaccccctaaccgtacggttttaaccctcgggtttttacccgtaacccgttttaccccg

SEQ ID NO: 77123 - DNA, 829 bp, Homo sapiens
  misc_feature: GYAE6OF02GDZ4J.8.34.D01.1.454.CMB.1.raw
tcagctcgcgtgtccacgaccggtgctcgatttagatcgtctgtgttgggtctgggagaggagcccagcactagaagtcggcggtgttccattcggtgatcagcactgaacacagaggactcaccatggagtttgggctgaacttgggttttcctcgttgtcttacttttaagaggtgtccagtgtacaagtgactaactggtcggtagtcggtgggggaggcgtggtccagccgtgggagtcaacgagtacgactctggtgtgcagtcctcgtgggttcctaccgttcaagtaaccacggcacgtgccacgtcgggtcccgactagcctcgaggacgtaagggtgtaggacggtgggtcggtcgtaggtttgttccgtaacgttcgtaggaggggtactaaggttcggttacgtaaacggttgggttacgtcggtcgtaacggtaacccgttccgggtacggggtaaaaccgggccgtttaaaccgttacccgaaacccgttaaacgttcccggtaacccgtaaagggtaaaccggtaaacctaaaaccgttacccggaaaacgggaaaccctaaaccggttaagtttacgttaagggtttacgtaccgtaacgtacgtaaaccgttaaaccggtacccgttaaacgttccgtaacggggtaaacggaacccggtacggtaaccgttaacgttacgttaaccgttaacggtaacgggtaacgggtaaaaccgggggaccgggggtaaaccggacgggttaacggggtaccgttaacccggttaaacggttacccggtttacggtttaccgggtacccggttaccgggg

SEQ ID NO: 77124 - DNA, 718 bp, Homo sapiens
  misc_feature: GYAE6OF02F3GUT.8.34.D01.1.454.CMB.1.raw
  modified_base (318)..(318): a, c, t, g, unknown or other
  misc_feature (318)..(318): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctcagccacctgtcttcgtctccgagggaaacgagccaccctctcctgcgagggccagtcagaactgttcgcgcctacgtatccgtaggtaccaacaagaaacctggaccacggcctcccgacggccccctagactacttagnggtacgctaacgtccaaacgacgggcctacgttcggactacgtccccgacgtccgtaacgggttacacggttacggaccgtagggtaggggtacgttacggggaacacggttacttccgaacttcctaacccacttacgtcctaagttaccgacggaccgttacgggaacgtcccgtaggtaacgggtacttggttacgtacgttaagttttacgtaacgttcgtaaccgaactaacgttccggtaaacgtaggtaccggtcccggtccggggtacctacggtttacccggtaccgtacggaaccgtaaggtcggtaattaaccggtaacgtaaacggttacgttacgggtacgttccgtacgacctaccgttacgtacgttcgttaccttccgttaccg

SEQ ID NO: 77125 - DNA, 915 bp, Homo sapiens
  misc_feature: GYAE6OF02G8P5Q.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgagggaagacgccacctctcctgcgacgggccagtcagtaactgttcgggccgtccttacggtaagtccgtacggtaacccaaacgaaccgaaaacccgttcggacccgaaggccctaccccgaaccgggtcccccctacaacgttccttaacgttggttacgacctaacgtacccgaaccggacggggcccctaacggtcgggacctaacgtccccgacggtaccccgtacgggtttccgaacgggttcggaccggtaagggttcgggggttaacggttacggggaacctaacggttaccgttccgtaaccgttcccgtaaccgtaacccgtacgtttacctaccgttaccggaccgtcccggtttacgggacccgtacccgttaagggtaaacggttagttacgggtttacgtaaccgtttaagggttttttaacttaaccggtttacgttaaccgaaacgtttaccggttaaccggttaacccgggtacgggttacccgggttaccccggggttcccgggggttaacccgtttaccccggggttttacccggggtaccccggggttacggggtaaacccgggttaacggggttcgggtaaccgtaaccggtaaccccggttaaaacggtaccgggttaacgggtaccgggtaccgttaccggaacccgttaccggtactttacccggttacgtttcccttaacccgtacccg

SEQ ID NO: 77126 - DNA, 682 bp, Homo sapiens
  misc_feature: GYAE6OF02FKEBE.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctgtaccaacagaaacctggccaggctcccaggcccctcatctatggtgcatccaacgacgggccactgggcactccccagcccgagttcagtggcaggtgggtagtgggacaagtacttacgaccttctccacctatcactcagcctgggacgcccgtggaggtattggttcgtcgttagttttaattacttcggttaccaactagtaccggtaaccgtaggttcggtacccggttcccggggggtacccttaaccgggtttttcccgggacccggtttacggggaacccgtaaaacgggttcgggtaacgttacgttaaccgtaaaacccggtaacggtttacggggttaccggttaccggttaaccggacccgtaacccgtacgtttacccggttacggtttcccgtttacgttaaccccgg

SEQ ID NO: 77127 - DNA, 1162 bp, Homo sapiens
  misc_feature: GYAE6OF02HYWG4.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttacttttaagaggtgtccagtgtacaagtgcaacgtggtggagtcgtgggggaggcggtggtccgagccgtggggacggtcacgaggagactcctggtgtgcacgtcctcgttcgggttccacccgtttcgaggttaacctacggcaatcggacctaccggttcggggtcccgacccgaaacgtcccgttacccggaagggtaccgaaacgggggttagttcgggggtaaacgggtttgggggttacgggtaccgttagggttttacggtttttaccgaacgtttccggttaacgggtacggggggtaccgttaacgggttttacggttaccgttaaaagggtttacggggttaaacgttcggggtcccgttttaaaccgggggaaccccgggttacccggggttaaacggggggaaccccggggggttaaccccgggttaaccgttttaaccccgaaacccccggtttaaccgtttaccccgttaaaccccggtaaacgggtaaaacccgggttaaaaaccccgtaaaacccggtttaacccccggaaaaaccgggggttaaaaaacccctaaaaaccccggttttaaaaacggtttaaccggggttttttaaaaacccggttttttaaaccccggggggaaacccccgttttaaaaccggggtaaaaccccggttaaaacccggggttaaaccccgttttaaaacccggggtttaccccggtaaacgggggttaaaaccgggggtaaaccccgggttaaaccgggggtttacgttaaaacccgtttaaacccgttaaaccgggtttaacggggtaaaccggggggtaaaaccggggggggtaaaccggggggtaaacccgggtaaccgggggtaaacccgggggtttaacccggtttaaccccggttaaaacggggttttaccccgtttaacccgggtttttaacccggggtaaccccgggttttcccggggtaacccgggggtttaacccccgggg

SEQ ID NO: 77128 - DNA, 804 bp, Homo sapiens
  misc_feature: GYAE6OF02GY1X5.8.34.D01.1.454.CMB.1.raw
  modified_base (237)..(237): a, c, t, g, unknown or other
  misc_feature (237)..(237): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccagtggagtttgggctgaactgggttttcctcgttgcttctttaagaggtgtccagtgtcaagtgcaatggttggagtcgtgggggagcgtagtccagccgtgggaggtcanagagacctctcctgtcgcacgcctcgttgggttcctaccttgagtacgcgtacggcagtcgacctcggtacgggtacccgaccaaaccgtccgaggaccgtaagggtacgttgggacgggtgggggttacgacgttaggttttcggttacgtcgttcggtaggtacgggtacttaggttacggttacgtaaaggttcgggtttatacggtaccgttcggaaccgggtccggttacgggaaacgggtcccgtacgttcccgaaccttaccgttaccgtaccgtaacgacgtaacctaaccgtaacccggaacgtaaaccgtaaacgtaaacttaggttacgtttaccggaaacttacgaaccgtacgttaacccgtaacgtaccgttaacgggacggttaccggtaacgggttccttaaacgttaccgttaacggtacgggtaaccgggaagggggtaaccgggggttaaaccgaccggggttaccgggtaacggttaacccggttaacggtttacccgtttaaccggtttccggtaaccggttaccgggtaccggggttaacccggg

SEQ ID NO: 77129 - DNA, 836 bp, Homo sapiens
  misc_feature: GYAE6OF02GGXTG.8.34.D01.1.454.CMB.1.raw
  modified_base (182)..(182): a, c, t, g, unknown or other
  misc_feature (182)..(182): n is a, c, g, or t
  modified_base (213)..(213): a, c, t, g, unknown or other
  misc_feature (213)..(213): n is a, c, g, or t
tcagctcgcgtgtccacgaccggtgctcgatttagatcgtctgtgttgggtttgggggaggaactgctcagttaggacccagagggaaccatggaagccccagctcagcttctcttcctctgctactctggcctaccagtttcagataccgacggagagattgtgttgacacaatcctacanccaccctgtccttcgtctccgaagggtaaancgcccaccctctcctgaccgtacgggcctagtcgacgtaatggttacggtccgtaccgttaaccgttacgtccctacggggttaaacccaacgtaaaccgtaaaaccgttcggaacccgtaacggtcccgttaccccgaccggtcccccgtaccgtaacttaccgttaggtcggttcaccgtaactaccccgaaacggacccgggtaccaccggttacggacccctaacgtaccccccgaggtaccccgttacggtttaccgtaacgggtcgggtaccgttagggggttacggggttaagtcggggaaaccttacggttaacccgttcgtaaacccgttccgttacccgaacccgttacctttaaccgggattacccggtacccggtaccggtaccggtaaccggtaccgggttaacggagggtttaacgtttcggttacgttagtttaacgtttacttacggttacgtacgttaacttcgtacggtaccggtggtaccggtcccggtaccgggtccgttacccgttccgggtaccgttacggaaccgttaggagttacctaacggacgtaaccgtgacgttcggtactacgtaccgtactacttcgtaccgttcttctaccg

SEQ ID NO: 77130 - DNA, 764 bp, Homo sapiens
  misc_feature: GYAE6OF02IAC2L.8.34.D01.1.454.CMB.1.raw
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
  modified_base (348)..(348): a, c, t, g, unknown or other
  misc_feature (348)..(348): n is a, c, g, or t
  modified_base (411)..(411): a, c, t, g, unknown or other
  misc_feature (411)..(411): n is a, c, g, or t
tcagctcgcgtgtccacgaccggtgctcgatttagatcgtctgtgttgggtttgggggagaactgctcagttaggacccagagggaaccatggaagccccagctcagcttctcttcctcctgctactctggcctccagtttcagtactaccgacggagagtattggtgttgacacaatctccagcctaccctgtcttcgtctccgagggaancgccaccctntcctcgacgacgggaccctaggtacaaggtaagtggttacggccgtaccttacggttactccgtacggtaaccaaacgaacggtaaaccgtcggaccgtacggcctaccccgacggtcccccttanactaaccgttgtacggtcgtacctactaaccgaacgtccggaccgtacgtaccggacctaacncccgtacggaccgttaggtaccgtaggtaaccgcggtaggttacggggtagtacgggtaactacggtaacttctaaccttccggtaacctaacccgtatttacccgacgttacgtacccggtacgttcggaaccgtcgtagggtacggtctttacggtacgtaacgttatttacggtacttaagtaccttaagtcgtacccgtacggtcggtaccgggcccttacggggttaccctacggtttccggaccgttaaacggcgtttaacgggcgtaccgtttaacgaacgacggtacgttcggaacgttacggacttaccgcgtttaacggccgtttgtaaccgtttcgtacccg

SEQ ID NO: 77131 - DNA, 860 bp, Homo sapiens
  misc_feature: GYAE6OF02HXH16.8.34.D01.1.454.CMB.1.raw
  modified_base (215)..(215): a, c, t, g, unknown or other
  misc_feature (215)..(215): n is a, c, g, or t
  modified_base (217)..(217): a, c, t, g, unknown or other
  misc_feature (217)..(217): n is a, c, g, or t
tcagctcgcgtgtccacgaccggtgctcgatttagatcgtctgtgttgggtttgggggaggaactgctcagttaggacccagagggaaccatggaacgccccagctcagcttctcttcctcctgctactctggcctccagtttcagataccgacggagagattgtgttacgacacaatctccacgcctacctgtcttcgtcaccggaagggaacncnccctaccctctccgtgcgacgggaccagtcaagtaagttcggttcggccgtacccgttagttcgttacccgtagggtaacccaaacgacggtaaacccgtcggacccgtaacgggtccccttacccccgacccggtaccccctaccggtaactttaccgtacgttagggttaccgaacccttacgaaccccgaaacgggtaccggtacccctaccggtcgggtacctaaccgttacccccgacggaacccggttcgggtttaccgtacggggtacggtaccggttaggggtttacggggtaagtacgggaaccttacgtaaccgtttaccaccgttacctaacccgtaactaccgtacctaacgtaccgaccggttaccggtacgggtaccgtaaccggtaggtaacgggttacgttcggttacggttacgttaacgttttacgtttacttaacgtaccgtacgttaaccggtacccggttacggtacggttaccgggtaccggtacccggggtacccttccggttacccgggtaccggtaccggaaccggtaacgtacggtataaccggtaccgtaaacgtaccggtacggtcgtaccgtacggaccctacggtacctccgttacgttacttcccttacccg

SEQ ID NO: 77132 - DNA, 741 bp, Homo sapiens
  misc_feature: GYAE6OF02HAR7B.8.34.D01.1.454.CMB.1.raw
  modified_base (210)..(210): a, c, t, g, unknown or other
  misc_feature (210)..(210): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgagggaaagngccaccctctcctgcgaggccagtcagaatgttggcgtccttgaagctggtaccaacacaaactggaccagctccgacgcccctcatctagtcggtgacactaccaacgacgggccctacgtcggaccacgttccccagtaccgtagggttacaggttcgacgtacgggtcggggttacgtagggactaacggtaccttacaccgttcgtaccaccgtaatacgtacttacgacgtcccgtagggtacctaccgtaggaaacgtacgttcggttacgaccgttaagttttaccgtacttacgtaaccgtaacgtaacgtttacccggtaacggttacgggaccggttccccgggtccccggggtacctttaaccggtttcccgggtacccgtaacggggtacccggttaaacgggttcgggaagtaacccttcccggggaaaaacggttaccggttcgggtaaaccgggttcccgtaacggggtacctacccgtaaggttcccgttttacggtaccgttacgttaaccccg

SEQ ID NO: 77133 - DNA, 910 bp, Homo sapiens
  misc_feature: GYAE6OF02I4507.8.34.D01.1.454.CMB.1.raw
  modified_base (235)..(235): a, c, t, g, unknown or other
  misc_feature (235)..(235): n is a, c, g, or t
tcagctcgcgtgtccacgaccggtgctcgatttagatcgtctgtgttggggttgggggaggactgctcagttaggacccagagggaaccatggaagccccagctcagccttctcttcctcctgctactctggcctccagtttcagactacccgacggaggagtattggtgttacgacaactaatcctccaacgccccaccctggttccttcgtcctaccggaaagggggaaaacnccgtacccctacccgttccttccggcgacgaccggggccctaaggtacgaaagtaagttcggggtcggtaaccctcccttaacggttcctacccggttaacgtaacccgaaacctaaccgaaccggtccgggaaccgtaccgggacccctccccgacccggtccccctacgtacttctacggtcgggtacacctacctaaccggaaaccggtacccggacgtaaccggtcggaccctaccgtacccgaacggtcccggtaacgggtacgtcgggtcggtacgggtacgggttacggttacgggacgggtaaccctacgttacccgtactaccgtaccctaccgtaaacccttagtcctaaccgcggttaccggtaaccgtcggaaccggttacccgtaaggtaaacgtagtttaccgggttacttaccgtttaaggtttaccgttaacttaacgtaaccgttacgtacgttaacccgggtcggttaaccgggttcccgggtacccggggttccggttacccggttccgggtacccggttccgggaacgttaacgggtaaccgggttacggtaccgaaccggttaaccggtaaacgttcggttaccgggtaaccggtccacccggttacctaccggttaccgttcgtacccgtttaccgttaccctttaacccggg

SEQ ID NO: 77134 - DNA, 780 bp, Homo sapiens
  misc_feature: GYAE6OF02JCG0H.8.34.D01.1.454.CMB.1.raw
  modified_base (201)..(201): a, c, t, g, unknown or other
  misc_feature (201)..(201): n is a, c, g, or t
  modified_base (462)..(462): a, c, t, g, unknown or other
  misc_feature (462)..(462): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaacgtggtttcctcgttgcttacttttaagagtgtccagtgtcaagtgctaacgtggtagngtacgtggggagtcgtggtccaggtccgtgggagtcacaggagtacctcgtcgtgtagctagccttagtcggttccaccgttcgaagttaaacgtcggactagtcgccgtacggttccggacccgtaccgaaacggtccgtacccgaagggtaccgtaaggggtacttaggggacggttcggggtacggtacgttaacggtttttcggttactaacgttcggtaggacggtctaaggtttcgtaacgtaaggtcggttaancggtacgtaacggtacccgttcggtaacgggtacgggtcccgtaacgttaaccgacccgttaacgttaccgtaccggaacgtaacgttaacccgtacttaacccgaagtaaccgttaagtacgttaagttcgtaggtaccacggttaccgaataccggtaccgtacgtacgtaggtaaccgggtccgtacggtacgttacttaccgtaacggtaggttaacgggaaacgggtaaccggggacgtaacgggttaccggtaacggttaacccgttaggttaaccccgttaggttaaaccggtcggttaccggtacccggg

SEQ ID NO: 77135 - DNA, 769 bp, Homo sapiens
  misc_feature: GYAE6OF02FL69A.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacgagagactctcggtgtacgcacgccttcgtggggttccacctttcgagtaactacggcatgcactgggtcccgacaagcctccaggcaagggtacttgggagttggggtgactaggtttgtttaccattcgttaggaacgggtcaggttgttaccgaaggttcggttatacgccgtagtaccgttccgggttagggaacgggtacccggtacttaccgtaacccgtactaccgttacccgacgtaaacggttaacccaacgtttacccgaaacgggtaaaccgttaaccgaaactttacggttacgttttacgggtacgtaccggttacggaaaccgtaacggtacccgtttaaacgtacccttagggaacgggaaccgtacgggtacccgttaagtaacccgtttagtaaccggttaacgggaacggggtaaaccgggggggaaccgtaacgggtaccgggggttaacggttacccggtaaacggtttacccggttaccggtttccggttacccggttaccgggttacccgggg

SEQ ID NO: 77136 - DNA, 690 bp, Homo sapiens
  misc_feature: GYAE6OF02GBITN.8.34.D01.1.454.CMB.1.raw
  modified_base (162)..(162): a, c, t, g, unknown or other
  misc_feature (162)..(162): n is a, c, g, or t
  modified_base (179)..(179): a, c, t, g, unknown or other
  misc_feature (179)..(179): n is a, c, g, or t
  modified_base (308)..(308): a, c, t, g, unknown or other
  misc_feature (308)..(308): n is a, c, g, or t
tcagctcgcgtgtccacgaccggtgctcgatttagatcgtctgtgttgggtttgggggaagaggaagactgacggtcctgccacaggtggtgtttccattcggtgatcagcaactgaacacagaggactcaccatggagtttgggctgaactgggttttccncgttgcttcttttaagnggtgtccagtgtcaagtcacaacgtggtggagtcgtggggggagccgtagtccgacgccgtacgggtggtacacagacgacctctcctgtcgcacgtcctcgttggttcctcttcgagtagtctaccgnacgtgccgtacgtcggtacccgaccctaaaccgtccggacggacgtaacgggtagtttacgggtaggtcggggttcggtacctaggttttagtttccgtaagtccgttaggacgggtacgtagttacggttactaaggtggttacgtgtacggtacgaccggtaccggtaggaaacgggtccgtatttccgaacgtaccttcgtaccgagtacgactaacctcgagaactacagttgttagttacgacacgactagtccgtaacgtcgtacgacgaccgtcgtacgttactactacgtaggacggtaagggaacggggtaaccgaggtacggtacgttacgtaacgttcgttccgttacggtccgttgggaccgggtaccgg

SEQ ID NO: 77137 - DNA, 768 bp, Homo sapiens
  misc_feature: GYAE6OF02JW2YL.8.34.D01.1.454.CMB.1.raw
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (411)..(411): a, c, t, g, unknown or other
  misc_feature (411)..(411): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccagtggagtttgggctgaacgttgggttttcctcgttgcttcgttttaagaggtgtccagtgtcaagtgacaacgtggtggagttcggtgggggacggcgtggtacccaggtccgtaggggacgtcacgaggaacgacctcgtcgtgtcgcacgtccctgtcgggttaccaccttacgaagtaacctacggcatacgccgacgtacggggtaccccgccgaacgccgtaccgacggacgaagggtacttggggnggttaggggngtacgtaggttttcgttaacgnttcggtggaacgggtcgtaggttcgttacgtaagttggtacgtaggtaccgacggttaacccggcgggttaacgggaccgggtacctaacgttcccgtaacccgtaagttcccgacggaaggtaaccgtaacgttaaaccttacggaaaccggaacgaactttaaggttaacgtttacggttacggacgtacggtaacgtaaccgagttacccgtaacggtcgtaacggtaacgacggtaaccggtacttaacgtacgtacgacggttaacgggacggggtaaaccgggtagacggttacccggtagtaaccgtacgttaaccgttacgttaccggtacccggttcggtaaccgggg

SEQ ID NO: 77138 - DNA, 705 bp, Homo sapiens
  misc_feature: GYAE6OF02F1D8H.8.34.D01.1.454.CMB.1.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagccacctctcctgcaggccagtcagaatgttggcncctacgtatcctggtaccanagaacctgccaggctcccaggcccctnatctatggtcgcatccgaacgacggggccacgtggaccacgtccccagccctaggttccaaggtcggacgtaggtcgggtagtcggggaacaggtacttacgaactcgtaccaacactacacgtccacgccgtaggacgtccgtaggaggtagttggttacgccgttaaggtttacttacgttacgttacctaaacgtactttaccgggttaacccggtagggttaccgggtacccgggtaccccggggggttaccttacccgggttttcccgggttaccccgtacggggttaaacccgtaaaggggttacggtacgttaacgtaaccgtaaaaccggtaaccgttacgggtaccggttaccgtccggacctaaccggtccgttaccgttacggtttaccttcgttaacccg

SEQ ID NO: 77139 - DNA, 966 bp, Homo sapiens
  misc_feature: GYAE6OF02GQOD0.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctgttgcttacttttaagaggtgtccagtgtacaagtgacaacgtggtggagttcgtgggggagcggtggtcccaggccgtgggacgtcacgagacgacttcgtcggtgtcgacgacgtccttcgtagggtttaccaccttcgaagttaaccgtcggctagtcgaccgtacggttcgggacccacgtaacgtccgtcccggaaggtaccgtaaaggggtactttcgggggaacggtttcgggggtacgtaccgttagggtttttcggtttaaccgtaacgtttccggttacggggaaccggggtacctttaagggtttacggtttaaccggtaaaaggttccggggttaattaccggacccggttaaaccggttaacccggtttacccggggtaaacggggtaaacccgggttccgttaaccgtttaccccggaacccgtttacttacccggttaacccgaagggttaaaacccgtaacccggttaaaaccgtttacccgggaaaaaccggttaaacccgaaacggtttaaacggtttacggttaaacgggttttaccgggaaaccgtttacggttaaaccgggaaacccgttaaccggttacccggttaaaccggttaccggtaacggttaaacggggaacccggtaaacgggtaccctttaacgttacccggttacggttaacggggaaaccgggtaaaccgggggtaaccggggtaaacccgtacggggtaaccggggttaaccgtttaacccggtaacgggttttcccgtaccgggtttaccggtaccgggttccgggtaacccgggg

SEQ ID NO: 77140 - DNA, 656 bp, Homo sapiens
  misc_feature: GYAE6OF02HU6NZ.8.34.D01.1.454.CMB.1.raw
  modified_base (211)..(211): a, c, t, g, unknown or other
  misc_feature (211)..(211): n is a, c, g, or t
  modified_base (309)..(309): a, c, t, g, unknown or other
  misc_feature (309)..(309): n is a, c, g, or t
  modified_base (357)..(357): a, c, t, g, unknown or other
  misc_feature (357)..(357): n is a, c, g, or t
  modified_base (446)..(446): a, c, t, g, unknown or other
  misc_feature (446)..(446): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccgggagagattgtgttgacacaatctccagccaccctgtcttcgtctccgaaggggaancgccacccgtctcctgcagggccagtcagaatggttgcgcctagtactcgtggtaaccaactagaaacctcggaccacggcctacccgacggcccctnatctagtcggtcgcactaccgaacgcggaccacgtggctactcccganccgtaggttccaggttcggacgtaggtgggtagtagggactagtaccttcacttccacacctataccagtacacgtccgtacgggtacncccgtaggagtacgtcgtttacgtcgttaagtttactttacgtacgttaacaaacgttcgttaccggtacggtacggttcgggtacccggtcccgggtacgttacccggtttcgggacccggtagggaaaccctaggtcggtacttacgtaacggaacggttacgtcggtcgaccgtgtaccctacgtgtttcgtacgttctacgtcccg

SEQ ID NO: 77141 - DNA, 822 bp, Homo sapiens
  misc_feature: GYAE6OF02FJGMX.8.34.D01.1.454.CMB.1.raw
  modified_base (240)..(240): a, c, t, g, unknown or other
  misc_feature (240)..(240): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
  modified_base (630)..(630): a, c, t, g, unknown or other
  misc_feature (630)..(630): n is a, c, g, or t
tcagctcgcgtgtccacgaccggtgctcgatttagatcgtctgtgttgggtttgggggaggaactgctcagttaggacccagagggaaccatggaacgccccagctcagcttctcttcctcctgctactctggcctcccagtttccagatacccgaccggagagtacttggttgttgaccaactaacgtcctccaacgccctaccccgtgtacctttccgtcctccgaagggggaaaacnccgcccaaccccgtcttacctggcctagggccctagtccaagactggttcgaccgtcctaaccgtnttccgnggtaaccaaacgaccggtaaaccctgggcccaagggccctaccccgaggtacccccttcactacccttaaggtcgtcgtaccaacgtaccaaacggtaccggccctaactgggaaccctacgttaccccgcggtacccctaaaggtttccgtaaacggggttccggactaaccgggttcggggtaacgttaccggggaaccttaaccggttaccgttaacctccggttaaccctcccgaaaccaacctttcgaccgtaccacgcccgttacgaccggtccgtagtcggtaactggttaccgacgtcgtttttaaaccncgttaacgaaccgtacaagttcccggtagtacggtccgtccggtaaccgggtcccgttacgttacccggacccgttacgggaccttaaaccggtcgtagtaacctaaccgggtaaagacccgtttaccgggacgttaaccgacggttacccacccggttaaacctcggttactaccggttaccttaccccgg

SEQ ID NO: 77142 - DNA, 574 bp, Homo sapiens
  misc_feature: GYAE6OF02FITEL.8.34.D01.1.454.CMB.1.raw
  modified_base (248)..(248): a, c, t, g, unknown or other
  misc_feature (248)..(248): n is a, c, g, or t
tcagctcgcgtgtccacgaccggtgctcgatttagatcgtctgtgttgggtttgggggaggaactgctcagttaggacccagagggaaccatggaagcccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcncctacgtatcctggtacccaacagaaacctggccaggctccccaggccccctcactcatggtgcatccaacagggccactggccactccccagcccaggttcagtcggcaggtgggtatgggacagactcactctcaccatacactcagccgtggacgtccgtgagagtggttgcttagtttattacgtgtaccaactagtccgtaacgagtacggccgtccgggggcctacgtttccggcccgtcggaacccgtaaggtcggtatacgtacgaaacgtacgtacggtaggctacgacgtacctacgttcgtacgttcttctaccg

SEQ ID NO: 77143 - DNA, 805 bp, Homo sapiens
  misc_feature: GYAE6OF02H8MIJ.8.34.D01.1.454.CMB.1.raw
  modified_base (153)..(153): a, c, t, g, unknown or other
  misc_feature (153)..(153): n is a, c, g, or t
  modified_base (171)..(171): a, c, t, g, unknown or other
  misc_feature (171)..(171): n is a, c, g, or t
tcagctcgcgtgtccacgaccggtgctcgatttagatcgtctgtgttgggtctgggagaggagcccagcactagaagtcggcgtgtttccattcggtgatcagcactgaacacagaggactcaccatggagtttggctgaacttgggtttccncgttgcttcgttttaagnggtgtccagtgtcaagtgacaagtggtggagtcgtgggggagcggtggtccagccgtgggagtcacagacgactctgtgtgccagtcctcgtcggttacctacctttacgacgttaaacgttcggacctagtcggccacggttccgggtacccgaccccgtaaggtcccttacccggaagggacggtaaaggggtgttcgggggaggtttgggggttacggaccgtttaggttttacggtttaccagttccggtgggaacgggtacctaggtttgttaccgaagttgggtatacgggactaacgtacccggttaccggtaacggggtaaccggtccgttaacgtaccgaaccccttacgtccctaaccgaaggtaaccgtaaccgtaaaccgttaaccgaaacggtaaacctaacgttaagttaggttagtttaaggacgttaccgtaacggaaccgtaaccggtaccgttaaacggttcccgtagggtaaccggtaccggtaacgggtaaccgttaacgtaccgttaaccgggtaggaaaccgggtaaggggaaccggggtaacgacgggtaaccggtacggttacgtaacggttccgttaccggttacggttaccccggaggttacccgggg

SEQ ID NO: 77144 - DNA, 830 bp, Homo sapiens
  misc_feature: GYAE6OF02G3ODX.8.34.D01.1.454.CMB.1.raw
  modified_base (256)..(256): a, c, t, g, unknown or other
  misc_feature (256)..(256): n is a, c, g, or t
  modified_base (322)..(322): a, c, t, g, unknown or other
  misc_feature (322)..(322): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaaccagtggagtttgggctagaacgttgggttttcctcgttgctttacgtttaaggaggttgtccagtgtacagtgaccaagtggtgagtcggtgggggagtcggtaggtccaggccgttggggaggtaccanaggacgtacttcgttagtgtgcacgtccgttcgttggttccctacttacgaaggtaactacccggntacgtcgtccgtacggtccgggtccccgaacaggtcctaccggaacggactaaacgggggttatttgggggaacggtttcggggtacggtcttaacggggttttcgtttaacgtaacgttccggtaagggtacgggtcccgtttaggttacgtttaaccgggaaagttggttacgtacggtaaccgtacgttaacccggttacccggggttagtaaacccgggggtcctacgtttaacccgacccgttaacgtaccggtacgtaaacggtacgtaaaccgtaacgttacccggaaacgaacgtaacgttaacgttacggttagttaacgggaagtaccgtaacgaaaccgtacgtccgtaaaccgttcgtacggaacggtaccgacggtaacgttacttaaccgtacgttaacgggtaacggtaaacggggtaacgggaccgtaacgggtaccggttaagtacccggtaagttacccgttcgttacgggtacggtacccgggtacggg

SEQ ID NO: 77145 - DNA, 889 bp, Homo sapiens
  misc_feature: GYAE6OF02GNDNO.8.34.D01.1.454.CMB.1.raw
  modified_base (315)..(315): a, c, t, g, unknown or other
  misc_feature (315)..(315): n is a, c, g, or t
tcagctcgcgtgtccacgaccggtgctcgatttagatcgtctgtgttgggtttggggggaagaggaagactgacggtcctgccacaggtggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacgagagactctcggtgtgcagccttcgtgggttccaccttcaagtaactacggcatgcacgttcgggtacccncctaaggcctaccgagggacaaacggggtattggggacggttggggtacggcttaggttttcgtttacagttccgtagggacgggtctaggttcgttaactaaggttgggtatggactaaggtccgtaccggtagggaaaccgggtcccgtacttaccgacctacgttccgtaccgaaggtactaaaccgtaacgtttacccgaaacggtaacccaaacggttaaactttacgggtttaaacgtttacggggtaaacgttaccggttaacggtaaaacccgttaacgggtaacccgttttaaaccggtttaacccgggtacggggtaaaaccggggttaaaccccggtaaccggggggttaaaccgtttaaccgttaaaccggttaacccgggtttacggggtaaaaaaccgggggtaaaccgggggggtaaaaccggggggggaaaaccccggtaaacgggggttacccgggggtttaaaccggtttaacccgggtaaaaccgggtttaacccggttttaacccccgggttttaacgggttaacccgggttcccggggttaaccccggggggg

SEQ ID NO: 77146 - DNA, 763 bp, Homo sapiens
  misc_feature: GYAE6OF02GZBNU.8.34.D01.1.454.CMB.1.raw
  modified_base (214)..(214): a, c, t, g, unknown or other
  misc_feature (214)..(214): n is a, c, g, or t
  modified_base (270)..(270): a, c, t, g, unknown or other
  misc_feature (270)..(270): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagactaccaccggagagattggtgttgactacaatctccagccacctgtcttcgtctccgagggaaagacnccacccgtctcctgcgaggccagtcagatggtggcgctacgtctcgtcgtaccaanaacgaaccgtggaccacggcctacccgacggtcccctacactacgttagttacggtgacacgtaccgaaccggacgggcccacgtcggaccacttaccccgccggtaccgttacggttaccgaggtcggccgtaaggggttggggtaacgtaggacccgtacggtaccttaccgtacgtacctaccaactctaacgtacctccgactccggttagacccgtcgtagtacggtcttaggtacgtacttagtttactttaacctcggttaacctaacgtaccgttaaaccggtccggaacgggtttcccgggtccccgggtttaacccgggacccgtttaaccggtttccccggggaaccgttacccgggaaacgttaaggggtaccggtagttactaaccgtaaaaccgggtacggttttaccggaacgggttaccctaaggaccccgttacgttaaacgttccccggtagttttcccgaccgtttaaccccgg

SEQ ID NO: 77147 - DNA, 699 bp, Homo sapiens
  misc_feature: GYAE6OF02FN2ZT.8.34.D01.1.454.CMB.1.raw
  modified_base (249)..(249): a, c, t, g, unknown or other
  misc_feature (249)..(249): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattggtgttgacacaatctcagccacctgtcttcgtctccgaagggaagcgccacccgtctcctgcgagggccagtcagaatgttcggcnccgtacgtatccgtagtaaccaacgacgtaaaccgtggaccaggtcctaccccgacggtcccctcgacttcgtagtggtcgactactacccgaacgacgggtccacgtggacacgtcccagacccgtaggttcgaggtcggacgtagggttacgggtacgtacgggactaacggttacttccgtaaccgttccgtacaaccgtactcctaactacgaacggtcccgtaggacgtcccggtaggaggtagttcggttacgtacgttagttttactacgttacggtacaacgtacgttaccggtaccgtacgggttcggacccggttacccggggtcctaccggtttccgggacccgttacggaaccgtagggtacggtacgtaacgtaccggaaactcggtaggtcggtacgtacggaccacgttacctcgttacgtccgtacgttacccg

SEQ ID NO: 77148 - DNA, 898 bp, Homo sapiens
  misc_feature: GYAE6OF02HS0L6.8.34.D01.1.454.CMB.1.raw
  modified_base (859)..(859): a, c, t, g, unknown or other
  misc_feature (859)..(859): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccctagtttcagatacccgaccggagagattgtgttgacacaatctccacgccacctgtcttcgtctaccgaggggaaagacgccacccgtcctcctgacgacgggccctacgtcaagtaagttcgggttcgggaccgtcccgtaacggttacgtcccgttacgggtaacccaaaccgtaacggaaaacccgtcgggtaccccgaacgggtaccccttaccccggaaccggggtccccccttaactacgttacccgtaggttcgggtccgtaccgttaaccgtaaccccgaacgggaccgggtaccccgtaacggtccggggaaccctacccgtaccccgtaaccgggtcccgttaacggggttaccgtaacggggttacggtaccccgggtaggggttaacggggtttaacgggacgggggttaaaccaacggttaccgtttacccttaaccgtcccgttacccgtaaaccctacgtaccgtaacgtttacccggaaccggttcccggttaacgggaccgtacccgggttaaggtaaccggttacgttggggtttaccctaagggtttacgttttaaacgttacccggttagttacccgaaaagttccggtacccggttacgggtacggttacccgggtccgggtacccggggtacgttacccggtttccgggccgtaaaccgggaaccgtagggtctaacgttcaacgtaaacgtggtacggngtacgcgacctactccgttggttacctcgttctaacccg

SEQ ID NO: 77149 - DNA, 727 bp, Homo sapiens
  misc_feature: GYAE6OF02JSUQE.8.34.D01.1.454.CMB.1.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (291)..(291): a, c, t, g, unknown or other
  misc_feature (291)..(291): n is a, c, g, or t
  modified_base (421)..(421): a, c, t, g, unknown or other
  misc_feature (421)..(421): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagatacccaccggagagattgtgttgacacaatctccagccaccctgtcttcgtctccgagggaaancgccaccctctcctgcagggccagtcagatgtgcnctacgtatctgtacacgagaacctgccaggctccgacggcccctanctctacgtggtcgctacgtcccgaaacgtacggggcccctaacgtcgggacctacgtccccgaacggtcccgtaacggttcaacggttggacctagggtcgggtaagtcgggactaacggtcgttaaccncgttactacaccgttactcgagtacaacgtccggtacgacggtcccgtagaagtacgttcggttacgtaccgttaagttttacgttaaccgttacgtaccgtaacgtaccgtttaacggttaaccggtagtccggtaacccgggtcccggggtacccgtacccggttttcccggtaaccggtaccgggtaaccgtaacgggtcgggtacgtaaccggtaaccggtaaaccggtaacggttcgggtaaccggttcgtaaccgtacccgttaaccgtcggttacgtcccgtttacgtcccgttaaccg

SEQ ID NO: 77150 - DNA, 820 bp, Homo sapiens
  misc_feature: GYAE6OF02FXCTX.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaactgggttttcctcgttgcttcttttaagaggtgtccagtgtcaagtgcaacgtggtggagtcgtgggggagcggtggtccagccgtgggacgtcacagacgactctcgtgtgcacggtccttcggtggttccaccttcgaagtaaacctcggctatcgactcgtcgggtccaccgaagtcctacgaggaccgaaggggtcttagggagggttcggggtcggtctaggttttcgttacacgttcgtaagggacggaccgttaggttacgttacctaaagttcgggtaaacttacgaaggtacccgttccggggttaaacgggaaccgggtaccggttaactttcccgaaacctacgttaccccgttacgaaacggtaacgtaaaaccgttaacgttaacccgaaacgggtaaacctaacggttaaacgttacgtttaaaggttcgggtaaaccgtcgtaaccgggaactacccgttaaacggttaaccgttacgtagggaacccgtaacggttaccggggaccgttaaactccggttaacttacggggtaaaaccgggaacggggggtaacgggggaaacccggtacggggtaaccggggtttaacgtttaaaccggaaccggtttaccggtttaccggtttacggaccggggtttaccgggtcgggtaaaccccgggg

SEQ ID NO: 77151 - DNA, 681 bp, Homo sapiens
  misc_feature: GYAE6OF02HPW60.8.34.D01.1.454.CMB.1.raw
  modified_base (207)..(207): a, c, t, g, unknown or other
  misc_feature (207)..(207): n is a, c, g, or t
  modified_base (292)..(292): a, c, t, g, unknown or other
  misc_feature (292)..(292): n is a, c, g, or t
tcagctcgcgtgtccacgaccggtgctcgatttagatcgtctgtgttggggtttgggggaggaactgctcagttaggacccagagggaaccatggaagccccagctcagcttctcttcctcctgctactctggctcccagtttcagataccacggagagattgtgttgacacaatctcagccacctgtctcgtctccgagggaaagngccacctctcgtgcagggccagtcagagtgtgcgcctagtctccgtgtaccaacagaaccgtgccaggcctaccaggtcccctanactctagtggtcgctacgtaccgaacgacgggcctacgtcgggacctacgtacccgacgtccgtaggttcaggttggccaggttgggtagtgggtaactaggtacttacgactcctacacctatcaacgtcgaaccgtccgtagggacgccctagggagtattcggttagtcttaaggtttacttacgtacgttacaactacttaccggtacggacggtaccgtcccgggtaccggggtccgttaaccggttttcccggaccggttaacgggaacccgtaagggttcgtaacttaggttaacccgtaaacgttaccggtacggtacggtacccgtacggacccgtaacccgtagtttaccccgttacggtttaccgtacccttacccgg

SEQ ID NO: 77152 - DNA, 695 bp, Homo sapiens
  misc_feature: GYAE6OF02F9Q9K.8.34.D01.1.454.CMB.1.raw
  modified_base (174)..(174): a, c, t, g, unknown or other
  misc_feature (174)..(174): n is a, c, g, or t
  modified_base (232)..(232): a, c, t, g, unknown or other
  misc_feature (232)..(232): n is a, c, g, or t
  modified_base (262)..(262): a, c, t, g, unknown or other
  misc_feature (262)..(262): n is a, c, g, or t
  modified_base (284)..(284): a, c, t, g, unknown or other
  misc_feature (284)..(284): n is a, c, g, or t
  modified_base (636)..(636): a, c, t, g, unknown or other
  misc_feature (636)..(636): n is a, c, g, or t
  modified_base (648)..(648): a, c, t, g, unknown or other
  misc_feature (648)..(648): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcacagtggagtttgggctgacgttcgggttttcctcgttgcttcgtttaagnggtgtccagtgtacaagtgacaacgtggtggagtcgtggggagcgtgtcagccgtggngtcacgagacactctacgtgtacgacgacnccttagtggttacctaccttanaacgtaacgtcgactagtcgactaccgtcgggtacccacgtaacgtccaccgtaggcggaaacgggtgttaggcgggttgggtacgcgtttaggtttcgttacgacgttcggttcggtaaggtaccttagttaaccggttagtaaggttcggttaactcgtaaagacccggttaacggtccccggaagggtccggtaaccgttactacccgtacgtacctacgtaccgaaggtactaacgtaccgtaccgtaaacggtacttaacgaaagttgtaaccgttaggaactcgtaacgactacggttacgtaagtcgtaagacgtagaccggttatacgtactcgaggtaacggnggggacggtacncgggacgtacgtacgtacgttccctaggtaccgtaggtccggtacgg

SEQ ID NO: 77153 - DNA, 777 bp, Homo sapiens
  misc_feature: GYAE6OF02F71S9.8.34.D01.1.454.CMB.1.raw
  modified_base (171)..(171): a, c, t, g, unknown or other
  misc_feature (171)..(171): n is a, c, g, or t
  modified_base (394)..(394): a, c, t, g, unknown or other
  misc_feature (394)..(394): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaatggtggagtcgtgggggaggcgtggtccagccgtgggaggtcacagagacttctcggtgtcgcagcctcgttgggtcctacctttcgagttaaacctcggcagtcgctacgttcgggccgaccaagccgtaccgaggcgaaaggggtattggggaggtggggtcgacgtggtttgtttacagttcgtggagggtcagggttnttacgaattgggtatgactacggtaccgttccggtaagggaaccgggcccgtaactttcccgaacctactaccgtacccgtaaggaacgaaaccgttaaacggttacccgggaaacctaaccgttaagtttacggtttaacgttttacgggaacgttaccgttacggaaaccgtaacgtaacccggttaaacgtacccgttaggaaccgggtaaccggtaacggggtaaccgtttaacttaacggttaaccgtagggtaaacccgggaagggggtaaaccggggggaaaccggtacgggtaccggggttaacggttaaccggtaaccggtttacgtttacccggtttacggtaacccgggtttaccgggtacgggtacccggg

SEQ ID NO: 77154 - DNA, 787 bp, Homo sapiens
  misc_feature: GYAE6OF02HMBMB.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagccgtggggagtcacgagagacttctcgtgtgcagtccctcgtgggttccaccttcgaacgttaacctacggccatcgactacgtcgggtcccgaccaaaggcctcccgaagggaccgaaaggggtactttgggaggttggggtcggactaggttttgtttcagtcgtaggagggactaggttgttacgaagttggtatgaccgtaaggtacccgttccggtagggaaccggggtccgtacgttaccgtaccctaacgttaccccgtaccgaaggtacgtaaaccgtaaccgtttacccgaaacgggtaaacctaaacgtaacgttaacggtttaaggtttacggtacgtacgttacggtaaaccgtaaccggtaccgtaaacggttaccgtaacggaacgggtacggtaaccgggtacgttaacgttaccgttaacggttacggttaaacggggaaacggggtaaccggggggaacccgaagggtaccgggttaaccgttacccggttaaccggtttacccgtttaccggttttacggtaccggttaccgggttaacccggggg

SEQ ID NO: 77155 - DNA, 885 bp, Homo sapiens
  misc_feature: GYAE6OF02HHEX1.8.34.D01.1.454.CMB.1.raw
  modified_base (213)..(213): a, c, t, g, unknown or other
  misc_feature (213)..(213): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagtatacccaccggagagattgtgttgacacaatctccagccacctgtccttcgtctaccgagggaacncgccacctctctgcgcggcagtacagtaagtcggtggacctcgtacgtactccgtacgtacccaacgaacgaaaccgtgacccgacggaccctaccccgtaccgggtccccctactaccttcgttacgtcggcggacctaaccgtaccgaaccggtaccggacccgaaccggtggaccctaaccgtaccccggaccgtacccggtacgggttaccgtagggtacggtaccggtacggggttacggggtaggtaaccgggtaccgtacggtacctttacgtacccgttacccttaaccgacgttaacctcgtaccggtaccgtaaccggttccggtaacggtaccgtacccggttagggacggttaacgggttacggttacgttaccggttttaaacggtttaacttttaccgggtacctttaaaccggtaacccgttacgggttaaacccggttcccgggtaaaccggggtttccccggggtaacccggggtttaccccgggggttacccgtttttacccccggttccggggttaaccccgggttaaacccgggtaaacccggtaaggttaccggtacgttaaccgtaaccggtaaacgttaacgttcgggtccgaccgtttacggaccctaaccggttccgtcgtttacccggttacttacccgttacccg

SEQ ID NO: 77156 - DNA, 731 bp, Homo sapiens
  misc_feature: GYAE6OF02GMTZQ.8.34.D01.1.454.CMB.1.raw
  modified_base (156)..(156): a, c, t, g, unknown or other
  misc_feature (156)..(156): n is a, c, g, or t
  modified_base (173)..(173): a, c, t, g, unknown or other
  misc_feature (173)..(173): n is a, c, g, or t
  modified_base (177)..(177): a, c, t, g, unknown or other
  misc_feature (177)..(177): n is a, c, g, or t
  modified_base (247)..(247): a, c, t, g, unknown or other
  misc_feature (247)..(247): n is a, c, g, or t
  modified_base (275)..(275): a, c, t, g, unknown or other
  misc_feature (275)..(275): n is a, c, g, or t
  modified_base (325)..(325): a, c, t, g, unknown or other
  misc_feature (325)..(325): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacctgggttttccncgttgctcttttaaagnggtntccagtgtcaagtgcaactgggtcgagtcgtgggggagcgtggtccaggcctgggaggtcacagagactntcgtgtgcaggccttctggttccacttnagtaactcggcatgcactggggtcccacgaagcctaccaggccaaagggnttggagtgggtgctagtttgttacatctggaggcgagttcgtacaagttcgggtatcgacaggtacctccgggtaagaacgggtccgatttaccgacctacgtactacccgaagaacgtaaccaagttacccgaaacgggttaaacaaccgtaaattacgttaagtttacggaacgtacttaacggaaactaccggttacccgttaaacgttcccgtagggtaacgaccgtaacggggtaaccgttaacgttaacgttaacccgtagggttaaaacccggaaggggggtaaaccggggggtaaacccgaaggggtacccgggggttaaacgttaccccggtaaaacggtttaacccgtttaccccggttttagggaaccccgggtttccgggttaaacccgggggg

SEQ ID NO: 77157 - DNA, 710 bp, Homo sapiens
  misc_feature: GYAE6OF02JK8UD.8.34.D01.1.454.CMB.1.raw
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagttggctgaactggtttcctcgtgctctttaagagtgtccagtgtcagtgacactggcgagtcgtggggagcgtcggtcagtccgnggacgtcacagagtactcgtcgttggngcagtccgtagttcggggttccaaccgttcgtaacgtaacgtcggtacattggtacgtcgggtcccacgtacgccgtccgaggaccgtaaggctacggtaggtggtcgtcgtacggttttccaagtctacgggcggtacgtacgtttacgtactaaggttggtactcggaacgtaaccggtaccgttacggtacggggaaaccggtcccgttaagtaccgtaccgtacttcccgtacgaaggtaacgtaactaagtaccgaacgtaagaaccgttaagttagttagttcggactacgtacgaacgtagtccgaacgtcgtacgacggtacggaccggtaccgtaacgtaacgtaccgtagggaaccggtacgggtaacccgggggtaacgaccgggtacgggtaaccgtaccggtaacggttacccgttaccgttcggtaacggtaccggtaccgggtaacccggg

SEQ ID NO: 77158 - DNA, 777 bp, Homo sapiens
  misc_feature: GYAE6OF02H0NTH.8.34.D01.1.454.CMB.1.raw
  modified_base (349)..(349): a, c, t, g, unknown or other
  misc_feature (349)..(349): n is a, c, g, or t
  modified_base (395)..(395): a, c, t, g, unknown or other
  misc_feature (395)..(395): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctccctagtttcagataccaccggagagattgtgttgactacaatctaccacgccacctgtcttcgtctccgagggaagacgccacctctccgtgacgacgggcagtacagtattggttcggcctaccgttacgtctccgtaacggtaaccaactacgaaaccgtcggaccgacggcctaccccgaccgccccgtactattacgttagtcggtacnccaaccgtaccaacggtaccggaccgtcggtcgacctaccgtaccnggtaccgtacggttcacggtcggacgtaggttacgggagtacggacgtacgtaccttacgtaccttaccgtacaacccgtacttacaccgtcgtccgtccgtaggacccgtcgtaacggtacgggtcgttagtacgttccggttaaagtttactttacggttctaaccctaacgttccgtaccggtacgggtacggttcccggtacccgggtaacccggtttccggtacccggtttccccggggacgtaacggttaaacccgtagggttacggttaaccgttaaccggaacggttaaaccgtaccgggtttacgtaacggacccgtttaacggccccttaaagccccgttttacgtaccgtttaccgttaccgttaccccgg

SEQ ID NO: 77159 - DNA, 687 bp, Homo sapiens
  misc_feature: GYAE6OF02IGCBY.8.34.D01.1.454.CMB.1.raw
  modified_base (171)..(171): a, c, t, g, unknown or other
  misc_feature (171)..(171): n is a, c, g, or t
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactgggtggagtcgtgggggagcgtggtccagcctggggagtcacagagactctcgtgtgcagcctctggttcaccttnagtaacacggcatgcncgtcgggtaccnccaagcctaccgagggaccaaggggtattgggacgtggggtcgctaggtttgttacagtcgtggaggggctaggttgtacaaagttgggacttggctgaacggtcggtaggaacgggcccgtatttccgaactacgtctaccaggaacgacctaaaccgtccgaaacggtaaacaacgtaaataggtttaacgtttacgaacctagaaccgtaacgtaacccgttaagtcccgttaggacgtaacggtaacgggtacgtaacttaacgtaagtaccggtaacgggaacggggtaacgggggaaaccgagggtaaccgggtacggtttaaccggtaacggtttaacccgtttaccggttaggtaaccgggtcggttacggggtacccggg

SEQ ID NO: 77160 - DNA, 747 bp, Homo sapiens
  misc_feature: GYAE6OF02FTVW2.8.34.D01.1.454.CMB.1.raw
  modified_base (209)..(209): a, c, t, g, unknown or other
  misc_feature (209)..(209): n is a, c, g, or t
  modified_base (224)..(224): a, c, t, g, unknown or other
  misc_feature (224)..(224): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaaancgccacccttctccngccagggccaggtcagaatggttcggcgtcctacgtatcctaggtaccaacacgaaaccgtcggccacgggcctcccgacggccccctacacgttactagtgggtcgccactacccaacgcggggaccctacgtcggaccaccgtccccgacgtaccgtacggttacggacggtcggtaccgtaggggttacggggttacgtcggggtaaacacggttaccgttacctaaccgttaccttccaaccgtactaccgtaacgtccaacggttcccgtaggtaccgtcccggtaggtaggtacgttacggtttcgacgtttaacgttttaacttacgttacgtaactaaccgtagtacccgggttaagaccgggtccggttaccccgggtcccggggtacccgttaccgtttcccgggcccggtacgggtaaccgtacggggtaggaccgtaacgtaccgtaaaacggtaccggtggtaccggtactcgaaccgtccttacgggtctacggttcctacgttacccg

SEQ ID NO: 77161 - DNA, 922 bp, Homo sapiens
  misc_feature: GYAE6OF02F2S0T.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaagcgcccaccctctcctgcgacgggccagtcagtaatggttcgggctaccgttacgtactccgtaggtaacccaacaacggtaaacctcgggacccaacgggtcctacccccgaacgggccccccttacgacttaccgtagttcgggtcgaccacttacccgaaaccggacggggtacccctacggtacgggacctaacctaccccgacgggacccttaagggttccgaaggtcgggaccgtaggggtttaggggtacgtacgggggaactaggtaccttaccgaccgtttacctacccaacccgttatacccgattaccgaaccggtcccgttacggggacgttcccggtaagggtacgggttaaccgtttgggttacggttacttaaacgggttttttaactaccgtttaacgtaacccgttaaacgttaacccggtttaccggttaacccggggttacgggttaccccggggttacccgggggtacccccgggggtttaacccgtttacccgggtttttacccccgggggcccgttaaacccgggggtaaacccgttaaagggggtttaccgtaccggttaaaccgttaacccggtaaaaaccggggttaccgtaccgggggtttaaccggaccggttaacccgtaacccggtacccttttaacgggttacccggttttacccgttaacccggttacgttttaacccccggg

SEQ ID NO: 77162 - DNA, 679 bp, Homo sapiens
  misc_feature: GYAE6OF02JYFVS.8.34.D01.1.454.CMB.1.raw
  modified_base (476)..(476): a, c, t, g, unknown or other
  misc_feature (476)..(476): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgtctacttttaaggaggttgtccagttgtacaagtgacctaagtgggtggagtcgtggggggacgcgtagtccaggccgtgggacgtcacagagacctctccgtggcgcacgtccctcgttcgggttacctaccgttcgagtagccgtacggcagtcgctacgtcggtacccgaccaacctccgaaggacgtaagggtagttgggacggtgggtacggcgttaggtttacttacgatcggaggaggtcgtagttgttactaaggtggtaatgtcgtacggacggtccggtagggaaccggtcggtacttaccaccncgtacgtacctagaacactaccgtacgaacgaaccaactatagttacggtacgaccgtagaacctacgtacctacgtacgacggaacggtacgtacggtactaacgtactacgtacgggtaacggaacggggaacggggaaccgagggtacggttacggtaccgtacgttacgtccgttacggacggttcggtacggtaccgg

SEQ ID NO: 77163 - DNA, 762 bp, Homo sapiens
  misc_feature: GYAE6OF02IDPJ6.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgacttgggtttcctcgttgcttcttttaagaggttgtaccagtgtacaagtgacaacgtggtggagtcggtgggggaggtcgtggtccagtccgtgggacggtcacgagacgactcgtcgtgtgctagccttggtcggttctacccttcgacgttaacgtcggcagtcgcaccgtcgggtccaccaacgtccgtaccgaggacgaagggtcgttagggacgggttcgggtggcgttaggtttcgtttactacgttcggtaggtacggtgttaacggtcgttaacaaggtttacgtacgtcgtaccgtaggttaccgtacgggtagggtaacccggtcgtaacgttccgtacgtacgttccaccgtacgaaacgtacgttaaccgtacgaaacggtaaacctacgtaaacttagttaacgtttaggacgtaacgtacgtaaaccgtcgttacccgtaacggttacgtacgggtaacggaccggtacgggtacgttaacttaaccgttacggtacgggaaccgggtaaggggtaaccggggaacggtccggggttaaggtacccgtaaccggttaacgttaccggtttacccggttacgggttacccggttgggtaacccggggg

SEQ ID NO: 77164 - DNA, 830 bp, Homo sapiens
  misc_feature: GYAE6OF02GLS7P.8.34.D01.1.454.CMB.1.raw
tcagctcgcgtgtccacgaccggtgctcgatttagatcgtctgtgttgggtttgggggaggaactgctcagttaggacccagagggaaccatggaagcaccagctcagcttctcttcctcctgctactcgtggctccctagtttccagactaccaccggagagtatttggtgttgaacactaatccgtccaagcccaaccctgttccttcgtctacccgaaggggaaacgtcgaccctacccgtctccgtggacgacgggcctacggtacaaggtaacgttcggtttcgggacccgtaccgttaacggttacttccccgttacgggttaaccgaaacctaaacggtaaaacccgttccgggtaacccgacggtacccgttaccccgaacgggtcccccctctaacgttcctagtcggtcgtaccgtactaccgtaacggaccggggcctacggtacggactacctccccgaagccgttacggttcgacggtggcgtacgggttggtagtcgggaactacgtacttcgaccgttacctaccggaaccttagtaccacgttaccgtacggacccgtggtacgacccgttggaacggttacgtttcggtacgtaccggttttaaggtttaccgtttaaacgttccggtaacctaaccggttaacgtaccggttaaccgggtacggttcggtacccgggggttcccggtacccgttaaccgggtttccggacccggttaaacggtaccgtaacggttacgggtactaacggtaacggtaaccgacttcgggaactcggtacgtaccgtaccgttcgttacgtcgttccttaccg

SEQ ID NO: 77165 - DNA, 978 bp, Homo sapiens
  misc_feature: GYAE6OF02IH7KF.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggaggcgtcggtccagccgtggggagtcacagagactcgtcgtgtcgcgacgtccttcgttcgggttcctaacctttacctaacggttaaaaccgttaccgggactaacgtttcggacccgttaaccggttccgggggttaccccgaaccccgtaaaaccggtcccttaacccccgggaaagggaacccgggtaaaagggggggttaagttttcgggggggaaggggtttcgggggggttaacggggtaccggtttaagggttttttacggttttacgtaacgtttccggtaggggtacggggggtaccttagggtttccggtttaacgtaaaggtttcgggttaattacggacgttaaacggtaccggttacccggtaaggggtaaaccggggtacccgtttaactttacccgtaaacccgtaccgtttacccctaacccggtaaacggtaaaccgaaacccgtaaacccgttaacccgaaaaccgggtaaaaccctaaggttaaacgtttacggtttaacggttttaaccggaacccgttaaacgtaaaccgttaccggtaaacccttaacgggttacccgtagggtaaacggtaaccgggttaaaccgggttacgttaaacgttaacccggtttaagttaacggggtaaaccggggaaacggggggaacccgggggtaaaccggtacgggtaaccgggttacttaaccggtaacgtttacccgtttacggttacggtaccggttaccgggttacgggtaccccgg

SEQ ID NO: 77166 - DNA, 768 bp, Homo sapiens
  misc_feature: GYAE6OF02GNBXC.8.34.D01.1.454.CMB.1.raw
tcagctcgcgtgtccacgaccggtgctcgatttagatcgtctgtgttgggtttggggggaagaggaagactgacggtcctgccacaggtggtgtttccattcggtgatcagcactgaacacagaggactcaccatggagtttgggctgaacttgggttttcctcgttgctcttttaagaggtgtccagtgtcaagtgcaactggtggagtcgtggggggacggcgtggtcccaggccgtagggaggtcacgagacgacttcgtcgtgtgcagccttcgttgggtcctaccgttcagtaacctaccggctatcgcaccgtggtcccgaccaagcctaccgaggacgaaggggtagttcgggaggtcggggttaggccgtaggttttcgtttacagttccgtagggtacgggtctaggtttacgttaacgtaaggttagggttactcgggacccaacggtacccgttccgggtaacggaaacgggggtccctaacgtttacacccgttacgtacctaccgtaaggtaaaccgaaccgtaacgttaacccgaacggtaaacctaacgaaacttaggtttacgtttacggagtccgtacgtaaccgagtaccctaacggtccgtacggaacggtacgaccgggttacgtacgttaaccttacgtaggtaaccgggtaaagggggtaaccggggaaccgacggggttaacgggtacgttacccggtaacgttaacccgttccggtttaacggaccggtacgggtacccggggg

SEQ ID NO: 77167 - DNA, 698 bp, Homo sapiens
  misc_feature: GYAE6OF02IRXAF.8.34.D01.1.454.CMB.1.raw
  modified_base (169)..(169): a, c, t, g, unknown or other
  misc_feature (169)..(169): n is a, c, g, or t
  modified_base (173)..(173): a, c, t, g, unknown or other
  misc_feature (173)..(173): n is a, c, g, or t
  modified_base (383)..(383): a, c, t, g, unknown or other
  misc_feature (383)..(383): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaactggttttcctcgttgctcttttaagnggtntccagtgtcaagtgcaactggtggtagtcgtgggggagtcgtggtccagccgtgggagtcacagagactctcgtgtgcacgccttcgtgggttccaccgttacagtaacctacggctaatgacctacgtcgggtcccacccgaaagcctaccgaggaccgaagggtacttggggaacgttgggtggaccgtaggtttcgttacagttcgnggacgggtctagttgttaacaagttggtaatcgtagacgtacgttccggtagggaacgggtccgtaattccgaacctagttcctaccgaagtaacgaactaaacgttaccgaaggaaactacgtaagttacgtagtttaggacgtacgtaacgaacgtaccgtacgtaacgtccgtagaaccgacgtacgggacgtaacgtacgttacgtaggtaacgggtaaaggggtaacgggggaaccgtagggtaccgggttaaccgttaccgtaaacggttaccgttaccggtttacggtaccggttacggtaaccgggg

SEQ ID NO: 77168 - DNA, 750 bp, Homo sapiens
  misc_feature: GYAE6OF02I7OE7.8.34.D01.1.454.CMB.1.raw
tcagctcgcgtgtccacgaccggtgctcgatttagatcgtctgtgttgggtttgggggaggactgctcagttaggacccagagggaaccatggaagccccagctcagcttctcttcctcctgctactctggctcccagtttcagataccaccggagagattgtcgttgacacaatctccagccaccctgtcttcgtctccaggggaaagagccaccctctaccgtcgcagggccctagtcagaactgttaggcgcctacgatcctggtaccaacagaaacctggccaggcctacccacggcccctcatcctagtcggtcgtacagtaccaaccgtgggccctaaccgttgggaccctacgttaccccgacggtaccccgtagggtttccaagggtcggacctaggggttgggggttaaactgggggaacctaggacgtttacccacttaccgcctaacccatacctaatcgaacgtcccgtggtaagccctaggacgtagttacgtcggtacgtaagttttacttaccgtacggttataaaccctagttcccggtaaccggtcggtaccggtacccgggttacccgggggacccttaccggtttaccccgggtacccgtaccggggtaaaccgaaaggttttacgggaccgtttaacctaaccggtaaacctaaccgttaccgggttaggtaccgttacggtaaccgtaccctaacgttcccggttccgttacccgttaaccgttacccg

SEQ ID NO: 77169 - DNA, 871 bp, Homo sapiens
  misc_feature: GYAE6OF02HTYQF.8.34.D01.1.454.CMB.1.raw
  modified_base (275)..(275): a, c, t, g, unknown or other
  misc_feature (275)..(275): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcacatggagttggctgtacccggttttctcgttactcttttaaggaggtcgtaccagtgtacaagtgcctaagtgggtggaacgtcggtgggggacggccggttagggtcccaggtccgttaggggagtacacgaggacgtactcgtaggtgngccgagcccttgtcggttctaccttcgaagttaacacggcagtcgactcgtgtcgtacccgaccaacgcctacgaacggacgtaacgggtattgggaggtcggggtgtacgttaaggtttcggttttacacgttcgtacgggacggtccgttaggttaacttaccgtaaaggtttaggtacgtcggtacgtaaggtaacccggttacgggtaaggtaaaccgggtccttaaacgttcctaacccgtaactaccggtaacgaacggtaacgaaccgttaaacctaaccgggaaccgtaaaacgtaagttaaaaccgggttgtttaaacgggttaaggtaacgtaaccgttaacgaaacccgttaccggtaaacccgttaacgtacccgtaagggtaacccgggtaagggtaaaccccgggttaacttaacccgttaaaccggtaccgttacggggttaaacccgggaaaaggggggtaacccggggggttaaaccgaccgggggtaaccgggttaaccgttaacccgggtaaacgtttacccgggtttaccggttttacggaacccgggttttccgggggaccgggtaaccccgggg

SEQ ID NO: 77170 - DNA, 917 bp, Homo sapiens
  misc_feature: GYAE6OF02HWT71.8.34.D01.1.454.CMB.1.raw
  modified_base (206)..(206): a, c, t, g, unknown or other
  misc_feature (206)..(206): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagactaccgaccggagagattgtgttgacacatctccagccacctgtcttcgtctcgagggaancgccacctctacctgcgacgggccaggtcagaatggttaggcgacttacgtatccgtacggacctaaacgacgaaaccgtggaccgaacggcctaccccgacgggtaccccccttagaacttaccgttaacgtcggggtactaccgtaccgttaaccccgaaacggaccggggtacccacgggttaacggccgtaaccgttccccgtaacgggtaccccggttaaaggggttcccgtaacggggttacgggtaccggtaacggggttttacggggttaacgttaacgggggtaaacccgtaacggttaacccgtttaaccgtaaaccgtttcccggtaaccctaaacccgtaacgtttacccgttaaaccgtttaccgaacccgggtttaccgttaccgggggtaacccgtacccggggtttaggaaacggggttaacgtttacgggtttaccggttacgtttaaacgttttacgttaaaccggtttacggtaaccttaacggttaacggtacccggttaacggtaaccgggttcccggggtaccccgggttcccggggttaaaccccgtttccgggtttacccggggaaccccgttagggaaacccgttaagggtcggtaacgttacgtaaccggtaaaacgttccgtacgggttccggacgtttacgaccgttaaacccgtgttcccggtacgtttcgtacgttacccg

SEQ ID NO: 77171 - DNA, 825 bp, Homo sapiens
  misc_feature: GYAE6OF02I6U95.8.34.D01.1.454.CMB.1.raw
  modified_base (211)..(211): a, c, t, g, unknown or other
  misc_feature (211)..(211): n is a, c, g, or t
  modified_base (308)..(308): a, c, t, g, unknown or other
  misc_feature (308)..(308): n is a, c, g, or t
  modified_base (572)..(572): a, c, t, g, unknown or other
  misc_feature (572)..(572): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcctagtttcagataccaccggagagattgtgttgacaacaatcctccagccaccctgtcttcgtctccgagggaancgccacctctctgcagggccagcagatggtacgcgctacgatccgtaggtaccaagacgaaacctcgaccgacggtcctacccgacggtccccctanaccttcgtaagtcggttacgctaaccgtacccgaaacggtaccgggacctaccggtacggtaaccctaacccgtaccccgtacggtaaccccgttaagggttaccgacggggttacggacccgggtttaaggggttacggggttaccggttaaccggggtacccgtaaacgttcccggtttaaccaaacccggttttcctaacccggtaacttacgtaccttaacgccgtaaacgtcccggtagggtaacccgtccgtaagggngttaacgtttcggttaccgaagtttaacgtttacgttaccgttcgttaccctaaacgtttacggtaccggttccggaaagggtccccgtaacccggggttccccggggttaaccgttacccgggttttcccggaccgggttaacggttaaccgtaaagggttccgactttaacgggaaccctaacgggttacgtaacgggtcgtaccgtcgtacccgtattaccgtacgtttaccgttccttaacggttcccg

SEQ ID NO: 77172 - DNA, 856 bp, Homo sapiens
  misc_feature: GYAE6OF02GY6U7.8.34.D01.1.454.CMB.1.raw
  modified_base (358)..(358): a, c, t, g, unknown or other
  misc_feature (358)..(358): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggtagtttgggctgaacgttgggttttcctcgttgtcttcgttttaagaggtgtccagtgtcaagtcgcaacgtggtggagtcggtgggggagcgtggtcagccgtgggacgtcacgagacgacttcgtcgtgtcgcgacgccgttcgtcgggtttaccacttcgtaagtacgtcgtacgcagtcgacgcgtcggaccgaccaaaccgtccgagggaccgtaaaggggtnttagggtacggtgggtacgggtcgttacggtttcggtttacgaacgttcggtacggaacggtacgtagtttcggttaactagggttaacgtcggtacgtaccgtcggtacggtcccgggttaaggaacccggtcgtaccgttaaccaccggttactacccggtttaccgaaaggtaccggtaaacctacccggtaaacggtaaaccggaaccgtaaacgggtttaaacgtttacgggttttaaacgttaccggggtaaacccgttagggtaaaaccggtaacccgttaaacccgggttaccggttaacccgtagggtaaccggtaccggtaacccggggtttttattaaccgtaacccgttaagttaccggggtaaaggggtaaaccgggggtaaccggggaacgtaaccggggaccggttaacggtttaacccggtacgggtttaccctttaccgggtttaccgggacccgtttccggggtacccgggttaacccgg

SEQ ID NO: 77173 - DNA, 755 bp, Homo sapiens
  misc_feature: GYAE6OF02J0X0Z.8.34.D01.1.454.CMB.1.raw
  modified_base (134)..(134): a, c, t, g, unknown or other
  misc_feature (134)..(134): n is a, c, g, or t
  modified_base (176)..(176): a, c, t, g, unknown or other
  misc_feature (176)..(176): n is a, c, g, or t
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (403)..(403): a, c, t, g, unknown or other
  misc_feature (403)..(403): n is a, c, g, or t
  modified_base (625)..(625): a, c, t, g, unknown or other
  misc_feature (625)..(625): n is a, c, g, or t
tcagctcgcgtgtccacgaccggtgctcgatttagatcgtctgtggttgggtctgggagaggagcccagcactagaagtccggcgggtgtttccattcggtgatcagccactgaacacagagactcaccatggngtttgggctgacttgggtttctcgttgcttctttaagaggtntccagtgtcaagtgactaacgtggtgagtcgtgggggaggtcgtggtcccgagcctgggagtcacgngagacctntcgtgtcgcacgtcctcgtcggtcctacgtttcgataaccgtgcagtcgactactcgggtaccacgtagtcccacgtagggtccaaaggggtacgttgggagtcgggtacggacggttaggtttcgtttcgacgtttcggaggtaccgggtnacgtttgtaccgtaagttggggtaactcggtacgtaccggaccgtaccggggttaaggtaacccgggtacgtaaccgtcctaacgttaaccgtacttaacccggaggtacttaaaacccgtagtttaaccccgaaagggtaaacccaggttaaaccggttacggttttaagtaacggtaaccgtggtaacgaaccgtaacgtacccgtagtaacccggttanaccggggtaacgtaccgtacggtttaacgtcgttacgtacggggttaaacggacgggggtaaggggtaccctaggtacggtaaccggttcgacggttaaccgtcgttaccgggtacggtacgttccgggg

SEQ ID NO: 77174 - DNA, 680 bp, Homo sapiens
  misc_feature: GYAE6OF02HOVP7.8.34.D01.1.454.CMB.1.raw
  modified_base (234)..(234): a, c, t, g, unknown or other
  misc_feature (234)..(234): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtctgggggagcgtggtccagcctgggagtcanagagactctcgtgtgcagcctcgtggttcaccttcagtaactacggcatgcacgtcgggtcccgaccaggcctaccgaggacgaagggtattgggaggttgggtggactaggtttcgtttacattcgtggagggctagttcgttactagtgttatgacaggtaccgtccggtaggtaacggggccgtattacccgaactacgttccgtaccgaggtaaccgaactaaccgttaacccgaaacgtaaacaacgtaacgttgttaagtttacggacgtcgtacgaaacgtacgaccgttaacggtcccgtaggaccgggacgtaccgggtacgttacgtaacgttaccgttaggtaacgggaacgggggtaacggggtaaccgagggtacgggtacgttaccggtaacggttaccgttaccggtttacgaccggttccggtaccgggg

SEQ ID NO: 77175 - DNA, 811 bp, Homo sapiens
  misc_feature: GYAE6OF02FIIZ7.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactagaacacagagactcaccagtggagtttggctgacgttgggttttcctcgttgcttacgtttttaagaggttcgtacctaaggttcgtactaaaggttcaccgtaaacgttggggttacgggacgttccggttgggggggaacggtccggttcggttacccaggtcccgtagggggacgttccaacgaggtacacttccgttcgtgtacggacctgtaccttcgtacgggttcctaccgtttacgtaacgttaaaccgtaccggcctagtccggtaccgtaccggttacccgggtcccggtaaccaaaccggttcccgtaaccgacgggtaaacggtaacgggtaccggtttcgggaggttcggggtacggtaccgttagggtttttacggttactacgttccggtaggacgggtaccttagggtaccgttacgtaaagtttcggtactacgttacgtaacgttcgttaccgggtaacgggtaaccgtaccggtactacgaccgtactaccgacgtacgtacgtaactaccgaccgacgaactacgtaatcgttatagtacacgtagacacgtacgttacgcgtaacgagacggttacgtagtacgttacgtagtacggaacggtacgggtaacggaccggttacgggacgttacggtaccgacgtttaccgtccggtttacggttaccggccggttaacggg

SEQ ID NO: 77176 - DNA, 886 bp, Homo sapiens
  misc_feature: GYAE6OF02GQ01A.8.34.D01.1.454.CMB.1.raw
  modified_base (217)..(217): a, c, t, g, unknown or other
  misc_feature (217)..(217): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagataccaccggagagattgtgttgacacaactctccagccaccctgtccttcgtccgtaccgaaggggaaanacgcccaccctctccgtggacgacgggccaggtcaagtaagttcggttcggccgacccgttacgtaacttcccgtacggtaaacccaaacgaaaccggtaaaaccgtcggacccgtaacgggccctacccccggtaccggtacccccctacgtacctttacccgttaaggtccgggttaccgtccgtaaaaccgttaccccggaaaaccggaccgggtaccccgaacgttccgggaaccctaacccgttacccccgacggttaaccccggtaaggttccgaaacggttccggtacggtaacggggtttcggggtaacgtaacggggtaaacaaccggttaacgttcccgtaccgttcccgtacccgtaacgtacgtactacgtaccgtaccgtaccggtacggaaccgtaccgtagtaacgttacgttcgtacggtacgtttaagtttacttaacgttacgttaacctaacgttacgtaccggttaaccggtacggtccgggtacccggttacccgggtaccctttacccgggttccggttaccccggtacggtaaacccggtacgggtacggtacgtaacgtaacccgggttaacgaacccggttacggtccggttacggtcgaccggttaacctggttaaccgttcgtttaaccgtcccttacccgg

SEQ ID NO: 77177 - DNA, 815 bp, Homo sapiens
  misc_feature: GYAE6OF02GMAQ9.8.34.D01.1.454.CMB.1.raw
tcagctcgcgtgtccacgaccggtgctcgatttagatcgtctgtgttggggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaagggaaagagcccaaccctctccgtgacgacgggccagtacaagatggttggcgacctacgtactccgtaggtaaccaaacgacgaaacctggacccaggccctaccccgaacggcccccttcaattccgtaagttaggtcgaccaacgtaccccaaacggacggggaccccaacgtccgggaactacctccccgaaggtcccctaaggggttacaacggggtacggaccggaaggggttagggtacggtacggggaactaggtaaccttccgaaccgttctaacctaaccgatttaaccactaccgaacgtccgtacggacgtaccgtaggaacgttagttaggttacgtaacttaacgttttaacttaccgttacgtaaccgaaacttaggttacccgtaacggtacggttacccggggttaacccggtacccgggggttacccttaaccgggtttcccgggtacccggtaaccggggaaacccgttaaaggggtaccggttacgtaaaccggtttaaccggaaaaaacggtaacgggttaccggtaaccgggttacgtacggaacccgtaacggtacgttaccctggttttaccgtacttaacccccgg

SEQ ID NO: 77178 - DNA, 724 bp, Homo sapiens
  misc_feature: GYAE6OF02IXQ21.8.34.D01.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (269)..(269): a, c, t, g, unknown or other
  misc_feature (269)..(269): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggacgtttgggctgaactgggtttttcctcgttgcttactttttaagaggtgtaccagttgtacaagtgcaacgtggtggngtcgtgggggagcgtggtccagccgtgggagtccanagacgtactcgtcgtgtacgcacnccttgttcggtttccaccttgaacgtaacctaccgggactaacgttcgactaccggtcggggtacccaccgaagtccctaccggagggaccgaaaggggttcgtttggggagggttcgggtggacttagggttttctttcagtcgtggacgggtctaggtttgttaccagttggtcgagctaggacccttacgggtaggaccggcgttacttaccgactactaccacgtaacgaacaccgaaccgaaccgtaacaactaacgtaaagttacgttaacgttaccgggtaacctacggtaactacgttacccgtaacgtcccgtaagtaacggaccgggtagtacgttaacgtaacgttagtacgtacgggtaacggggaaccggggtaaccgagggtaccggtaacgtcgtaacgttaccgttaccgttacggtaccggttcggtacgggtaccgg

SEQ ID NO: 77179 - DNA, 745 bp, Homo sapiens
  misc_feature: GYAE6OF02GNFPB.8.34.D01.1.454.CMB.1.raw
  modified_base (323)..(323): a, c, t, g, unknown or other
  misc_feature (323)..(323): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccagtggtagtttgggctagaacgttcgggttttcctcgttgtcttacttttaaggaggtcgtcagtgtcaagtgcaacgtggtaggagtcggtggggaggtcgtcggtccagccgtgggacggtcgacgagacgaccgtcgtcggtgtcgcacgtccgttcgttcggtcctaaccttaccgaacgttaaaccgcgganacgtgaccgtacggtcgggtcccgaaccgtaacggccctacggacggtacgtaaggggtgttacgggagggttcgggtcggtacgttacggttttacgttacgtacgttccggaggtaacggtacgtaggttacttacggtaaagtggttagtcgaacgtacgtaccggttacggtagggaacggtcgtaacgttcacctacgtcaccggagtaacgtaccgtaacgtaccgaaacgtaacgtaacgtagttacgttacgttacgtacgtacggtacaacgtacgttactaacgtcgaacggcgtaacggtcggtaactacttacggtaccgaaggtaaccgggagggtaaccggacgtacgggtacgtaccggttacgtaaccggttccgttacgggtacggtacggtaccggttccgggg

SEQ ID NO: 77180 - DNA, 725 bp, Homo sapiens
  misc_feature: GYAE6OF02IS1XC.8.34.D01.1.454.CMB.1.raw
tcagctcgcgtgtccacgaccggtgctcgatttagatcgtctgtgttgggtttgggggaggaactgctcagttaggacccagagggaaccatggaagccccagctcagcttctcttctcctgctactctggctcccagtttcagataccacggagagattgtgttgacacaatctccagccaccctgtcttcgtctcgagggaagagcccacctctcctgcgacggccgacgtcacgaatgttcggacgtccgtacgtactccgtacggtaaccaacaacgtaaaccgtacggaccgtacggccctaccccgaaccggtcccccgtacctactcttaacgttgggtcgtacacgttacccgaaccggaacggaccgtaccgtcggacctacctacccgaccgccgttacggttacgtggtacggacgtagggtacgggtaggtacggacggtacgtaccgtacgttaacctccttaaccgacctacgttacaccgtacgtcgtaccggtgggaacgtccggtagtaggtaggttggttcgtacgttagtttactttacgtactaactagtaccgtaccgtacggtacgtccgggtaccggtcccggggttaccgtaccgttccgaccggtaggaaccggtagtacgtacgtaacgtacggaaaccgtcggtaacggttccgacgtcgtaaccgtaccgtactacgtttcgtacgttccttacccg

SEQ ID NO: 77181 - DNA, 849 bp, Homo sapiens
  misc_feature: GYAE6OF02GJLOS.8.34.D01.1.454.CMB.1.raw
  modified_base (157)..(157): a, c, t, g, unknown or other
  misc_feature (157)..(157): n is a, c, g, or t
tcagctcgcgtgtccacgaccggtgctcgatttagatcgtctgtgttgggtttgggggagaactgctcagttaggacccagagggaaccatggaagccccagctcagcttctcttcctcctgctactctggctcccagtttcagataccacgggganattgtgttgacacaatctccagcccacctgtccttcgtcctaccgaaggggaaacgtacgccctacccgtcttccgtgccgaacggggcccaaggtccagtaacgtggttacggcgtaccttaacgtactccgttacgggaaccctaacgaacggaaaaccctcgggtaacccgacggtccctaccccgaacggtccccctactattccgtaacgttggtcgactaacgtccaacggacgggcctacgtggcctacgtacccgagtccgtacggttacacgggtcggtacgtagggttacgggtagtaccggggtaactaacggttaccgttacgtaacccgttcgttaacccgaaaccccggtacgttaccgtaacgtttaaccgaccgggtaccccgttagggggtaaaccttacccgggtacggttaaagggtactttcgggttacgtaacggttacgtttttaattaaccgttcgtaacccgtaaagtcgttaacccgtttacgacgggttccggtacccccgggacgggttaccctttcggttaaccccgggccgttaaccgggaaaccttaaaggtcgggaacccttttacggaaccgttaaccggtaaccgggtaggttaccgtacgttaaccgcgtaaaccttcggttaacgtccgggtttaaccctctacccggtttaccccg

SEQ ID NO: 77182 - DNA, 732 bp, Homo sapiens
  misc_feature: GYAE6OF02JJVOT.8.34.D01.1.454.CMB.1.raw
  modified_base (169)..(169): a, c, t, g, unknown or other
  misc_feature (169)..(169): n is a, c, g, or t
  modified_base (188)..(188): a, c, t, g, unknown or other
  misc_feature (188)..(188): n is a, c, g, or t
  modified_base (250)..(250): a, c, t, g, unknown or other
  misc_feature (250)..(250): n is a, c, g, or t
  modified_base (630)..(630): a, c, t, g, unknown or other
  misc_feature (630)..(630): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaacttggttttcccgtgcttcgtttaagnggtgtccagtcgtacagtnccaactgggtggatcgtggggacgcgtacggtcccaggcccgtagggacgttcacgacgganaccgttctccgtgtacgcgtaacgccgttacgttcggtaccttaccgttacaggttaccgccgtacggactaagtcgccgtacggttcggacccgtacccgaactcgacggccgtaaggtacgttcgggaatcggggtcgtacgttggttacgtttcgaaggttccgaggtacgggtccttagggtacgtttcaaaggtcggtacgttggtaccgtcggaacgttaccggtacgggtaacgggtccgtaacgttaccgtaccgtacttaccgtaccgaacgacggtacctaaacggtcccgaaggtaaccgtaacgtagtttacgacttaccggtacaacgacgtaacgactaacgtcgtaaggtacggagtacggttanacgttacgtacgtaggtaacgggaccgggtaggtaaccggcgtacgggttaccttaccggaacgtttcgtaccggttgaaccggttccgtaggttaccccgg

SEQ ID NO: 77183 - DNA, 819 bp, Homo sapiens
  misc_feature: GYAE6OF02H19FU.8.34.D01.1.454.CMB.1.raw
  modified_base (771)..(771): a, c, t, g, unknown or other
  misc_feature (771)..(771): n is a, c, g, or t
tcagctcgcgtgtccacgaccggtgctcgatttagatcgtctgtgttgggtctgggagaggagcccagcactagaagtcggcggtgtttccattcggtgactcagcactcgaaacacgagaggactcaccagtgggtagtttgggactggaacgttcggggttttccctcggttagtcttacgttttaaaggaggttcgtaccaggttcgtacgaagttcgacgtaacgtgggtcggagtcggtgggggagtacgtgtaccgagtccggtgggacggtcaagacgagtacctccgttcgtagtggacctggtcccttacggttacgggttcctaccgttacgtaggtacgacgtacggtacgcgttacggcctaacggttccggtacccccgaacgtaaacccgtccggaacggtaaccggaagggttaacgttggggtaacgggttcgggtaacgggtaccgtttgggtttttaccgtttaaccgaggttttcggggaacgggtccgggtaaccgggttttaggttaccgtttaaccgggtttaaacgggttaagggtcggttaccgggttaacggttccggggaccgggtaccggttacggggaaccgggttaccgtttacgtaccgtaacccgtacttccggtaacgaggtaacctaccgtaaacccgtacgaacaacggtaacttattagttacgttacgacaaggtcacggtactaccgcgtagtacgaacgtgtactctagcggtacgaggaccggaaggtacgnggaaccgttatcgtaacggtcttccgttagacggtcggtacggtaccg

SEQ ID NO: 77184 - DNA, 661 bp, Homo sapiens
  misc_feature: GYAE6OF02JQJR8.8.34.D01.1.454.CMB.1.raw
  modified_base (220)..(220): a, c, t, g, unknown or other
  misc_feature (220)..(220): n is a, c, g, or t
  modified_base (265)..(265): a, c, t, g, unknown or other
  misc_feature (265)..(265): n is a, c, g, or t
  modified_base (390)..(390): a, c, t, g, unknown or other
  misc_feature (390)..(390): n is a, c, g, or t
  modified_base (446)..(446): a, c, t, g, unknown or other
  misc_feature (446)..(446): n is a, c, g, or t
tcagctcgcgtgtccacgaccggtgctcgatttagatcgtctgtgttgggtttgggggaggaactgctcagttaggacccagagggaaccatggaagccccagctcagcttctcttcctctgctactctcggcctcccagtttcaggactacccgacggagagtatttgtgttgacactaatcctccacgccacccgttgtccttcggctacgagggaancgcctaccctctccgtgccgaggcctagtcagagttcggtcgccnctagctccgtaggtaccaacgacgaaccgtgaccagtccctaccgcgaccctcgattcgtagtggcgtctaactacgaccgaggccctacgtcgacctccggtaccaccgacgtacgtacgacgnggtaccgtggtagggtagtaccgacgacgtactccgtacttccgactacgcgtacnctcgacgcgtggacctcggatcggacttgtctacttagttaacgttgtagtacctataccggtcgtaacggttacggtccggcccggtcgggttaccttacccgttacgggcccgtaacgggtaaccgtacgttcggtactacgaccgtaacggtatacgggtccgtcgttaccggactttaaccgccgtttaactccgtttccacccgttaccg

SEQ ID NO: 77185 - DNA, 859 bp, Homo sapiens
  misc_feature: GYAE6OF02JRAQF.8.34.D01.1.454.CMB.1.raw
  modified_base (480)..(480): a, c, t, g, unknown or other
  misc_feature (480)..(480): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccagtggagtttgggctagaacgttgggttttcctcggttgcttacgtttttaaggaggtcgtacctagtacttcgaaggtcgacaaacggttgggtggaggtcggtcggggggaggtcggttggttaccgagtccgggtagggacggttaccgaagaggacaccgttcgttcgttagtcggacacgtccgttcggttacggttacctaccgtttaccgaaggttaacctaccggtactggtacgtcgtaaccggtcgggtacccgtaacccgtagacccgtttaccggaccgggtaacgtagggtacgtttgggggaacggtttcggggtaacgtcgtttacgttttcgtttacncgggttactaggggcggttactagtttacggtagttacggttggtaattcgaacgtaccggtacgtaccggtagggaaccgggttctaacttcgaaccgtttacgtacccgtacgagttaaccgaagttaaccgtaccgtaaaggaactaacttaggtacgtttagtacgataccggacttaaccggacgtaccgtaacggtcccgttaaagggaaaccgtacggggtaccgttaacgtaaccttaacggtccgttaaaacggcggggggtaaaaccgggtaaccgggacccggttaaacgggtcgggtttaaaccgttcgggttaaacctttccccggttacgggtttaaggttaccccggggacggttaaccggggg

SEQ ID NO: 77186 - DNA, 712 bp, Homo sapiens
  misc_feature: GYAE6OF02G2MVC.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagccgtgggaggtcacagagacctctcctgtgcagcctctggttccaccttcagtagctacggcatgcacgtcgggtcccaccaaacctccgaaggaccgaagggtattgggaggtgggtgactaggtttgttcatcgtaggagggctaggtcgttacgaagtggtatgtacgtcgacggtccggtaggaacggggtcccgtaacttcccgaacctacgtaccgtaccgaagaaccgaaacctaaaccgtaccgaaacggaaacctaacgtaaacgttacgttaacgttacggtaacctacgaaaccgtaacgtacccttaacgttccgtaacggaacggtaccgtaacgggttacgtaaacgttaccgtaacgttacggtaacgggtaacgggggtaacgggggaaacccgtaggggaaccgggttacgttaaccggtaacggttaccgtttaccggtttacggaccggttacgggtacggggtacccgg

SEQ ID NO: 77187 - DNA, 711 bp, Homo sapiens
  misc_feature: GYAE6OF02GYTMA.8.34.D01.1.454.CMB.1.raw
  modified_base (177)..(177): a, c, t, g, unknown or other
  misc_feature (177)..(177): n is a, c, g, or t
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
tcagctcgcgtgtccacgaccggtgctcgatttagatcgtctgtgttgggtctgggagaggagcccagcactagagtcggcggtgtttccattcggtgatcagcactgaacacagaggactcaccatggagtttgggctgaacttgggttttcctcgttgcttacttttaagaggtntccagtgtacaagtgcaagtggtgagtcgtggggagcgtggtccagccgttgggagtcacnggacgactctcggtagtncgacgccttcgtggttcctccgttcaacgttaacctacggctagtcgacaccggttacgggtcccgaccgaacgcctaccgaggacggaacgggttagttagggagggtggggtacggcgtttaggtttaggttaccagtttcgagggtacgggtacgtagggttacgtaacttaggttaggttacgtggaaccgtaacgtaccggtcggtaacgggaacggtccgtaagtaccctacgtacgtttacacggaaacgacgtaactacgtaaccgaagaacctaacgtagtacgtagttaggacatacggaacgtacgtaccgtacgtacggagtaaccggaacggtacggtaactacgtactacgacggtaaggtaacggggaaggacccggaagggtaccggtacggtaacgtaaccggttaccttaacggttcggtaccgtacggtaccgggg

SEQ ID NO: 77188 - DNA, 731 bp, Homo sapiens
  misc_feature: GYAE6OF02IT6RX.8.34.D01.1.454.CMB.1.raw
  modified_base (174)..(174): a, c, t, g, unknown or other
  misc_feature (174)..(174): n is a, c, g, or t
  modified_base (247)..(247): a, c, t, g, unknown or other
  misc_feature (247)..(247): n is a, c, g, or t
  modified_base (371)..(371): a, c, t, g, unknown or other
  misc_feature (371)..(371): n is a, c, g, or t
  modified_base (437)..(437): a, c, t, g, unknown or other
  misc_feature (437)..(437): n is a, c, g, or t
tcagctcgcgtgtccacgaccggtgctcgatttagatcgtctgtggttgggtctgggagaggagcccagcactagaagtcggcggtgtttccattcggtgatcagcactgaacacagagactcaccatggagtttgggctgacgttgggttttcctgttgcttacgttttaagnggtgtccagtgtacaagtgacaacgtggtggagtcggtgggggagcggtggtcacgccgttgggacggtccanagagacttcgtcggtgtgacacgtccgttcgttcggttccaccgttacgaacgtaaacctcggactagtcgctacgtcggtccacacggtcctaccgaggacgaagggtgtagggaggtcgggngtaccttaggtttagttcgacgttcgtagggacggtactaggttcggttaacgtaagtcggtacgngaaccgtacggtaccgttcgggtaacggacggtaccgttaactccgtaacacgttacccgagtacgaacgtaaacttaaccgtaaccggaacgtaaacacgttaagtttcggtacgtttaccgactaacgaaccggtactaccgttaacgtcgtaacggtacgaacggttacggttagttaaactacgtaagccgggttaaagggaaccggggaacgggtacccgagggtaacggttcccgttaagtaaccgtttccggttaccgtcggtacgttacgggtccgggtaacccgg

SEQ ID NO: 77189 - DNA, 832 bp, Homo sapiens
  misc_feature: GYAE6OF02F43QW.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagttggctgaactgggttttcctgttgcttacttttaagaggtgtccagtgtcaagtgacaactggtggagtcggtgggggagcgtcggtccagccgtgggagtcacgagagactcgtcgtgtcgcacgtcctcgttgggttaccaaccttcaagtaaccgtcggactagtcgactaccggtcggggtcccacgaacgtccgtaccgagggacaaggggtacgttagggacggtggggtgacgtttaggtttcgtttacaagttccggtaggtagggtcgttaggttcgtttacggaagttggtaactcgactacggtaccggttccgggtaaggaacgggtcccgtaagttacccgaccgtacgttacccgttacgaaacggtaaccgtaacctaaaccgttaccggaaacggtaaaccgtaaaccttaacggtttaggttacgttttaacgggaaccgttaacgtaaccggtaacgtaccggttaaccgtaacgggttacccgtaggggaaacccgtaacgggtaaccgggtaccttaacgggttaacctttaccgggtaagggtaacccggggtaacggggggtaaccggggtaaacggtaccggggttaaccgggggtttaacctaccgggtttaacccggtttaacccgttttaccgggtttacggttaccccggggtttacggttaccccgggggg

SEQ ID NO: 77190 - DNA, 750 bp, Homo sapiens
  misc_feature: GYAE6OF02HQASJ.8.34.D01.1.454.CMB.1.raw
  modified_base (224)..(224): a, c, t, g, unknown or other
  misc_feature (224)..(224): n is a, c, g, or t
  modified_base (360)..(360): a, c, t, g, unknown or other
  misc_feature (360)..(360): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagatacccaccggagagatttggtcgttgaccaacaatcctccacgcccaccctgtccttcgtcctaccgaagggggaanacgcccaccctctacctggcagggcccaggtcaaggaacttcggttcggaccgtcccttaacggtactttccgttaacggtaacccaaacgtacgaaaaccgtcggaccacgggccctccccgaacggtccccctntactccgtagtcggtcgactacctaccgaaccggcggacctacgtcggacctaccgacccgacgtccgtacggttcgacggtcggacgtgggttacgggtaacgcgggtaacgtacgtaccttacgaccgttcctacgacctactctaactcggactcccggtagtacctcggtaggacggtactttcggtcaagttttacgttaacgtttcacgttacctaacgtcggtaccggttcgggaacgttcccgggtccgtacccggggtctacccggtttccgggacgttaaaccggaccgtaaaggttcgtaacgtacctaaacggtactaccgggttagcggttacctacggaccctaattccggttccttacgttccctagttccccgg

SEQ ID NO: 77191 - DNA, 1089 bp, Homo sapiens
  misc_feature: GYAE6OF02IDMHD.8.34.D01.1.454.CMB.1.raw
  modified_base (991)..(991): a, c, t, g, unknown or other
  misc_feature (991)..(991): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcacagtggaggtttggctgtaacgtttgggttttcctcggttgtcttacttttaaggaggttcgtacctaggttgtacaaggtcgaccgtaacgttggggtagggtaggttaccgggtagggggggacggtccggttacgggtaccccgaaggtcccggttaaggggggacggttccaacgtaaggacgtaccgttccgtaggttcggtacggcctaacggtccccgtttggttacgggggtttaccctaaccccgttttacggaaaaccggttaacccgttaaccggggctaaacgttcggacccgtaccgggtttccgggggtaccgaaccccgtaaacggggtcccttaacccggggaacggggtaccggtaaagggggttttacggtttacgggggaccggggtttagggggtacgggtaccgttttaacggggtttttcggtttacgtaacgttacccgggttaagggggacccgggttagtttaagggtttccggtttaaaccgtaaagggtttacgggtacggtttacggtaaacccgtacgggtttaaccccggtaccgggtaagggggttaaccccggtaacccgtttaccgtttacccgtaaaccccgtacgtttaccccggtaacggtaacggttaaacccgtaacttaaacccggtaacccggaaacgttaaaccgtaaaccgttaagttaaccggtttacgggttaacgaacggtaaccttaacggaaacgttaccggttacctaaacggtccggtaacgggtaaaccgggtacggtaacccggttaaggttaacgttaaccgttacccgggtaaaggggaaccggggtaaacgggggaacccgggggtaaaccgngggtttaaaccccggggttatttaaccccggggtaaggtttaaacccccgtttggggtttaaaccccggttacggggtccccgggttaacccgggggg

SEQ ID NO: 77192 - DNA, 757 bp, Homo sapiens
  misc_feature: GYAE6OF02GEDB2.8.34.D01.1.454.CMB.1.raw
  modified_base (172)..(172): a, c, t, g, unknown or other
  misc_feature (172)..(172): n is a, c, g, or t
  modified_base (176)..(176): a, c, t, g, unknown or other
  misc_feature (176)..(176): n is a, c, g, or t
  modified_base (208)..(208): a, c, t, g, unknown or other
  misc_feature (208)..(208): n is a, c, g, or t
  modified_base (353)..(353): a, c, t, g, unknown or other
  misc_feature (353)..(353): n is a, c, g, or t
  modified_base (391)..(391): a, c, t, g, unknown or other
  misc_feature (391)..(391): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacgtgggttttcctcgttgctcttttaagnggtntccagtgtcaagtgcaacgtggtcggagtcgngggggagcgtggtccagccgtagggacggtcacgaggacgaccttctcggtcgtgccgagtcctcggttcgggttaccctaacctttccgaaaggttaaaccgtaccggactagtacgccgtacggtcgggtaccccgacgaacnccgttaaccgacgggtacggtaaagggtagttacgggngggttcggggtacggtacttaaggttttgttaccgacgttccgtagggtacgggtactagggttcgttaacgaaggttcggttatacgcgtaacgtcgtcggtaggaacggtcgtacgttacgacctactcgtacaggtaacgtacctaaccgttaccgaaggtaactaacgtaattggttagtagacgtacgtaacgaacgtacgtactaacggttaccgtacggaacgaacggtcggtacgttacgtaaccgttacggtaacggtaaggggaaacgggtaaccgggggtaaccgtaacgggtacgggttaacgttaccgtaacgttaacccgttacggttacgggtaccggttcggtaccgggg

SEQ ID NO: 77193 - DNA, 871 bp, Homo sapiens
  misc_feature: GYAE6OF02HUHCI.8.34.D01.1.454.CMB.1.raw
tcagctcgcgtgtccacgaccggtgctcgatttagatcgtctgtgttgggtctgggagaggagcccagcactagaagtcggcggttgtttccattcggtgatcagcactgaaacacagaggactcaccagtggtaggtttgggctaggtaacgttcggggttttccttcgtttgtcctttacgtttttaaggaggttcgtacctagttgtactaaggttcgaccaacgttgggtggaggttccgggtagggggggacggtccggttcggtcccaggtccggtggggtacggtaccaacgaggacgacttcgtcggttgtcgcacgccgtcgttacggttaccaccttacgaagttaaccgtcgactatcgaccgtaccgttcgggccctaacccgtagtccctaccggacgggaacggtaaagggttacgtgggtacgggttggggttcgtaccgttaggtttttcgttacgtacgttcggtacggtagggtaccttaggtttacggttaaggtaacgttacgggtacgtaccgacggtaaccgtaccgggtcccgggtaaagggtaccgggtaccttaaccgtttccctaaccgttaaccgttcccgaacgtaacgaacgtttaaaccgtacccgtaaaccggtaaaacgtaacccgtaacgttaaacgttaggtttaggttaaaccgtaggtacctaaaccggtaccgtaccgttaccgttaaacgccggttaagggaccgttaaccggtacggtccttaagttaccgtacgttacgggaaccgggaaacgggggttaccgggaaccgtacgggacggtttactacggttaacgttccgtttacccggtggtaccggtagggtcccggg

SEQ ID NO: 77194 - DNA, 636 bp, Homo sapiens
  misc_feature: GYAE6OF02HQLLK.8.34.D01.1.454.CMB.1.raw
  modified_base (174)..(174): a, c, t, g, unknown or other
  misc_feature (174)..(174): n is a, c, g, or t
  modified_base (212)..(212): a, c, t, g, unknown or other
  misc_feature (212)..(212): n is a, c, g, or t
  modified_base (337)..(337): a, c, t, g, unknown or other
  misc_feature (337)..(337): n is a, c, g, or t
  modified_base (458)..(458): a, c, t, g, unknown or other
  misc_feature (458)..(458): n is a, c, g, or t
  modified_base (490)..(490): a, c, t, g, unknown or other
  misc_feature (490)..(490): n is a, c, g, or t
  modified_base (612)..(612): a, c, t, g, unknown or other
  misc_feature (612)..(612): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccgaccggagagattgtgttgaacanaatctaccagccaccctgtcttcgtctcgaagggaaancgccctaccctctcctgcgacgggccagtcagtagtgtaggccgtaccgtactctccgtaggaaccaacaacgaaaccgtcgaccgacggcctaccccgacggcccctagactcgtagttcggtnactactaccgaacgtacgggaccctacggacgacctacgcccgagaccgtaggtcgagtcgcgtaggaggtagtacggaatacgtacgtacgtctacacacctatcactcacgtctggacncgtaggagtgtcgtgtacgttaatttgtacgnttaccgagtcgtacgtcgtcggtcggtacccggtccggacttcccggtcgtccggtaacggaacgtacgtagacctaagtaccgaaaggtcccgtaggccggttacgacgtacctaccggtnttaccgtcgtttacctagttaccc

SEQ ID NO: 77195 - DNA, 760 bp, Homo sapiens
  misc_feature: GYAE6OF02FL9DC.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagagactcaccatggagtttgggctgaactgggtttcctcgttgctcttttaagaggtgtccagtgtcaagtgcaactggtggagtctggggggaggtcggtggtccagtcccgtgggacggtacaccgagacgacctctcgtgtgcacgcctcgtggtcaccttgtactaactacggcatgaccacgttcgggtacccgacctaagcctacccgagggaccgtaaaggggtattaggggacgttggggtggtcctaggtttcgtttactagtccgtaggacggggtctaagttcggttacaaggtttggtacttacggacgtaagtacccgttaccgggtaagggaaccgggtcccgtaacttacgaaccctagttacccgtaccgtaacgaacgtaaaccgtaaaccttaacccgaaggtaaaccaaactaaacggtttagtttaacgttagggtacgtaccttaacggaaaccgtacggtaaccgttaaacggtacctacgggaaacggaccgtacgggttacgtaacttacggtaaccgttcgggaaacgggtaacggggaacggggaaccgtagggaaccgggttaacgtacccgtaacggttacccgttaccgtttacggaccggttcggttacccgggg

SEQ ID NO: 77196 - DNA, 818 bp, Homo sapiens
  misc_feature: GYAE6OF02F6CRN.8.34.D01.1.454.CMB.1.raw
  modified_base (184)..(184): a, c, t, g, unknown or other
  misc_feature (184)..(184): n is a, c, g, or t
  modified_base (223)..(223): a, c, t, g, unknown or other
  misc_feature (223)..(223): n is a, c, g, or t
  modified_base (397)..(397): a, c, t, g, unknown or other
  misc_feature (397)..(397): n is a, c, g, or t
  modified_base (781)..(781): a, c, t, g, unknown or other
  misc_feature (781)..(781): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggacctccgagtttcagactaccgacggagacgtattgtgttgacactaatccnccagcccaccctgtaccttcgtctccggaaggggtaaancggacccaccctctccgtggccgagggtccaggttacaagtaacgttggttcggccgtaccgttaacgttctccgtacggtaaccaacgacgaaccgtgaccgacgtcctcccgacgcccctcattacgtagtggacgactactaccgaaccggtacggcctaacggcggaccncttacccgacgtaccggttacggtccaggtcggtacgtagggttacggggttagtaaccggggactaacggttaccttaccgaaccgttttcccgaacgttacctacgtttaaccgactttaaccgaccggttccgtagggtaaccgttacgtaacgggtacgttaacgttccggtttaacggtacccgtttaagtttttaccgtaacgttcgtaaaccgtacgttaccgttaccggttaaccgggtacggttacccgggttaccccggttacgggggtacccgtttaccggtttacccggggtaaccccgtacgggttaaactaacccgggtacgttacgtaacgttaaccggaaacggttccggttaggaccgtcgttaccncggttactaccgttccgtacgttaccttcgttacccg

SEQ ID NO: 77197 - DNA, 997 bp, Homo sapiens
  misc_feature: GYAE6OF02FTGSH.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcacctagtggtaggtttcggctagtacgtttcggttttccttcgttgtcctttacgtttaaggtaggttcgtaccgagttcgtactaaggtgacctaaggtggggttaggtacggttcgggtaggggggacgtacggttacgtcccgaacggtccgggtacgggggtacgtaccgaacgtaaggtaaccgttacccttccgttcgttcggcgtaccgtaccgtcccgttcggttcggttacccctacctttacgtaacggtccgtaccgtacggtacgtagtccgtaccgtaccgggtccgggtaaccccgaacccctaaacccggttaccggaaccggtaaaccgggtaacgggttagggtttacggggaacgggggttacggggtcgttcggttaacggttttttccgttaaccgtacggtttaccgggtacggtaacgggtcgttaacggttccggtttaagtaagggtttaccggttagtccggttaccggtaaccggtaccccggggttacggtaaacgggggtaccgggttacccgttaaaccgtttaacccgtaaaccttaccgttaacccggtaacccgtaaaacggttaacccgaaaccgtaacccgttaaaccggaaacgtaaaaccgaacgttaacggtttacggtttaaccgttaacggtaaccgtaacggaaccggtaaccgttaacccggtaacgttaccggaacgggtaccggtaaccggttaccggttacttaaacggttactagggttaccggacgggttaacgggggaaccggtaacggtacgggtaccggttaaccgttacggttaccggttacgttaccggttccgggtaccgttccgggaccggttaaccccgg

SEQ ID NO: 77198 - DNA, 858 bp, Homo sapiens
  misc_feature: GYAE6OF02GKCLE.8.34.D01.1.454.CMB.1.raw
tcagctcgcgtgtccacgaccggtgctcgatttagatcgtctgtggttgggtctgggagaggagcccagcactagaagtcggcggttgtttccattcggtgatcagcactgaacacagaggactcaccagtggtagtttgggctgtaacgttcgggtttttcctcgttgtcctttactttttaaggaggttcgtccaggttgtactaaggtcgacgtaacgtgggtgggtacgtcggtggggggagtcggtcggtcccgagccggttgggaacgtcgacgaggacgtacgttcgtcggttgtcgaccgtacggtccttcggttcgggttaccctaccgtttaacgaacggttaaccgtaccggtctagtcggcttacccggtcgggtacccaccgtaacggtccctaccggaacgggaccgtaacgggtaggtttacgggagggttcggggtcggtaccgttaggttttcggtttacacggtttccggtaggacggggtcctttaggttacgttaacgtaaaggttcggtacgtacgtaccgtaacggtaccgtttacccgggaggggtaaccggtaccgttacgttaaccgtaccccaagtttacccgacgtaaacggactaaaccgttaaccgtaccgaaggtaaacctaacgttaacgtttaagtcggttaacggacgttaccggaagtaaacccggtattacccgggttaacgttccggaacggtaaccgggaaccggttacggtacttaacgttaacgttcggtaacggaacggggtaaggggaaaccgggtacgacgggtaacggtaccttaaccgacgttaccgttccgtacggtaccggtaggtaccggg

SEQ ID NO: 77199 - DNA, 1008 bp, Homo sapiens
  misc_feature: GYAE6OF02I51MI.8.34.D01.1.454.CMB.1.raw
  modified_base (165)..(165): a, c, t, g, unknown or other
  misc_feature (165)..(165): n is a, c, g, or t
tcagctcgcgtgtccacgaccggtgctcgatttagatcgtctgtgttggggtttggggggaagaggaagactgacggtcctgccacaggtggtgtttccattcggtgatcagcactgaacacagaggactcaccagtggagtttgggctgaacttgggttttccncgttgcttctttaaggagtgtccagtgtacaagtgcaacgtgggtagacgtcggtgggggagcggtcggtccagtccgtagggaggtcacgagaggactctcggtagtcgcgacgtccttcgttcgggttacctaccggttttcaacggttaaacctcgggacctattcggaccgtacgtacggggttacccgacccggtaaacgcccgtaccggaaagggaccggaaagggggttagtttaaggggaccgggttgggggttacggacccggtttaaggtttttggtttacgtaacgttacggagggttaaccggggctttaaaccgttgggtttaacctaaaggttcggttaacgttaggaccgtaccggtaacccgttaccggggttacgggaacggtcccggttaacttacccgaaccgttaaccgtaccgtaaccggaagggtaacgaaaccgttacgttaacccgaaacgggtaaacctaaacgttaaacgtaacggttttaaacggtcggtaaacccgtttaaggtaacccggtaaaacgtacccggttaaaccggtttaacccgtaacccgggtaggggtaaaccccggttaaaaggggttaccccgggttaaacgtttaaacccggttaaccggtttaacccgtttaaagggggttaaaccccggggggttaaaagggggggtaaaccccgggggttaacccggggtaaacggggttaaccccgggggtttaaaccgggtttacccgggtttaaaccccggggttttaacccggtttacccggggttttaaaccgggttacccgggtttaccccggggtttaaaccccggggggg

SEQ ID NO: 77200 - DNA, 616 bp, Homo sapiens
  misc_feature: GYAE6OF02G1SSU.8.34.D01.1.454.CMB.1.raw
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (247)..(247): a, c, t, g, unknown or other
  misc_feature (247)..(247): n is a, c, g, or t
  modified_base (292)..(292): a, c, t, g, unknown or other
  misc_feature (292)..(292): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagataccaccggagagattgtgttgacacaatctccagccacctgtcttcgtctccgaggggaaancgccaccctntcctgcagggccagtcagatgtcggcnctagatccgtgtaccacagaacctggaccaggctccaggcccctnatctatggtgctatccaagcggcctacgtggacacgtcccagccaggttcaggtcggcgtaggtgggatggggacacggtcttacactctacaaccgtatcaactcacgtccgtaggactccgtaggacggtactggttacgtactagttttactacttgtactaacacgttacggtacgagggttccgccgggttcccgggacttaccgtttccgggacccgttagggaacccgtaaggttcggaacttacgaacgtaaacggtacgtacgggtacgtctacggtaacctaccgtacgttcctttacggttcttaccgtaccg

SEQ ID NO: 77201 - DNA, 744 bp, Homo sapiens
  misc_feature: GYAE6OF02FSV8I.8.34.D01.1.454.CMB.1.raw
  modified_base (322)..(322): a, c, t, g, unknown or other
  misc_feature (322)..(322): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagttttgggctgaactgggttttcctcgttgctctttttaagaggtgtccagtgtcaagtgcaactgggtggagtcgtgggggaggcggtggtccagcccgttggggaggtcagagagactctcggtgcgcacgtcctccgtgggttccaccgtttcacgtaactacggcagtcggacacggtcgggtcccncaagcctacccgagggccaaaggggtgttgggagtgggtgcgtagtttgttcagtctaggagggctaggttctagagttggattcgataacggaccgttaccggtagggaaccgggtccgtacgttcctaacccgtacttaccgtcccgtaaacggaacgtaaaccttacccgttaccggaaggttaaacctaacgtaaaggttcggtttaactttcgggaactaggtaccgtaaaacgtccgtaaaccctaaggtttacccggagggtaccgggaaccgtaccggggttacctaacgttaaccgttacggttaaggtaacccggtaaaggggggttaacccggggaccgtacgggtacgggttaacgttcccggtaacgttacccgttaccgttttacggtaccggttacgtacccggggg

SEQ ID NO: 77202 - DNA, 815 bp, Homo sapiens
  misc_feature: GYAE6OF02IC98Z.8.34.D01.1.454.CMB.1.raw
  modified_base (213)..(213): a, c, t, g, unknown or other
  misc_feature (213)..(213): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagactaccaccggagagattggtgttgacacaatctccagccaccctgtcttcgtctccgaagggaaacncgccaccctctccgtgcgacgggccagtcaagagtggttacggccgcctacgtactccgtaggtaccaacgacgaaaccgtggaccacggtcctccccgacggtcccctcattccgtagtcggtacgtacctacgtaccgaacgcgggtcccacggtcggaccaccgtcccgaacgtccgttacggttaccgagggtcggtacgtagggtacgggttagcggggaactacggtacccttacgaccttaccgtaccgaacctacgttccgtacctacgtaccggtaccccggttgggaccgtacccgggttaggtaaccggttacgttacgggttccgttaagtttaagggttttaactttccgtaaggttaaccctaacgtacgttaacccggtccgggtaccgggttacccgggtccccggttacccgggggttacccttaccgggtttacccgggtacccggtaacgggggttaaacccgtaaggtaccgggtaacttacccgtaaaacctaaaccggggttacgtaccgggtacgttacccgtaacggtccctaaaccggttccgttaccggttttactaccccgttcgtaacccccgg

SEQ ID NO: 77203 - DNA, 778 bp, Homo sapiens
  misc_feature: GYAE6OF02FYLZL.8.34.D01.1.454.CMB.1.raw
  modified_base (199)..(199): a, c, t, g, unknown or other
  misc_feature (199)..(199): n is a, c, g, or t
  modified_base (422)..(422): a, c, t, g, unknown or other
  misc_feature (422)..(422): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgtaacgtgggttttcctcggttgcttacttttaaggaggttgtccaggtgtacaaggtnccgaactgggtggagttcggtagggggaggcgtggtaccaggtccgtggggacgtccgacagacggtaccttcgtcgtggtcgcgacgtcccttgttcgggttccaccgtttcaagttaaccgtacggcctagtcgcgtacggtcgggtcccacgtacgtcctaccgaggacgtaaggggtgttcgggagggtcggggtcgtacgttaaggtttcgtttaacngttacggtggacgggtactaggttcgttacgtaagtgggtatcgacgtacgtaccgtacggtagggaacggtccgtacgttaaccaccgttagttacccgtacgtaacaaaccgtaaacctaaccggttaaccgaaacgtaccgtaaacgttaattaacggttaggttacggacgtaccgtaagtaactaccggtaactttaacggtcccggtaagaccgggtaacgtaccgggtaacgtacttaccgtacggttaggaacgggggtaagggtaaccgggtaaccgtacgggtcggttaacgttaccggaacgtttaccggttaccggtttacggtaccgggtccggttaccgggg

SEQ ID NO: 77204 - DNA, 822 bp, Homo sapiens
  misc_feature: GYAE6OF02JUL9I.8.34.D01.1.454.CMB.1.raw
  modified_base (358)..(358): a, c, t, g, unknown or other
  misc_feature (358)..(358): n is a, c, g, or t
  modified_base (425)..(425): a, c, t, g, unknown or other
  misc_feature (425)..(425): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttacttttaagaggtgtccagtgtcaagtcgactaactgggtggagtcgtgggggagcgtggtccaggccgtgggagtcacgtagacgacctctacggtgtagcacgtccttacgtgggttaccaccttcgaacgtaacctacggctatcgcctacgtcgggtacccaccaaggccttaccgaggtcgaaaggggtnttcgggacggtcggggtaggaccttaggttttcgttacacgttcggtaggacggggtactagggttntttaacgaagttcggtagtacggaccaggttaaccgtccgggtaacggggtaaaccggtccggtaaccgtttacccgaacccggttaagtaccccgtacggtaaacgggtaaccgtaaccttaaaaccggttaccccgggaaagtaaacctaaccgttaaaagtttacggtttaaacggtttaacgggacctttaaccggttaacgaaacccggtacgttacccgttaaagggtcccgtaacgggaaacgtacccgggtaacggtaacgttaacctaaccggttaggtacgggttaaaccggggaaggggtaacggaacccgtagggtaacccgggtaacgtttaccggaaacggttacctttaccgggttaccgacgggttacccggtaccggggg

SEQ ID NO: 77205 - DNA, 1056 bp, Homo sapiens
  misc_feature: GYAE6OF02G5R9A.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggtagtttgggctagaacgttgggttttcctcgttgcttacttttaaggaggttgtccagtgtacgaagtgacaacgtggtcggagttcggtgggggagcggtcggtaccaggccgtgggacggtcaacgaggagacttcgtcggtgtgacacgtccttacggttcgggttacccaaccgtttacgaaacggtttaaaaccgaccggtactaaggttccggtaaccgtaaccgggtttccgggggttacccccgaaccgtaaaacgggtccccgttaacccgggaacggggtacccggtaaaagggggggtttactttaggggggtaaacggggttttcggggggtaaccggtaacggttttacgggttttttaccgggttttaccaaacgggtttaccggttaacgggaacgggggttaccttaagggttttaaccggtttaacgtaaagggtttacggggttaagtaccggtaaaccgtaaccggttaacccggtttacccgggggttaagggtaaaaccgggggttccccttttaaacgttaccccgggttaaacccttaaccggtttaccccggtaaaccgtaaacgggggttaaaccctaaaccggttaaaaaccggttttaaccccgggaaaaagggttaaaacccgttaaacgtttaaaacgggtttacgggttttaaacggtttaacgggggaaccttaaaccgggttaccggtaaaaacccggttaccggttaaccgtttaaacggtttccccggtaaagggaaacgggttaaccccgggtacgggttaaccttaaacgttaaccgttacgggttaaacggaaacgggggtaacggggtaacggggtaacgtaccgggtacggtaaaccgttacgtaacggttccgttaacccggttagtaccggtacgggtaaccggg

SEQ ID NO: 77206 - DNA, 952 bp, Homo sapiens
  misc_feature: GYAE6OF02FLSPC.8.34.D01.1.454.CMB.1.raw
  modified_base (181)..(181): a, c, t, g, unknown or other
  misc_feature (181)..(181): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccagtggtagtttgggctagaacgttcggttttcctgttagtcttacgttttaaggnggttcgtccgtagttcgtaccgaagtcgactaacgtggtaggagttcgggtagggggacgtcggtcggtacccaggtccggtagggacgtcaagtacgtacgtaccgttcgtacgttggtcgacgtacgttccgttcgttcggtaccttccgttagaacgtaacgtacggactagacgtaccgacggttccggacccgaacacggtcctaaccggaggaacgggtaggtaacggttcggggaggttcgggtacgttcgtttacgggtttcctttaaaccggtagttccgggttaacggtaggtaccggtttagttaccggttaactacgggtttaggttaacgaccgggttaacgttaacccggttaccgggtacccggttaaaaccggggtcggttaacccgttaaccgttaaccccggacccggtttaaccgttaaccccgtaaccggttaaacgggtaacccgttaaccgtaaaacccggtttaacccggaaacggttaaaccgttaaaccgtttaagggttttaaacccgttttacgggttaaacgttaccgggtttaaccaaaccgggttccttaaaccgggttccgttaacgtaccggttaggtaaacccgggttaggttaaccggttaacgtaccgtaaccggttacccgggtaaggttaacccgggggtaaggggaacccggttacggtaaccgggtaaccgttaacggtaccggtttacggttacccgttacgggtaccgttacgggtaccggtaccccggg

SEQ ID NO: 77207 - DNA, 988 bp, Homo sapiens
  misc_feature: GYAE6OF02H32VQ.8.34.D01.1.454.CMB.1.raw
tcagctcgcgtgtccacgaccggtgctcgatttagatcgtctgtgttgggtcgtgggagaggagcccagcactagaagtcggcggtgtttccattcggtgatcagcactgaacacagaggactcaccatggtagtttgggctgtaacgttgggttttcctcgttgcttacttttaagaggtgtccagtgtacaagtgacaacgttggtaggagtcggtggggggaggtcggtggtccacggtccgtggggtacggtccacgaggaagtcctcgtcggttagtcgcgtacgtcctcggttcgggttacctacccgtttacaacggttaaccgtaccggactaacgttcggaccgttaaccggttccggggtacccggtaaccccgaaacggtaccccgttacccgggagggtaaccggtaaagggggtaacggtttggggtaagggggtttgggggtccgggactttaagggtttacgtttaccgaagttccggtacgggaacggggtaccgttaaggtttccgtttaagtaaggttttagggtaacgtacgggaaccttaaccggggttacccttaaccgggggtacgggtaaaacccgggggttcccgttaaaccgttaccccgttaaaccgtacccggttaccccgtaacccgaaggttaacccgtaaacggttaaccctaacccggtaaaaccgaaacccggttaaaccttaacggtttaacggtttaaaccggttttaacgtaacccgtaaacgtaaccccggttaaacaacccggttttaaccgaccgttagggaaccggttaaaccgggtacggttaacgttaaaccgtacgggttaacgttacgggtaaaccgggaaaggggggtccggggtaaaaccgggtccgggtaaccgggtttaacgttaaacccggtacggtttaccccggttaaccggtttaccgggacccgggtttaaccggggttaccgggggtaacccggg

SEQ ID NO: 77208 - DNA, 761 bp, Homo sapiens
  misc_feature: GYAE6OF02GR3CF.8.34.D01.1.454.CMB.1.raw
tcagctcgcgtgtccacgaccggtgctcgatttagatcgtctgtgttgggtttgggggaggaactgctcagttaggacccagagggaccatggaacgccccagctcagcttctcttcctcctgctactctggcctcccagtttacagactaccacggagagattgtgttgacacaatctccagccacctgtcttccgtacttaccggaaggggtaaacaccggtcctacccctctaccctgccgaggtcctagttacagtaaagttggttcgaccgtccgttacgtatccgtaggtaaccctaacgaactaaccgtggacccgaggtaccctaccccgaaccgtcccctacacgtactacggtacgtgacctacaccctaaggaccgcctacggtcgactacccggtaccacggcgtcggttaacgacggcggtaccgtaggttacgggacggtacgggaacctaaggttaccttacgacgttaccctaacggtccctaagttacctacgtccgtaacgtaccggtacggaacgttcgaccggagggttaaacttcggtacgttaaccggttagttttaacgtacgttactacgttaacccgaagtttaccgggaccgttacgggtcccgggtacccgtaccggtttaccgtaccgttttcccgggacgttaccgaacgggtaagtcgtacgttaactaacggtaacggtactcccggttagacgttacgactacggtccttagtttccgcttactaaccg

SEQ ID NO: 77209 - DNA, 708 bp, Homo sapiens
  misc_feature: GYAE6OF02HGPB9.8.34.D01.1.454.CMB.1.raw
  modified_base (156)..(156): a, c, t, g, unknown or other
  misc_feature (156)..(156): n is a, c, g, or t
  modified_base (222)..(222): a, c, t, g, unknown or other
  misc_feature (222)..(222): n is a, c, g, or t
tcagctcgcgtgtccacgaccggtgctcgatttagatcgtctgtgttgggtctgggagaggagcccagcactagaagtcggcggtgttccattcggtgatcagcactgaacacagaggactcaccatcggagtttgggctgaactggggttttccncgttgcttcgttttaagaggtgtccaggtgtcaaagttgacaactgggtggagtcgtggggggacncgtagggtccagccgtggggacggttcacaggaagtctctacgtgtagctagcctgtcggtcacttcacgtaactacgggctacgtgacctacgtccggggtaccaccgtaagtcctaccgagggaccgaagggtagttgggtaacggtgggtacgggactagggtttgttacgacggtcgtaagggcggtagtaccggttgtaacgtaaggttcggtacttggaacctacggtacgtacggtacggaaacggtccgtaacttacccgattaccgtaccgtaacggaacgtacaacgttaccgaacgggaaaccacgtaacgtagttacgtacgggtacgtaacgtacgaacgtagaacccgttacgtaccgtaggtaacggaccgtacggtacctagtacgtagtacggtacggaacgggaaggggacccgagggtaccgtacggtactacgtaccgttacgtacggtcgtacgtcgggtaccgg

SEQ ID NO: 77210 - DNA, 982 bp, Homo sapiens
  misc_feature: GYAE6OF02IQ4HZ.8.34.D01.1.454.CMB.1.raw
tcagctcgcgtgtccacgaccggtgctcgatttagatcgtctgtgttgggtctggagaggagcccagcactagaagtcggcggtgtttccattcggtgatcagcactgaacacagaggactcaccatggagtttgggctgaacttgggttttcctcgttcgcttacgttttaaggaggtcgtacctagtgtacaaagtgacaacgtggtaggagtcgtgggggacgtcgtggtccaggccgtgggacgtcacgtagagtacctcgtcgttgtgcacgtccttgttgggttccacctttcgaacgttaaccgtcggctaagtcgacctacggtcgggtcccgacgtaacgtccgtaccgaagggtacgaagggtacttggggaaggttcgggtcgaccgtttaggtttgttaccacgttcgtagggacggggttactaggtttaccgttaagtaacggttggttactacggttaccgaaccggttaacccgttccgggggtaaggggtaaacccgggttacccttaacgtttacccgaaccccttaacggttacccttaacccggaaaagggttaacccgtaaaccgtttaaaaccggttaccccgaaaaggttaaacccgtaaaccggttttaaaggtttcccgttttaaagggtttcggaacggttaacccgtttaaagggaaccccgttaaaccgggtttaccccgtttaaaacgggttcccggttaaaagggtaacccgggttaaacccggggttaaacggggtttaccctttaaaaaccggtttacccgggtttaaccgggtaaacgggggttaaacccgggggtaaaaccggggggggttaacccggggtaaacccgggttaaagggttaaccccggggttttaacggaaacccccggttttaaacggggtttttcccccggttttaaccgggtttaaacggggttacccggtttaacccgggggtttacccggggg

SEQ ID NO: 77211 - DNA, 1083 bp, Homo sapiens
  misc_feature: GYAE6OF02HRKKD.8.34.D01.1.454.CMB.1.raw
  modified_base (254)..(254): a, c, t, g, unknown or other
  misc_feature (254)..(254): n is a, c, g, or t
tcagctcgcgtgtccacgaccggtgctcgatttagatcgtctgtgttggggtttgggggaggaactgctcagttaggacccagagggaccatggaagccccagctcagcttctcttcctcctgctactctggctccctagtttcagatacccaccggagagagtttgtgttgaactacaacttctaccgacgccctaccctgtccttacgtcctaccgaaagggggtaaagccgaccctaacccctcgttcccngacgacgggcctacgtcaaggtaacgttgttacggccgtacttacgtacgtaccgtacggtaaacccaacggtaaagaaacccgttggacccgacgtaccgtacccccgacggtaccccctcgaacttaccgtaagttcgggtacaccgtaaccgtaaccccgaaacggacccgggtaccaaccgggttcgaaaccccgtaaccggttaccccggaacgggttaacccggttacgggtttaaccgaacggggttaccgggtaaccgggttaagggggtttaccgggggtaacgttaacggggggtaacctaaaacggttaccccggtttacctaaacccgggttaccccttaaacccggaacccttttaaaaccgacccttaaaacgtttccccgaaacgggttacccggttaacgggggtaaccggccccggtttaagggtaaacgggtttacgttaacggggtttaacgtttaaccggttttaaacggttttttaaccgtaaccgggttttaacggtaaacccctaaacgggtttaacgggtttaaccccgggtttacccggggtaaacgggtttaaccccgggggttccccggggtttaaccccgggggtaacccgttttaaccccggggttttccgggggtaaacccccgttaaccgggggtaaaaaaccggtacccgggtttaacgggtaaacgtttacccgggttaaaacccgggtaaaaccgtcggggttttaacgtaaaccggggtacccgttacggtaaccccccgttaacgttaggttaccccccggtttagtttaccccggtttaattaccccccggg

SEQ ID NO: 77212 - DNA, 862 bp, Homo sapiens
  misc_feature: GYAE6OF02IWDV2.8.34.D01.1.454.CMB.1.raw
  modified_base (252)..(252): a, c, t, g, unknown or other
  misc_feature (252)..(252): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaaggaggtgtccagtgtcaagtgcaactggtggagtcgtgggggagcggtggtccagccgtgggaggtcacagagactctcgtgngcacgcctcgtcgggttccaccttcgaagttaaaccgtcggcagttcgacctacgtcggggtcccgacccaaggcccttaccgacggggacccgaaaggggtcgtttaggggacgggtttcgggggtaggtccgtttaagggtttccgttttacgaaggttccgtaggggtacggggtacctagggtttacggtttaacgtaaaggtttggggttaacttacgggaccggtaaacggtaacccggttttacccggggacggggtaaacccgggggtcccggttaaacgtttaccccgaaaccgttaccgtaccgttacccggaaaggtaaccggtaaacttaaaccgtttacccgaaacggaaacctaaaacgtagtttaagttagttacggggactacgttaacgaaactacccggtacccgtaacggttccgtaacggggaacggtaccggtaaccgggttaccgtacgttaacccgttacggtaacggtaaacccggggtaaagggggacccgggggtaaccggtaacgggtacggggttaacccgttaccggtaacggtttacccgttaccggttttaccgggaccggttacccggggtacggggg

SEQ ID NO: 77213 - DNA, 744 bp, Homo sapiens
  misc_feature: GYAE6OF02FOI20.8.34.D01.1.454.CMB.1.raw
  modified_base (231)..(231): a, c, t, g, unknown or other
  misc_feature (231)..(231): n is a, c, g, or t
  modified_base (300)..(300): a, c, t, g, unknown or other
  misc_feature (300)..(300): n is a, c, g, or t
tcagctcgcgtgtccacgaccggtgctcgattttagatcgtctgtgttgggtttgggggaggaactgctcagttaggacccagagggaaccatggaagccccagctcagcttctcttcctcctgctactctggactcctagtttcagactaccacggagagtacgttgttgttgacacgaatcctaccaggccccaccgttgttaccttcgtccgtaccggaaggggaaanccggtacccacccttctccctgtacgacgggcctacggacagttaagtggtcggtccgaccgtagtacncgtacgtaaccagaacgtaactcggacgcggaccgtaccccggacggtcccctaagtccttactacggtacgtcgtacctaccgtaccgacggttaccggggaccaaccggtcggacacccgtaccgacggtactcggtaccgaggtccgggtataggggtacgggttaggaacgggtacgacggtacttaccaacgttcttaccgacctttacgcaaccgttcgaccgttcgtacgacgttcgtaacggtagtacggttcgtacggttacgtttaagtttgttaacccgttacttagtaaaccgctttaccggagttcggaccgggttcccggtaccggtaccgtttacggtcccggtacgtacggtaacgtgaacgttcgtaacgtacggtaacgacgttcgggactacgtcgactccgtagttccgtacttcgtactcccg

SEQ ID NO: 77214 - DNA, 762 bp, Homo sapiens
  misc_feature: GYAE6OF02HJ0EP.8.34.D01.1.454.CMB.1.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctggaacttgggttttcctcgttgtcttcttttaaggaggttgtcctagtgtacaaggtgacaactgggtggagtcgtgggggagcgtggtccaggccgtgggagtcacgagacgactctcgtgtgcacggtccctcgttgggttacctaccctttacgaacggttaaacctaccggcctagttacggaccgtacgttcggggtaccccaccgtaaccggccttacccggaggaaccggtaaggggacgttggggagggttacggggtggtactagggtttttacttaccgtagttccggtaggaccgggggtacttaggttcggttacgaaggttcggtagtacgtcgtacggacgttccggtaagggaaccgggtcctaagttaccctacctaagttcccacgtagactaaccgtaacctaccgaaacggaacctaacgtaagttacgttaacgttcgggtaaaccctagaaccgtaacgttaacccgtaacggttaccgtaggaacggttaccgtacgggtattaactaccgtacgttacgggaacgggaacgggacgggaaccgtgggaacggtacgtacgttacgtacgtttaccgtagtcggttacgacgggtaccgg

SEQ ID NO: 77215 - DNA, 895 bp, Homo sapiens
  misc_feature: GYAE6OF02FKE6U.8.34.D01.1.454.CMB.1.raw
  modified_base (58)..(58): a, c, t, g, unknown or other
  misc_feature (58)..(58): n is a, c, g, or t
tcagctcgcgtgtccacgaccggtgctcgatttagatcgtctgtgttggggtctgggngaggagcccagcacctagaagtcgcggtgtttccattcggtgatcagcactgaacacagaggactcaccatggagtttgggctgaactgggttttcctgttgcttcttttaagaggtgtaccagtgtaccaagtgctaacgtggtaggagtcgtgggggagcgtacggcagccgtgggaggtcacaggacacttcgtcgtggtcgcgtacgcccgttacgttacggggttccctaaccccgtttccgaaaggttaacccgttaaccgggccttaacgttacggtaaccggttcggggttaccccgaccgttaaacggtccgttacccgaagggtcgtaaaagggtcgtttacggggaagggttcggggtgtacccgttaacggtttgtttaacgaccgtcggtggaacgggtcttaacggtgttaccgtaaagttcgggtaacttcggaacgttacggtaccggtacggtacggtaaccggggacctacgtttaccgaacctacgtaccgaccgtaagaacgaaaccgtaacgtaacccgtaaacggaaaccgaaccttaaagtttacggttaaccgtttacggtaacccgtaacggtaaacccgtacgttaacccggttaaaggttacccggtaaggttaacgggtaaccggttaacgggttaacgttaaaccggtttaacgtaaccggtttacggttaacccggggaaacggggtaacgggggaaacccgtacgggttaaccgggttaaccgttaacccggttaaaggttacccgtttacccggtttaaggggtaccccgtttcgggtaacccggggttaccggttaaccccggg

SEQ ID NO: 77216 - DNA, 875 bp, Homo sapiens
  misc_feature: GYAE6OF02IY94K.8.34.D01.1.454.CMB.1.raw
  modified_base (283)..(283): a, c, t, g, unknown or other
  misc_feature (283)..(283): n is a, c, g, or t
tcagctcgcgtgtccacgaccggtgctcgatttagatcgtctgtgttgggtctgggagaggagcccagcactagaagtcggcggtgtttccattcggtgatcagcactgaacacagagactcaccatggagtttgggctgaacttgggttttcctcgttgcttcttttaagagtgtcagtgtcaagtgcaacgtggtggagtcgtgggggagcgtggtccagccgtgggagtccacgagagactcgtcgtgtgcgagtcccgtgttcgggttactacccttanacgtaaccgtaccggcagtccgacgtaacgtcgggtacccgacccgaaacggtccctaccggacgaccggtaaacggggtattacgggggtacggttagggggttcggtacgttacggttttacggttttaccgacgtttacggtagggtaccggggtaccttaagggtttacggtttaccgtaaggtttacggggtttaacgtacgtaccggtaacgttacccgggttaacccggggttaacgggtaaacccggggtacgtttaccggttttaacccgaacccgttaacgtttacccgtaacccggaaggtaaacccgtaaaccgttaactaacccggtaaagggtaaacctaaccgtaacggtttaaaccgtttacggttaaccgggtaacctaacggaacgtaacgtacccgttaacggtaccgtacggtaacggtaccgggtaacggtacgttaagtaccgttacggtacgaaccggggtaacggggaacggggtaacggtaccgggtaacgggtaaccgttaccggtaacgggttacccttaccgggtttacgggttaacccggtaccgggttccgggttaaccggg

SEQ ID NO: 77217 - DNA, 824 bp, Homo sapiens
  misc_feature: GYAE6OF02JOVOR.8.34.D01.1.454.CMB.1.raw
  modified_base (105)..(105): a, c, t, g, unknown or other
  misc_feature (105)..(105): n is a, c, g, or t
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
  modified_base (595)..(595): a, c, t, g, unknown or other
  misc_feature (595)..(595): n is a, c, g, or t
  modified_base (603)..(603): a, c, t, g, unknown or other
  misc_feature (603)..(603): n is a, c, g, or t
  modified_base (646)..(646): a, c, t, g, unknown or other
  misc_feature (646)..(646): n is a, c, g, or t
  modified_base (764)..(764): a, c, t, g, unknown or other
  misc_feature (764)..(764): n is a, c, g, or t
tcagctcgcgtgtccacgaccggtgctcgatttagatcgtctgtgttgggtcgtgggagaggagcccagcactagagtcggcggttgtttccattcggtgatcancactgaacacgagagactcaccagtggagtttcgggccttagtaccgttgggttttcccttcggttgccgtttagtttttaaggaggttcgaccgtagttacgtcctaagttcgtaccaacgttgggtagggtagttcgggttagggggaccggtccggttccggtccacggtccggtaaggggtcggtaccaaccgggtaggtaacgtaccttcggtcggttgacccggtcaacggttccttccggttggggttacccttaccgttacgaaaggttaccaccgggtcacttggtacccggacttaccggggttcccaacgtagaccccttaccgacggtacgtaaagggtccggttagggtaggggtcggttcggaaccgttgttttgtttacccngttcggnggacgggtacttaggttattcgtaaggtttcgacgttacggtacaacgttggtaacccggtggtaacggtacgttccttaacgctnacccgtanacgtactaacttaagaccgttaacgacgtaacgtagttagttnttaaggaaccttcggtaaaaccggtacctaacgtttaccggtcggaacggtacggttaacggacttaaccgaagtttcgcggtttaaacggagggggtaacccgggtagtaacccggnggtaccgggtaacttccggttaacggtccttaaccggttcgggtagtacccgggtttagg

SEQ ID NO: 77218 - DNA, 753 bp, Homo sapiens
  misc_feature: GYAE6OF02G5J1H.8.34.D01.1.454.CMB.1.raw
  modified_base (192)..(192): a, c, t, g, unknown or other
  misc_feature (192)..(192): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaaggaggtgtccagtgtacaagtnacaacgtggtggagtcgtgggggagcgttgactccgagccgtgggacggtccactaggagtacctcgtcgtgtcgacgacgtcccgtcgttcggggttcctaacccgttaccgaaacgttaaaccgtaaccggcctaacgtcgaccgtaccggttcggggtaccccggaccgaaacgtcccctaaccggtaacggccgaaaagggtacgttagggaggtcggggtaggtctaacggtttagttccgagttaccggtagggaggaccgtaaggttcgttaacgtaaaggttcggtactgaccgtaacgtacccggttaccggtagggaaacggggtccctaaagttacccgaaccttacgtacctaaccgaacgtaacaacgtaccgttaccaacggtaaacaacgtagttacgtagttacgaggtctaacgacgacgtacctacgctagcgtaacgacggtagtaactacgttacgacgggtaacggtaaggggaaaccgggtacgagggtaccggtaacgttacggaaccgtttacgtacggttaccgtaggtacccggg

SEQ ID NO: 77219 - DNA, 430 bp, Homo sapiens
  misc_feature: GYAE6OF02F3JB1.15.77.G11.1.454.CMB.1.raw
  modified_base (422)..(430): a, c, t, g, unknown or other
  misc_feature (422)..(430): n is a, c, g, or t
tcagtctacgtagccacgaccggtgctcgatttagctagtcactcaagggaaagggactggagtggataggctatatccgcttcactgggagcaccaactacaacccctccctcaagagtcgactcaccatatctttagacacggccaacaaccagttctccctgaggctcagctctgtgaccgccgcagacacggccgtctattactgcgcgagacggagggtagacggtgaccggggctcgtttgactactggggccaggggaatccgtggtcaccgtctcctcggcctccaccaagggcccatcggtcttccccctggcaccctcctccaagagcacctctgggggcacagcggccctgggctgcctggtcaggactacttccgctacgtagactgagcgggctggcaaggcgcatagnnnnnnnnn

SEQ ID NO: 77220 - DNA, 437 bp, Homo sapiens
  misc_feature: GYAE6OF02F888B.15.77.G11.1.454.CMB.1.raw
  modified_base (338)..(338): a, c, t, g, unknown or other
  misc_feature (338)..(338): n is a, c, g, or t
  modified_base (427)..(435): a, c, t, g, unknown or other
  misc_feature (427)..(435): n is a, c, g, or t
tcagtctacgtagccacgaccggtgctcgatttagctagtcactcaagggaaagggactggagtggataggctatatccgcttcactgggagcaccaactacaacccctccctcaagagtcgactcaccatatctttagacacggccaacaaccagttctccctgaggctcagctctgtgaccgccgcagacacggccgtctattactgcgcgagacgggagggtagacggtgaccggggctcgttgactacgtggggccagggaatccgtggtcaccgtctcctcggcctccaccaagggcccatcggtcttccccctggcacccctcctccaacgngcacctcgtgggggcacagccggccccgtgggctgcctggtcaaggactacttccgctacgtagactgagcgggctggcaggcgcatgnnnnnnnnncc

SEQ ID NO: 77221 - DNA, 444 bp, Homo sapiens
  misc_feature: GYAE6OF01EDYZO.24.70.G04.1.454.CMB.1.raw
  modified_base (342)..(342): a, c, t, g, unknown or other
  misc_feature (342)..(342): n is a, c, g, or t
  modified_base (430)..(444): a, c, t, g, unknown or other
  misc_feature (430)..(444): n is a, c, g, or t
tcagactactatgtcacgaccggtgctcgatttagtgtagtgtgaagggaagggacgtggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtgatggggcagctcgtggggacaacgtggttcgaccccgtggggccagggaaccctggtcctccgtctcctcagcctccaccaaggcccatcggtcttccccctggccgccctgctccaggngcacctcgagagcacagcggcctgggctgcctggtcaaggctacttccacatagtagtctgacgcgggctgggacaggcgacatacgnnnnnnnnnnnnnnn

SEQ ID NO: 77222 - DNA, 442 bp, Homo sapiens
  misc_feature: GYAE6OF01EW1PJ.24.70.G04.1.454.CMB.1.raw
  modified_base (435)..(442): a, c, t, g, unknown or other
  misc_feature (435)..(442): n is a, c, g, or t
tcagactactatgtcacgaccggtgctcgatttagtgtagtgtgaagggaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtggatgggcagctcgtggggacaactggttcgacccctggggccagggaaccctggtctccgtctcctcagcctccaccaagggcccagtccggtccttccccctggccgcccctgcctccaggacgcaccctccgagacgcacagcggccctgggctgcctggtcaaggactactccacatagtagtctgacggcggctggcgaaggcgcatagnnnnnnnn

SEQ ID NO: 77223 - DNA, 442 bp, Homo sapiens
  misc_feature: GYAE6OF01A3QGY.24.70.G04.1.454.CMB.1.raw
  modified_base (415)..(415): a, c, t, g, unknown or other
  misc_feature (415)..(415): n is a, c, g, or t
  modified_base (433)..(442): a, c, t, g, unknown or other
  misc_feature (433)..(442): n is a, c, g, or t
tcagactactatgtcacgaccggtgctcgatttagtgtagtgtgaagggaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtggatgggcagctcgtggggacaactggttcgacccctggggccagggaaccctggtctccgtctcctcagcctccaccaacgggcccatcggtccttcccctggccgccctgctccaggacgcacctccgagacgcacagccggccctgggctcgcctggtcaaggactaccttcacatagtagtctgagcgggntggacaagggcacatagnnnnnnnnnn

SEQ ID NO: 77224 - DNA, 510 bp, Homo sapiens
  misc_feature: GYAE6OF01CFLW7.24.70.G04.1.454.CMB.1.raw
  modified_base (364)..(364): a, c, t, g, unknown or other
  misc_feature (364)..(364): n is a, c, g, or t
  modified_base (483)..(483): a, c, t, g, unknown or other
  misc_feature (483)..(483): n is a, c, g, or t
  modified_base (485)..(486): a, c, t, g, unknown or other
  misc_feature (485)..(486): n is a, c, g, or t
  modified_base (488)..(510): a, c, t, g, unknown or other
  misc_feature (488)..(510): n is a, c, g, or t
tcagactactatgtcacgaccggtgctcgatttagtgtagtgtgaagggaagggactggagtggataggggctgtctatcatatcgggaacaccttttacaatccgtccctcgagagtcgactctccatatccattgacacgtccaagaatcagttctcgttgaggctgcactctgtcacggccgcggacacggtccgtttatttctgcgcgagagtggggtggatgggcagcgtcggtggggacaacgtggttccgaccccgtggggccacgggaccctggtctccgtctcctcacgccctccaccgaacgggccccagtccggtccctttcccccgtggcccgccctcgcctaccgaggacnccacccgtccgagacgccacgacgccggccgtgggctcgccgtggaccgaaggtaccttacgttaccatagtacgtagtcgtaggacggcgggtcgtcggacgaacggcgtacagtagngnncnnnnnnnnnnnnnnnnnnnnnnn

SEQ ID NO: 77225 - DNA, 478 bp, Homo sapiens
  misc_feature: GYAE6OF01A6HB5.24.70.G04.1.454.CMB.1.raw
  modified_base (286)..(286): a, c, t, g, unknown or other
  misc_feature (286)..(286): n is a, c, g, or t
  modified_base (321)..(321): a, c, t, g, unknown or other
  misc_feature (321)..(321): n is a, c, g, or t
  modified_base (339)..(339): a, c, t, g, unknown or other
  misc_feature (339)..(339): n is a, c, g, or t
  modified_base (444)..(478): a, c, t, g, unknown or other
  misc_feature (444)..(478): n is a, c, g, or t
tcagactactatgtcacgaccggtgctcgatttagtgtagtgtgaagggaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatgggggtggatgggcagctcggtggggacaactggttccgaccctggggccagggaaccctggtctccgtcncctcacgcctcaccagggcccatccggtctccccnggccgcctgctccaggcncacctcgagagcacagccggcctggggctgccgtaggtacaaggacctacttccaactatagtagtccgtgacggtcgggcgtcggacgaaggcgctaatacggnnnnnnnnnnnnnnnnnnnnnnnnnnnnnnnnnnn

SEQ ID NO: 77226 - DNA, 472 bp, Homo sapiens
  misc_feature: GYAE6OF01BFAYB.24.70.G04.1.454.CMB.1.raw
  modified_base (351)..(351): a, c, t, g, unknown or other
  misc_feature (351)..(351): n is a, c, g, or t
  modified_base (454)..(472): a, c, t, g, unknown or other
  misc_feature (454)..(472): n is a, c, g, or t
tcagactactatgtcacgaccggtgctcgatttagtgtagtgtgaagggaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttattctgcgcgagatgggttgatgggcagctcggtgggacaactggtcgacccgtggggccaggaaccctggtctccgtctcctcagcctcccgaaccgaacgggccctacgtccggtccttcccccgtggccgccctggcctccgaggacncctaaccctcgagacgcaacgcgcgccgtgggctcgccgtgacaggactcttacacagtacgtcgtcgtgaggccgggctcgggacgaacggcgacagtacgnnnnnnnnnnnnnnnnnnn

SEQ ID NO: 77227 - DNA, 548 bp, Homo sapiens
  misc_feature: GYAE6OF01BQ276.24.70.G04.1.454.CMB.1.raw
  modified_base (503)..(503): a, c, t, g, unknown or other
  misc_feature (503)..(503): n is a, c, g, or t
  modified_base (507)..(510): a, c, t, g, unknown or other
  misc_feature (507)..(510): n is a, c, g, or t
  modified_base (512)..(513): a, c, t, g, unknown or other
  misc_feature (512)..(513): n is a, c, g, or t
  modified_base (515)..(516): a, c, t, g, unknown or other
  misc_feature (515)..(516): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (523)..(540): a, c, t, g, unknown or other
  misc_feature (523)..(540): n is a, c, g, or t
  modified_base (542)..(548): a, c, t, g, unknown or other
  misc_feature (542)..(548): n is a, c, g, or t
tcagactactatgtcacgaccggtgctcgatttagtgtagtgtgaagggaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagagtgggggtgatgggcagctcggtggggacaacgtggttcgaccccgtggggccagggaaccctggtctccgtctcctcagcctccaccaagggccccagtccggtccttcccccgtggccgcccctgcctccgaggacgccacccgtccgagacgccacgacggcccggccccgtgggcctcggcccgttagggtaccgaaagggtcccttaaccgtttcccaacgtagttacggttacgttcctggaacgggccggggctgggaccgaaacgggccgacaagtacggnacgnnnngnngnngngngcnnnnnnnnnnnnnnnnnncnnnnnnn

SEQ ID NO: 77228 - DNA, 558 bp, Homo sapiens
  misc_feature: GYAE6OF01DEWH9.24.70.G04.1.454.CMB.1.raw
  modified_base (358)..(358): a, c, t, g, unknown or other
  misc_feature (358)..(358): n is a, c, g, or t
  modified_base (517)..(517): a, c, t, g, unknown or other
  misc_feature (517)..(517): n is a, c, g, or t
  modified_base (520)..(526): a, c, t, g, unknown or other
  misc_feature (520)..(526): n is a, c, g, or t
  modified_base (528)..(539): a, c, t, g, unknown or other
  misc_feature (528)..(539): n is a, c, g, or t
  modified_base (541)..(551): a, c, t, g, unknown or other
  misc_feature (541)..(551): n is a, c, g, or t
  modified_base (553)..(558): a, c, t, g, unknown or other
  misc_feature (553)..(558): n is a, c, g, or t
tcagactactatgtcacgaccggtgctcgatttagtgtagtgtgaagggaagggactggagtggataggggctgtctatcatatcgggaacaccttttacaatccgtccctcgagagtcgactctccatatccattgacacggtccaagaatcagttctcgttgaggctgcactctgtcacggccgcggacacggtccgttttattcgtgcgcgagacgtgggggtgagtggggcaggcgtcgggtggggaccaaacgtcgggttccgaccccgtggggccaaggggaaccctgggtcctccgtactccctcgacgcctccaaccgaacggccccacgttccggttcccgtttccccnggcccacccgtgacctcccggaggactaccaccgtacgacgacgccaacgacggcccggtaccgtgggactcggaccgtttaggaccaaggtaccttcctacgactaagttagtacgtctagggacgcgggtagtcgaacggaaggcgacgtaatcggnagnnnnnnngnnnnnnnnnnnncnnnnnnnnnnncnnnnnn

SEQ ID NO: 77229 - DNA, 604 bp, Homo sapiens
  misc_feature: GYAE6OF01EJZFA.24.70.G04.1.454.CMB.1.raw
  modified_base (209)..(209): a, c, t, g, unknown or other
  misc_feature (209)..(209): n is a, c, g, or t
  modified_base (369)..(369): a, c, t, g, unknown or other
  misc_feature (369)..(369): n is a, c, g, or t
  modified_base (570)..(570): a, c, t, g, unknown or other
  misc_feature (570)..(570): n is a, c, g, or t
  modified_base (573)..(604): a, c, t, g, unknown or other
  misc_feature (573)..(604): n is a, c, g, or t
tcagactactatgtcacgaccggtgctcgatttagtgtagtgtgaagggaagggactggagtggatagggggctgtctatcatatcgggaacaccttttacaatcccgtccctcgagagtcgactctccatatccattgacacgtccaagaatcagttctcgttgaggctgcactctgtcacggccgcggacacggtccgttttattcngcgcgagagtggggtgagtgggcaggcgtcgggtagggacctaacgttcgggtcccgaccccggtgggggacccgaacgggtaccccttggtcccttcccgtcctcctcaccgccctaccgaaccgacggccctacgttcccggtcccctttcccccggnggccccgtccccgtcgcccgtaccggacgggaccgtaccccgacccgtaccggaagaccgaccaccgaccgggcccggtcccgtcggggcccttccggaccgttaggaaccgaaccggtaccttacccgtaccaacttaagttacggttagttcggtagggcgggtccgggtacgtacgggaacgacgggctagaagtcgnacnnnnnnnnnnnnnnnnnnnnnnnnnnnnnnnn

SEQ ID NO: 77230 - DNA, 599 bp, Homo sapiens
  misc_feature: GYAE6OF01BJFQU.24.70.G04.1.454.CMB.1.raw
  modified_base (215)..(215): a, c, t, g, unknown or other
  misc_feature (215)..(215): n is a, c, g, or t
  modified_base (351)..(351): a, c, t, g, unknown or other
  misc_feature (351)..(351): n is a, c, g, or t
  modified_base (556)..(556): a, c, t, g, unknown or other
  misc_feature (556)..(556): n is a, c, g, or t
  modified_base (563)..(563): a, c, t, g, unknown or other
  misc_feature (563)..(563): n is a, c, g, or t
  modified_base (569)..(571): a, c, t, g, unknown or other
  misc_feature (569)..(571): n is a, c, g, or t
  modified_base (573)..(578): a, c, t, g, unknown or other
  misc_feature (573)..(578): n is a, c, g, or t
  modified_base (580)..(581): a, c, t, g, unknown or other
  misc_feature (580)..(581): n is a, c, g, or t
  modified_base (583)..(583): a, c, t, g, unknown or other
  misc_feature (583)..(583): n is a, c, g, or t
  modified_base (585)..(588): a, c, t, g, unknown or other
  misc_feature (585)..(588): n is a, c, g, or t
  modified_base (590)..(591): a, c, t, g, unknown or other
  misc_feature (590)..(591): n is a, c, g, or t
  modified_base (593)..(599): a, c, t, g, unknown or other
  misc_feature (593)..(599): n is a, c, g, or t
tcagactactatgtcacgaccggtgctcgatttagtgtagtgtgaagggaagggactggagtggataggggctgtctatcatatcgggaacaccttttacaatccgtccctcgagagtcgactctccatatccattgacacgtccaaagaatcagttctcgttgaggctgcactctgtcgacggccgcggaccacggtccgttttattcgtgcgngagagtggggtgagtgggcagcgtcgggagggaacacgttggttccgacccgtggggccagggaccctggtcctccgtcctcctcgactccctacccgaaccgaccggccctacgttccggtccctttcccccggngggcccgtccccgtcgcctaccgaggaccgtccgaccgtcgaacggccaccgtaccgccgggcccggtccgtacgggccgttcggaacccggttggtaaccaacggtacccgtttacctaccctaagtacgtaaggtttcgacggttaggaccgggtcggggtacgtacgggacggaacggccacgaagtagcgtcgatcagtcngtcagtnacggcnnncnnnnnngnntngnnnncnncnnnnnnn

SEQ ID NO: 77231 - DNA, 425 bp, Homo sapiens
  misc_feature: GYAE6OF02IQA3I.24.70.G04.1.454.CMB.1.raw
  modified_base (420)..(425): a, c, t, g, unknown or other
  misc_feature (420)..(425): n is a, c, g, or t
tcagactactatgtcacgaccggtgctcgatttagtgtagtgtgaagggaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtggatggggcagctcgtggggacaactggttcgacccctggggccagggaaccctggtctccgtctcctcagcctcaccaagggccatcggtctcccctgcgccctgctccaggagcacctccgagacgcacagcggccctgggctgcctggtcaaggactactccacatagtagtctgagcggctggcaaggcgcatagnnnnnn

SEQ ID NO: 77232 - DNA, 535 bp, Homo sapiens
  misc_feature: GYAE6OF02I1A2R.24.70.G04.1.454.CMB.1.raw
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (516)..(535): a, c, t, g, unknown or other
  misc_feature (516)..(535): n is a, c, g, or t
tcagactactatgtcacgaccggtgctcgatttagtgtagtgtgaagggaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatgggttggatgggcagctcgtggggacactggttcgacccctggggccagggaaccctggtctccgtctcctcacgcctccaccaagggccccatccggtccttcccccgtggccgccccgtgcctccgaggacgccaccgtccgagacggcacgacggccggccccgtgggggcctcggcccgttgggtaccgaaacgggtacccttaaccgttccccaacctacgttaacggttaacgttccgttaggaacgggccggggtcgtacggggaccgaagggccgacgtagtacggngngacnnnnnnnnnnnnnnnnnnnn

SEQ ID NO: 77233 - DNA, 574 bp, Homo sapiens
  misc_feature: GYAE6OF02ILUE5.24.70.G04.1.454.CMB.1.raw
  modified_base (336)..(336): a, c, t, g, unknown or other
  misc_feature (336)..(336): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
  modified_base (542)..(543): a, c, t, g, unknown or other
  misc_feature (542)..(543): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (555)..(559): a, c, t, g, unknown or other
  misc_feature (555)..(559): n is a, c, g, or t
  modified_base (561)..(574): a, c, t, g, unknown or other
  misc_feature (561)..(574): n is a, c, g, or t
tcagactactatgtcacgaccggtgctcgatttagtgtagtgtgaagggaagggacgtggaggtggataggggcgtgtctatcatatcgggaacaccttttacaatccgtcctcgagagtcgactctccatactccattgacacgtccaagaatcagttctcgttgaggctgcactctgtcaccggcgcggacacggccgtttattctgcgcgagagtgggggtgagtggggcaggctcggtaggggacacgtggttccgacccgtggggccaggacctggtctccgtctccgtcagcctccaccgtaacgggcccactccgggtccttcccccgnggtaccgtcccctacgcctaccgtcggactccgacccgttcgaacgcgaccgactaccggccgcccgtggggcctacgcccggttgggtaacccaacgggtctaacccgtttccaaacgtcgttaacggtcgtcgtgtacggcgggtccttcgggacaacgggtcacgacggttaacgcgtagctcggactggtnancgngcgcgnngncncgcncngnnnnngnnnnnnnnnnnnnn

SEQ ID NO: 77234 - DNA, 522 bp, Homo sapiens
  misc_feature: GYAE6OF02I2Q27.24.70.G04.1.454.CMB.1.raw
  modified_base (334)..(334): a, c, t, g, unknown or other
  misc_feature (334)..(334): n is a, c, g, or t
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
  modified_base (492)..(522): a, c, t, g, unknown or other
  misc_feature (492)..(522): n is a, c, g, or t
tcagactactatgtcacgaccggtgctcgatttagtgtagtgtgaagggaagggactggagtggataggggctgtctatcatatcgggaacaccttttacaatccgtcctcgagagtcgactctccatatccattgacacgtccaaagaatcagttctcgttgaggctgcactctgtcacggccgcggacacggtccgttttatttctgcgcgagagtggggtggatgggcagctcggtggggacaacgtcggttcgaccccgtggggcccagggaacccctggtcctccgtctcctcagcctccacaacgggcccattcggtccttcccccgnggcctcccgtgcctccaggacncctacctcgganacgccacgacgccggcccgtgggcctacgcccttagggtaacaaacggtaccttaccttacccaactaagtacgtttacgtctaggacgggtcggggactgggacgaaaggccgataactaggnnnnnnnnnnnnnnnnnnnnnnnnnnnnnnn

SEQ ID NO: 77235 - DNA, 183 bp, Homo sapiens
  misc_feature: GYAE6OF01BC2PW.18.33.C11.1.454.CMB.1.raw
  modified_base (169)..(183): a, c, t, g, unknown or other
  misc_feature (169)..(183): n is a, c, g, or t
tcagtacgagtatgcacgaccggtgctcgatttagagtgagctcgttgggttgggaagaggaagactgacggtcccaggagttcaggtgctgggcacagtccggcctgggctgcctggtcaaggactacttcccatactcgtactgagcgggctggcaaggcgcatagnnnnnnnnnnnnnnn

SEQ ID NO: 77236 - DNA, 171 bp, Homo sapiens
  misc_feature: GYAE6OF01CIVST.18.33.C11.1.454.CMB.1.raw
  modified_base (171)..(171): a, c, t, g, unknown or other
  misc_feature (171)..(171): n is a, c, g, or t
tcagtacgagtatgcacgaccggtgctcgatttagagtgagctcgttgggtttggggaagaggaagactgacggtccccaggagttcaggtgctgggcacagcggccctgggctgcctggtcaaggactacttcccatactcgtactgagcgggctggcaaggcgcatagn

SEQ ID NO: 77237 - DNA, 172 bp, Homo sapiens
  misc_feature: GYAE6OF01ARFO5.18.33.C11.1.454.CMB.1.raw
  modified_base (170)..(172): a, c, t, g, unknown or other
  misc_feature (170)..(172): n is a, c, g, or t
tcagtacgagtatgcacgaccggtgctcgatttagagtgagctcgttgggtttgggaagaggaagactgacggtccccaggagttcaggtgctgggcacagcggccctgggctgcctggtcaaggactacttcccatactcgtactgagcgggctggcaaggcgcatagnnn

SEQ ID NO: 77238 - DNA, 176 bp, Homo sapiens
  misc_feature: GYAE6OF01CYVX7.18.33.C11.1.454.CMB.1.raw
  modified_base (172)..(176): a, c, t, g, unknown or other
  misc_feature (172)..(176): n is a, c, g, or t
tcagtacgagtatgcacgaccggtgctcgatttagagtgagctcgttgggtttgggggaagaggaagactgacggtccccaggagttcaggtgctgggcacagcggccctgggctgcctggtcaaggactacttcccatactcgtactgagcgggctggcaaggcgcatagnnnnn

SEQ ID NO: 77239 - DNA, 171 bp, Homo sapiens; identical to SEQ ID NO: 77236
  misc_feature: GYAE6OF01A9IW4.18.33.C11.1.454.CMB.1.raw
  modified_base (171)..(171): a, c, t, g, unknown or other
  misc_feature (171)..(171): n is a, c, g, or t

SEQ ID NO: 77240 - DNA, 174 bp, Homo sapiens
  misc_feature: GYAE6OF01DYTFM.18.33.C11.1.454.CMB.1.raw
  modified_base (173)..(174): a, c, t, g, unknown or other
  misc_feature (173)..(174): n is a, c, g, or t
tcagtacgagtatgcacgaccggtgctcgatttagagtgagctcgttgggtttgggggaagaggaagactgacggtcccccaggagttcaggtgctgggcacagcggccctgggctgcctggtcaaggagtacttcccatactcgtactgagcgggctggcaaggcgcatagnn

SEQ ID NO: 77241 - DNA, 183 bp, Homo sapiens
  misc_feature: GYAE6OF01CJROM.18.33.C11.1.454.CMB.1.raw
  modified_base (174)..(183): a, c, t, g, unknown or other
  misc_feature (174)..(183): n is a, c, g, or t
tcagtacgagtatgcacgaccggtgctcgatttagagtgagctcgttgggtttgggggaagaggaagactgacggtcccccaggagttcaggtgctgggcacagcggccctgggcctgcctggtcaaggactacttcccatactcgtactgagcgggctggcaaggcgcatagnnnnnnnnnn

SEQ ID NO: 77242 - DNA, 174 bp, Homo sapiens
  misc_feature: GYAE6OF01BYQMV.18.33.C11.1.454.CMB.1.raw
  modified_base (173)..(174): a, c, t, g, unknown or other
  misc_feature (173)..(174): n is a, c, g, or t
tcagtacgagtatgcacgaccggtgctcgatttagagtgagctcgttgggtttgggggaagaggaagactgacggtcccccaggagttcaggtgctgggcacagcggccctgggctgcctggtcaaggactacttcccatactcgtactgagcgggctggcaaggcgcatagnn

SEQ ID NO: 77243 - DNA, 174 bp, Homo sapiens; identical to SEQ ID NO: 77242
  misc_feature: GYAE6OF01BLBG3.18.33.C11.1.454.CMB.1.raw
  modified_base (173)..(174): a, c, t, g, unknown or other
  misc_feature (173)..(174): n is a, c, g, or t

SEQ ID NO: 77244 - DNA, 172 bp, Homo sapiens
  misc_feature: GYAE6OF01DRR8M.18.33.C11.1.454.CMB.1.raw
  modified_base (172)..(172): a, c, t, g, unknown or other
  misc_feature (172)..(172): n is a, c, g, or t
tcagtacgagtatgcacgaccggtgctcgatttagagtgagctcgttgggtttgggggaagaggaagactgacggtccccaggagttcaggtgctgggcacagcggccctgggctgcctggtcaaggactacttcccatactcgtactgagcgggctggcaaggcgcatagn

SEQ ID NO: 77245 - DNA, 175 bp, Homo sapiens
  misc_feature: GYAE6OF01D754O.18.33.C11.1.454.CMB.1.raw
  modified_base (173)..(175): a, c, t, g, unknown or other
  misc_feature (173)..(175): n is a, c, g, or t
tcagtacgagtatgcacgaccggtgctcgatttagagtgagctcgttgggtttgggggaagaggaagactgacggtcccccaggagttcaggtgctgggcacagcggccctgggctgcctggtcaaggactacttcccatactcgtactgagcgggctggcaaggcgcatagnnn

SEQ ID NO: 77246 - DNA, 132 bp, Homo sapiens
  misc_feature: GYAE6OF01EEBJX.18.33.C11.1.454.CMB.1.raw
  modified_base (130)..(132): a, c, t, g, unknown or other
  misc_feature (130)..(132): n is a, c, g, or t
tcagtacgagtatgcacgaccggtgctcgatttagagtgagctcgttgggtttgggcacagcggccctgggctgcctggtcaaggactacttcccatactcgtactgagcgggctggcaaggcgcatagnnn

SEQ ID NO: 77247 - DNA, 173 bp, Homo sapiens
  misc_feature: GYAE6OF01B7RXK.18.33.C11.1.454.CMB.1.raw
  modified_base (173)..(173): a, c, t, g, unknown or other
  misc_feature (173)..(173): n is a, c, g, or t
tcagtacgagtatgcacgaccggtgctcgatttagagtgagctcgttgggtttgggggaagaggaagactgacggtcccccaggagttcaggtgctgggcacagcggccctgggctgcctggtcaaggactacttcccatactcgtactgagcgggctggcaaggcgcatagn

SEQ ID NO: 77248 - DNA, 173 bp, Homo sapiens; identical to SEQ ID NO: 77247
  misc_feature: GYAE6OF01CBZIF.18.33.C11.1.454.CMB.1.raw
  modified_base (173)..(173): a, c, t, g, unknown or other
  misc_feature (173)..(173): n is a, c, g, or t

SEQ ID NO: 77249 - DNA, 174 bp, Homo sapiens; identical to SEQ ID NO: 77242
  misc_feature: GYAE6OF01CZSBT.18.33.C11.1.454.CMB.1.raw
  modified_base (173)..(174): a, c, t, g, unknown or other
  misc_feature (173)..(174): n is a, c, g, or t

SEQ ID NO: 77250 - DNA, 600 bp, Homo sapiens
  misc_feature: GYAE6OF01BQ9EO.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggtttccttgttgctatttcaaaaggtgtccagtgtgaggtgcagttggtggagacgtgggaggaggcttgatccagccgtgggggtccctgagactctcctgtgcagtctctgggttcgtcagtggcgactacatgagcgtgggtccgcaggcctccgagggacggcctggagtggatctactacttattagtagtggtaggtaccacactactacacacgactcgtacgaggacgctacacactctcagaacgactaactccgaagacgaacagttacgtatacctactaaatagtaactaacctacgtagacgacggacgacgtaaccggctacgtagtacttacgtgtggtcgggtactacgtttacgttcggacccggtcggggacccggggtaccctcggtacccgtacccgtacccgtcccctacccgtcccgtaaaccccgg

SEQ ID NO: 77251 - DNA, 172 bp, Homo sapiens
  misc_feature: GYAE6OF01AFF28.18.33.C11.1.454.CMB.1.raw
tcagtacgagtatgcacgaccggtgctcgatttagagtgagctcgttgggtttgggggaagaggaagactgacggtcccccaggagttcaggtgctgggcacagcggccctgggctgcctggtcaaggactacttcccatactcgtactgagcgggctggcaaggcgcatag

SEQ ID NO: 77252 - DNA, 186 bp, Homo sapiens
  misc_feature: GYAE6OF01AV72S.18.33.C11.1.454.CMB.1.raw
  modified_base (175)..(186): a, c, t, g, unknown or other
  misc_feature (175)..(186): n is a, c, g, or t
tcagtacgagtatgcacgaccggtgctcgatttagagtgagctcggtttgggtttgggggaagaggaagactgacggtcccccaggagttcaggtgctgggcacagcggccctgggctgcctggtcaaggactacttcccatactcgtactgagcgggctggcaaggcgcatagnnnnnnnnnnnn

SEQ ID NO: 77253 - DNA, 185 bp, Homo sapiens
  misc_feature: GYAE6OF01E1O9Z.18.33.C11.1.454.CMB.1.raw
  modified_base (175)..(185): a, c, t, g, unknown or other
  misc_feature (175)..(185): n is a, c, g, or t
tcagtacgagtatgcacgaccggtgctcgatttagagtgagctcgttggggtttgggggaagaggaagactgacggtcccccaggagttcaggtgctgggcacagcggccctgggctgcctggtccaaggactacttcccatactcgtactgagcgggctggcaaggcgcatagnnnnnnnnnnn

SEQ ID NO: 77254 - DNA, 559 bp, Homo sapiens
  misc_feature: GYAE6OF01EFVBP.18.33.C11.1.454.CMB.1.raw
  modified_base (398)..(398): a, c, t, g, unknown or other
  misc_feature (398)..(398): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaagggcctggagtggatctcacttatttatagtggtggtaccacatactacacagactccgtagaagggccgattccacatctanagaagacaatccaggaacacattgtatctacaaatgaataacctgagagccgagacacggccatcgtattactgtggtgggctagtttacctggaccccgtgggggaccccgggtaacctcgggtccacccggtccctcccccctaccctcccgaacccgg

SEQ ID NO: 77255 - DNA, 173 bp, Homo sapiens; identical to SEQ ID NO: 77247
  misc_feature: GYAE6OF01C3TPA.18.33.C11.1.454.CMB.1.raw
  modified_base (173)..(173): a, c, t, g, unknown or other
  misc_feature (173)..(173): n is a, c, g, or t

SEQ ID NO: 77256 - DNA, 173 bp, Homo sapiens; identical to SEQ ID NO: 77247
  misc_feature: GYAE6OF01A3RIZ.18.33.C11.1.454.CMB.1.raw
  modified_base (173)..(173): a, c, t, g, unknown or other
  misc_feature (173)..(173): n is a, c, g, or t

SEQ ID NO: 77257 - DNA, 722 bp, Homo sapiens
  misc_feature: GYAE6OF01CW5F8.18.33.C11.1.454.CMB.1.raw
  modified_base (364)..(364): a, c, t, g, unknown or other
  misc_feature (364)..(364): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctctgggttcgtcgaggtggcgactacatgagcgtgggtccgccgaggcctccgaggggaacggccgtgggagtggatctcacttatttatagtggtgtaccanatactacacagactccgtaggaacgggccgtattcacctatacctacgagaaacgaactaacttacccgaaggaaactaactagtttagtaacttcctttaacaaattacgtaaacttaacccgtaggaacgtaacggacccgggtaaaggaacccgtaaccgggtacctaacgttacggttactttaaccggttgggttagggtacggggggttacttaacggttttaacccgttacccgggtaaccccccgggttacggggggggacccccgggggttaaaccccgttcggggtaccccgtaacccccggttcccccttaccccccccgtacccccgttcccccgaaacccccggg

SEQ ID NO: 77258 - DNA, 174 bp, Homo sapiens; identical to SEQ ID NO: 77242
  misc_feature: GYAE6OF01AC8Z2.18.33.C11.1.454.CMB.1.raw
  modified_base (173)..(174): a, c, t, g, unknown or other
  misc_feature (173)..(174): n is a, c, g, or t

SEQ ID NO: 77259 - DNA, 386 bp, Homo sapiens
  misc_feature: GYAE6OF01DX7R7.18.33.C11.1.454.CMB.1.raw
  modified_base (380)..(386): a, c, t, g, unknown or other
  misc_feature (380)..(386): n is a, c, g, or t
tcagtacgagtatgcacgaccggtgctcgatttagagtgagctcgttgggtttgggattcacgttgcagatgtaggtctgggtgcccaagctgctgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaaggcccatccggtcttccccctggccaccctcctccaagagcacctctgggggcacagcggcctgggctgcctggtcaaggctacttcccatactcgtactgagcggctggcaaggcgcatagnnnnnnn

SEQ ID NO: 77260 - DNA, 584 bp, Homo sapiens
  misc_feature: GYAE6OF01A20QG.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggtttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaagggccgtgggagtggatcgtcactttatttatagtggtggtaccacatactacacagactccgtgaacgggccgattcacatctcagaagacaattaccaaggaacacattagtatcttacaaatgaaataacctgagagaccgaggacacggacatgtattacgtgtggtgggtactagtttcgttacggaccccggtgggggaccccgggtaacccgttcggtcccgtaccccggttccctccccctaccccgtccccgaaaccccgg

SEQ ID NO: 77261 - DNA, 566 bp, Homo sapiens
  misc_feature: GYAE6OF01BXXE5.18.33.C11.1.454.CMB.1.raw
  modified_base (476)..(476): a, c, t, g, unknown or other
  misc_feature (476)..(476): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctggggtcccgccaggcctccgaggggaacgggccgtgggagtggatcgtctacttatttatagtggtgtaccacatactacacagactccgtgaacgggccgattcaccatctcagaagacaatccaagaacacattgtatcttacaaatgaataactgagacgacgaggacacggcatgtattacngtgtgggactagtttacgtacgacccggtcggggacccgggtaaccctcggtccacccgttccctacccccgcccgtacccgaaccccgg

SEQ ID NO: 77262 - DNA, 174 bp, Homo sapiens; identical to SEQ ID NO: 77242
  misc_feature: GYAE6OF01C6DC4.18.33.C11.1.454.CMB.1.raw
  modified_base (173)..(174): a, c, t, g, unknown or other
  misc_feature (173)..(174): n is a, c, g, or t

SEQ ID NO: 77263 - DNA, 562 bp, Homo sapiens
  misc_feature: GYAE6OF01DX6UD.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcaggtggcgactacatgagctgggtccgccaggcctccgaggggaagggcctggagtggatctctacttatttataggtggtggtaccacatactacacagacctcgtagaacgggcattcacctatctcagaacgacaacttccaaggaacactattgtatcttacaatgaactactagagagaccgaggacacgaccagtgtatacgtgtggtcgggctagttacgttcgacccggtggggacccggtaccgtcggtccacccgtccctcccccacccgtcccaacccgg

SEQ ID NO: 77264 - DNA, 160 bp, Homo sapiens
  misc_feature: GYAE6OF01CBZ2B.18.33.C11.1.454.CMB.1.raw
  modified_base (159)..(160): a, c, t, g, unknown or other
  misc_feature (159)..(160): n is a, c, g, or t
tcagtacgagtatgcacgaccggtgctcgatttagagtgagctcgtttggtttgggggaagaggaagactgacggtcccccaggagttcaggtgctgggcacagcggccctgggctgcctggtcaaggactacttcccatactcgtactgagcgggctnn

SEQ ID NO: 77265 - DNA, 582 bp, Homo sapiens
  misc_feature: GYAE6OF01AOZ6G.18.33.C11.1.454.CMB.1.raw
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (566)..(566): a, c, t, g, unknown or other
  misc_feature (566)..(566): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtcccgccgaggcctccgaggggaacgggcccgtgggagtggatctctactttatttagtgtggtcggtaccacatactacacagactccgtagaacgggccgattcaccatctacagaagacaattcccaaggaacactattgtatctacaaatnaatacngagacgccgaggaccacggactagtgtattacgtggtgtgggctagtttacttcggaccccggtgggggaccccgggtaaccctcgggtacccacccgtccctccccccncccgtcccgaacccgg

SEQ ID NO: 77266 - DNA, 610 bp, Homo sapiens
  misc_feature: GYAE6OF01DXVJU.18.33.C11.1.454.CMB.1.raw
  modified_base (443)..(443): a, c, t, g, unknown or other
  misc_feature (443)..(443): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagcgtgggtccgccaggctccgaggggaacggcctggagtggatctacacttatttataggtggtgtaccacatactacacagacctcgtagaacgggccattcacctatctacagaaagactaaattccaaggaacacgtattgtaatcttanaaatagaactaacctgagaacgccgaaggacacggaccagttacgtattacgtggttggtgggtacttagtttaccgttacggaccccggttcggggggaccccggggtaacccgttcgggtacccacccggttccctaccccccctacccgtcccgaaaccccggg

SEQ ID NO: 77267 - DNA, 643 bp, Homo sapiens
  misc_feature: GYAE6OF01AGEJ1.18.33.C11.1.454.CMB.1.raw
  modified_base (457)..(457): a, c, t, g, unknown or other
  misc_feature (457)..(457): n is a, c, g, or t
tcagtacgagtatgcacgaccggtgctcgatttagagtgagctcgttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagcgtgggtccgccgaggcctccgaggggacgggcctgggagtggatcgtctacttatttataggtggtacggtaccactatacctacacagacgtccgtaggaacgggcctattccacctatctacaagaacacaacttaccgaaggaacactattgtattcttanaaatgaactaactgaagacgaccgaggacaccggaccagtcgtattacgtggtgggtcgggtacttacgttttccgttaccggaacccccgggttggggggacccccgggggttaaaccccgttcggggtacccgtaccccggttaccccgtccccccctaacccccgtccccggaaacccccggg

SEQ ID NO: 77268 - DNA, 653 bp, Homo sapiens
  misc_feature: GYAE6OF01D7OIB.18.33.C11.1.454.CMB.1.raw
  modified_base (485)..(485): a, c, t, g, unknown or other
  misc_feature (485)..(485): n is a, c, g, or t
tcagtacgagtatgcacgaccggtgctcgatttagagtgagctcgttgggtttggggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccagccgtggggggtccctgacgactctcctgtgcagtctcgtgggttcgtcaggtggcgactacatgagcgtggggtccgccgaggcctaccggagggggaacgggtccgtgggaggtggattctactaacttttagtttagtaggttggtacggtaccactatacctacacacgacctcgtaggacgggccgtatccactactctacaagaagactaattccgaaggaactactattacgtattacttaacaaatanaaactaacctggaagacggaccggaaggaccgacggtacctagttagtacttagtggttagggtgggtacttagtttaccgtccggtaaccccgggtcgggggaccccgggtaccgttcgggtaccctaccccggtaccctccccccgtacccgtcccgaaaccccgg

SEQ ID NO: 77269 - DNA, 777 bp, Homo sapiens
  misc_feature: GYAE6OF01CBB36.18.33.C11.1.454.CMB.1.raw
tcagtacgagtatgcacgaccggtgctcgatttagagtgagctcgttgggtttgggggggagaggagcccagcacgtgggattccgaggttgtttccattcggtgatcagcactgaacacagaggactcaccatggtagttttggctgagtcgttgggttttccttgttgcttatttacaaaggtgtccagtgtgaggtgctaggttggtggagacgtgggaggaggtcttgactccgaggccggtcgggggtccctagacgtacctcctccgtgtcgactacgttccgttcgttgggttccgtcgtaggtcggacgtaactacgagtggacgtccggtcggggtcccgccgacggtccgtaccggaaggggaacggtccgtaggggagtcggtacttccgtacttaactttaagtttacgtaggttcgggtacgtaaccactaactaactaacacgtacgaccgttcggtaggaacgggtcctactaccgacctactcctaacgaaagaacgtaactaaacgttaccgaaaggtaacctaacgttatttacgtaacttacttaaactaaatacgaaacttaacgagaacgacgaccggaacgaccgaccggtactagttacgttacgtacggttggtcggtacgggtactttaaccggttttaccgtacccgggtacccccggggttccggggggtaaccccggtaacccggtttccggtaccccgtaccccgttacccccgtacccccctaaccccgtacccggtaaaccccggg

SEQ ID NO: 77270 - DNA, 572 bp, Homo sapiens
  misc_feature: GYAE6OF01A92VR.18.33.C11.1.454.CMB.1.raw
  modified_base (361)..(361): a, c, t, g, unknown or other
  misc_feature (361)..(361): n is a, c, g, or t
  modified_base (424)..(424): a, c, t, g, unknown or other
  misc_feature (424)..(424): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccagccgtggggggtccctgagactctcctgtgcagtctctgggttcgtcagtggcgactacatgagcgtgggtccgccaggctccgagggacgggcctggagtggatctcactttatttatagtggtggtaccanatactacacagactccgtagaacgggccgattcaccatctcaagagacaattccaaggaacanattgtattcttacaaatgaaactaactgagagaccgaggacacggcatgtactactgtggtgggctagtttctcggaccccggtgggggacccgggtaacccgtgggtccctacccggttccctcccccgacccctcccgaaccccgg

SEQ ID NO: 77271 - DNA, 579 bp, Homo sapiens
  misc_feature: GYAE6OF01BGNIP.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccaggctccgaggggaacgggcctgggagtggatcgtcactttatttatagtggtcggtacacatactacacagactcgtgaaggccgattcaccatctcagaagactaattccaggaacacattgtatcttacaaatgaataacctagagacgaccgaggaccacggaccatgtattacgtgtggtggggacttagtttacgtcggaccccggttgggggaccccgggtaacccgtgggtcccacccggtccctccccccgcccgtcccgaaccccgg

SEQ ID NO: 77272 - DNA, 639 bp, Homo sapiens
  misc_feature: GYAE6OF01EGWUK.18.33.C11.1.454.CMB.1.raw
tcagtacgagtatgcacgaccggtgctcgatttagagtgagctcgttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagacctctcctgtgcagtctcgtgggttcgtcaggtggcgactacatgagcgtcgggtccgcaggctaccggaggggacgggccgtgggacgtggactctactactttattataggtggtcgtaccacatactacacacgactcgtagacgggaccgattccacctatctacaagaagactaacttaccgaaggaacactattagtattacttactaatacgaaattaaccgtagacgacgaccggaaggaccgacggacctagttagtacttacgtggtaggtcggggtacttacgtttacgttccggaccccgggttcgggggaccccggggtaacccgtcggtacccgtaccccgtaccccgtaccccctaccccgtcccgtaaaccccggg

SEQ ID NO: 77273 - DNA, 555 bp, Homo sapiens
  misc_feature: GYAE6OF01DOQAP.18.33.C11.1.454.CMB.1.raw
  modified_base (390)..(390): a, c, t, g, unknown or other
  misc_feature (390)..(390): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (438)..(438): a, c, t, g, unknown or other
  misc_feature (438)..(438): n is a, c, g, or t
  modified_base (541)..(541): a, c, t, g, unknown or other
  misc_feature (541)..(541): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggtagttttggctgagcttgggtttttccttgttgcttatttacaaaaggtgtccagtgtgaggtgcagttggtggagactggaggaggcttgatccagccgtggggggtccctgagactctcctgtgcagtctcgtgggttcgtcagtggcgactacagtgagcgtcgggtccgccgaggctccgaggggaacggccgtggagtggatctactactttaatttagtagtggtcgtaccacatactacacagactcgngaggcattcacntcnagaanacaactcaagaacactattgtatcttanaaatgaactaactgagacgcgaagacacgacatgtattagtgtgtggctagtttactcgacccggtggggacccggtaccctggtcccaccgtcccacccccncctcccgaacccgg

SEQ ID NO: 77274 - DNA, 750 bp, Homo sapiens
  misc_feature: GYAE6OF01DEIY0.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgctagttggtggagacgtggaggaggcttgatccagccgtggggggtccctgagactctcctgtgcagtctcgtgggttcgtcagtcggcgactacatgagcgtgggtccgccgaggctccgaggggacggcctggagtggatcgtactacttattagtagtggtagtaccacagttactacacgagtaccgtaccggtaggaacgggtccgtaatttccgaaccgtactccgttacgaaggtaaacgaactaaacgtttcccgaagggaaacctacgtaacgtttagttaaacttcctttaaaccaaaagttcgtaaacttaaaccccgttggaacggtaacgtccccgggaaagggtaaccctaaccgggtaccctaagttacggttaactttacggttacggttgggtaccgggggttaccttaaagtttttacccggttaggtacccccccgggttagggggggacccccggggttaaaccccgttcggggtacccgtacccccggttacccggttacccccccgaacccccgttcccgtaaaaccccccggg

SEQ ID NO: 77275 - DNA, 778 bp, Homo sapiens
  misc_feature: GYAE6OF01CR4HL.18.33.C11.1.454.CMB.1.raw
tcagtacgagtatgcacgaccggtgctcgatttagagtgagctcgttggggtttggggggggagaggagcccagcactgggattccgaggtgtttccattcggtgatcagcactgaacacagaggactcaccatggtagttttggctgagtcgttgggttttccttgttgcttatttacgaaaaggtgtccagtgtgaggtgcaggttggtggagacgtgggaggacggcttgactccgacggtccggtcgggggggtccctaggacggaccttccttccgtggtcgcgtacgttcttcggttcgggttcgtcgaggtcggacgtaactacagtgacggtcgtcggggtcccgccgacggccgtaccggaaggggaacggccgtagggaggtggactcgtactactttagttagtggtcggtacgtaaccactactaactacgaacgtacgtaccgttccggaggaacgggtaccgtacttaccgacctattaccgaacgaacgtaacgtaactaacttacccgaaacggtaacaacgttattacgttaacttcttaaactaaagtagtaaaactaaccgtaggaaccgaacggaccgaacggaaccgtacggtacctagttaacgttacttaacggttgggtacgggttcgggtacttaacgttttaccgtacccgggtaccccgggggttcgggggaacccccggggtaacccttcggggtaacccctaccccgttaccccctaccccccgtccccgtacccggtaaacccccggg

SEQ ID NO: 77276 - DNA, 590 bp, Homo sapiens
  misc_feature: GYAE6OF01EJ6AP.18.33.C11.1.454.CMB.1.raw
  modified_base (303)..(303): a, c, t, g, unknown or other
  misc_feature (303)..(303): n is a, c, g, or t
  modified_base (365)..(365): a, c, t, g, unknown or other
  misc_feature (365)..(365): n is a, c, g, or t
  modified_base (384)..(384): a, c, t, g, unknown or other
  misc_feature (384)..(384): n is a, c, g, or t
  modified_base (580)..(580): a, c, t, g, unknown or other
  misc_feature (580)..(580): n is a, c, g, or t
tcagtacgagtatgcacgaccggtgctcgatttagagtgagctcgttggggtttgggggaggagaggagcccagcactgggattccgaggtgtttccattcggtgatcagcactgaacacagaggactcaccatggagttttggctgagctgggtttttccttgttgctatttcaaaaggtgtccagtgtgaggtgcagttggtggagactggaggaggcttgatccagccgtggggggtccctgagactctcctgtgcagtctctgggttcgtcagtggcgactacatgagctcggggtccnccgaggctccgaggggaacgggcctggagtggatctctacttatttatagtggtggtaccanatactacacagactccggngaacgggcctatccaaccatctacaacgaagaactaacttaccgaaggaacaactaactttgtattcgttacaaatagaaataacctagagacgcgaacggacgacggccatagtattcgtggtggtgggctacgtttacgtcggccccggtcgggggacccggggaacccgtcggtaccacccgtccctcccccncccctacccg

SEQ ID NO: 77277 - DNA, 957 bp, Homo sapiens
  misc_feature: GYAE6OF01BLQA0.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctggttttccttgttgctatttcaaaggtgtccagtgtgaggtgcagttggtggagacgtgggaggaggtcttgactccaggccgtggggggtccctggacgtactctcctggtgctacgttcgtcgttgggttccgtcgaggtggcgtactacagtggaggtcgttcggggtcccgccgacgggtccgttaccgggaacgggggtaacggggtcccgtagggggtacggttacgggtaacgtttccttaccgttaactttttaagtttttaacgttacggggtttacggggtttaaccgggttaacccctaacgttaaacgtttaaccgttaaaccgtaaaccggtaacggtaacccggtttacccgggtaagggaaaacccgggggtttaccccgtaaaccttttacccgaacccgttaacgttaccgtaaccggtaaacggtaaaacggtaaccttaaaaccgttttccccggaaaaacggggtaaaccctaaaccgtttaaagtttccgtttaaaccgtttaccgtttaaacgtaaaacgttaacggtaaaaacctttaacccggttagggaaaggtaacccgggaaccgggtaacggaacccgtaccgggacctttaaggttacgtttaacgttacgggttcggtggggtttacccggggtaacttttacgttttacccgggttacccgggaacccccccggggtttcgggggggaaccccccgggttaaccgttccggggtaccccttacccccgggttacccccctaacccccgtacccccgttaacccgggtaaacccccgg

SEQ ID NO: 77278 - DNA, 642 bp, Homo sapiens
  misc_feature: GYAE6OF01CU40U.18.33.C11.1.454.CMB.1.raw
  modified_base (179)..(179): a, c, t, g, unknown or other
  misc_feature (179)..(179): n is a, c, g, or t
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (332)..(332): a, c, t, g, unknown or other
  misc_feature (332)..(332): n is a, c, g, or t
  modified_base (396)..(396): a, c, t, g, unknown or other
  misc_feature (396)..(396): n is a, c, g, or t
  modified_base (500)..(500): a, c, t, g, unknown or other
  misc_feature (500)..(500): n is a, c, g, or t
tcagtacgagtatgcacgaccggtgctcgatttagagtgagctcgttggggtttgggggggagaggagcccagcactgggattccgaggtgtttccattcggtgatcagcactgaacacagaggactcaccatggagttttggctgagcggtggtttcgtgtagctattacaaaaggtntcagtgtgaggtgcaggttggnggagacgtggaggacggtcttgactccgagccggtggggggtccctgagcttctccgtgtgccngtctcgtgggttcgtcaggtggctactacntgagtcgtggccgcgagtcncgagggacggctggagngatctactattattactggtcggttacgaccactaagttacgaacagaacgtaccgttacccgngggaacgggtaccctaatttacccgaacttacgtaccctaacgaagaaacgtaacctaaattaccccggaaggaaaactacctaagttcgtaattaccttaaanaaagtactaaactacgagacgacgcgagacgtcgacttgtacttacgtgtgtcggtacgtcttacgttccggaccggaccgggtcgggaacccggtaccttacggtccgtacccgtccccctaccccgtcccgcgaaacccg

SEQ ID NO: 77279 - DNA, 760 bp, Homo sapiens
  misc_feature: GYAE6OF01CM9RO.18.33.C11.1.454.CMB.1.raw
  modified_base (561)..(561): a, c, t, g, unknown or other
  misc_feature (561)..(561): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggtagttttggctgagtcttgggttttccttgttgcttatttacaaaaggtgtaccagtgtgaggtgcaggttggtggagacgtggaggaggtcttgactccgagccggtcgggggtccctgacgctcgtccgtgtgcctagtctcggttgggttctacgaggtcggaccgtactaacgatggacgtcgtcgggcccgacgacggccgtacggaacggggtaacggccgtagggagtaggacttccgtacgttaactttagtttaacggtaggttcggtaacgtaaccaagtaactaaccgtaacaacgtacgtaccgtaccggtaggaacgggtacctacttaccacgtatcctaacgaaagaacgtaactaacgttacccgaaaggaaccctaatacgttactaacgttacttaaacgtaaactaanaaaccgttaacgtacggaacgtaacggaccggaacggaaccgtaccgaccttaagtacgttaacgttagtcgggttcgggtacgggttacttaacgtttaccggtaccggtacccccgggtacgggggaccccgggttaccggtaccggtaccccgtacccgttacccctaccccccgaccgtaacccgaaaccccggg

SEQ ID NO: 77280 - DNA, 816 bp, Homo sapiens
  misc_feature: GYAE6OF01ELUTC.18.33.C11.1.454.CMB.1.raw
  modified_base (578)..(578): a, c, t, g, unknown or other
  misc_feature (578)..(578): n is a, c, g, or t
  modified_base (597)..(597): a, c, t, g, unknown or other
  misc_feature (597)..(597): n is a, c, g, or t
tcagtacgagtatgcacgaccggtgctcgatttagagtgagctcgttggggtttggggggggagaggagcccagcactgggattccgaggtgtttccatttggtgatcagcactgaacacagaggactcaccatgggtagttttggctgagtcgttgggtttttcctttgttgtcttatttacaaaaggtgtccaggtgtggaggtgcgtaggttgggtggagacgtgggaggaggtcgttgactccgacggtccggtcggggggtccctggacgtacctctccgtgtgctagttctcgttgggttcgtcgtaggtcggaccgtactacagtcggacggtcggtcggggtcccgccgacgggccgtaccggaaggggtaacgggtccgtagggaggtggtacttcttaccttaagttttattagttacggtcgggtaacgtaaccaagtaacttaacctaacacgaacgtaccgtaccggtaagggaacgggtacctacttaccaacccgtatccgtaacgaaacgaacgtaactaacgttaccgaaagaaacctactatttacgtacttaccttaanaaaagtataaacctaccgnggaaacggccggaaccggtaaccgggactaccgggtactagtttacgttaacgttggtgggttacgggttacgggtaacctttacgttttaaccgggtaccccggggacccccggggttaccggggggtaacccccgggtaacccgtttcgggtacccccttaccccggttacccccccgttacccccctaaaccccgggtccccggtaaaaccccggg

SEQ ID NO: 77281 - DNA, 690 bp, Homo sapiens
  misc_feature: GYAE6OF01C2X18.18.33.C11.1.454.CMB.1.raw
  modified_base (357)..(357): a, c, t, g, unknown or other
  misc_feature (357)..(357): n is a, c, g, or t
tcagtacgagtatgcacgaccggtgctcgatttagagtgagctcgttggggtttgggggggagaggagcccagcactgggattccgaggtgtttccattcggtgatcagcactgaacacagaggactcaccatgggagttttggctggagtcgttgggttttccttgttgctatttacaaaaggtgtccagtgtgaggtgcaggttgggtggagacgtgggaggaggcttgatccgagccggtcggggggtccctgacgtacctctcctgtcgctcgtctcgttgggttcgtcgaggtggcgactacagtgagcgtcggtccgcgacgcgtcgagggacggccgtggagtggactcncgtacttagtttacgtggtcggtacggttaccaactagtacctacacaacgacctccgggtaggaacgggccgtacttaccaccgtattccgtacaaggaaacacgtaacttaacccgaaggaactactattagtattactaacaaattacggaaataccgtaggacgaacgaccggaggtaccgacgtacctagttagttcgttaacgtggttggtacggggtacttaccgttaccgttcccggtacccgggttccggggggaccccggttaaccggtccggttaccccgtacccgttccccgtaccccccgacctacccccggaaccccgg

SEQ ID NO: 77282 - DNA, 851 bp, Homo sapiens
  misc_feature: GYAE6OF01B052P.18.33.C11.1.454.CMB.1.raw
tcagtacgagtatgcacgaccggtgctcgatttagagtgagctcggttggggtttggggggggagaggagcccagcactgggattccgaggtgtttccattcggtgatcagcactgaacacagaggactcaccatggtagttttggctgagtcgttgggttttccttgttgtcttattacgaaaggtgtccaggtgtgaggtgcgtaggttgggtaggagacgtgggaggtaggtcttgactccgacggtccggtcggggggtccctggacgtaccttccttccgtgtcgtcgtacgttccgttccggttggggttccgtcggtaggtcggtaccgacgttaacgtagtacggtacggtccggtccggggtcccgaccggtacgggccgtaccgggaaggggtaccgggtcggtggtaggtcgtacttcgtacttaacgttttagtttaacggttaggttcggttacgtaacctaactaacgtaaccgtaccaacgtaacggtaaccgttaccggtacggaaacggggtccgttaacttaccaaccttacgtcctaacgaaagtaaccgactaaactacgaaacgaactacttaggttacttaacttaacgttaactaagtaaagtaaccgttaaccgagggaacggtacccgacgggaacggtaccgtaaccgggtaccttaattaggttaacttagggttacggtcgggttagggtaaccctttacggttttaacggtacccccgggtacccgggggttacccgggggcccccgggttaaacccttcgggttaccccgacccccgttaacccccgtcccccctaaaccccggtacccggtaaaccccgg

SEQ ID NO: 77283 - DNA, 174 bp, Homo sapiens
  misc_feature: GYAE6OF01E2K60.18.33.C11.1.454.CMB.1.raw
  modified_base (174)..(174): a, c, t, g, unknown or other
  misc_feature (174)..(174): n is a, c, g, or t
tcagtacgagtatgcacgaccggtgctcgatttagagtgagctcgttgggtttggggggaagaggaagactgacggtcccccaggagttcaggtgctgggcacagcggccctgggctgcctggtcaaggactacttcccatactcgtactgagcgggctggcaaggcgcatagn

SEQ ID NO: 77284 - DNA, 743 bp, Homo sapiens
  misc_feature: GYAE6OF01EN9HM.18.33.C11.1.454.CMB.1.raw
tcagtacgagtatgcacgaccggtgctcgatttagagtgagctcgttgggtttggggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggttgggtggagacgtgggagggaggcttgactccgaggtcccggtgggggggtcccctggacgacctctcctgtgcagtctcgtgggttcgtcaggtggcgtactacatgagcgtcggggtccgccgagggcctaccggaggggaacgggccgtgggagtggatctctactttattagtaggtggtcggtaccatatactacacgacgtaccgtcggtaggaacgggtccgtattccgaacctataccgtacaacgaaacgaactaacgttcccgaaaggtaaccacgtatttagttacttacttaacgtaaattacgtaaacttaacccgtaggaacggaacggaccggaacgggacccgtaaccgggtacctagttacgttaactttaccggttaggttcgggttacggggtacctttaacgtttttacccggttaccgggacccccgggttcgggggggaaccccccggggtacccgtcgggttaccccgtaccccggttaccccctacccccccgtaccccgtaccccgtaaacccccggg

SEQ ID NO: 77285 - DNA, 859 bp, Homo sapiens
  misc_feature: GYAE6OF01C3R4L.18.33.C11.1.454.CMB.1.raw
  modified_base (116)..(116): a, c, t, g, unknown or other
  misc_feature (116)..(116): n is a, c, g, or t
tcagtacgagtatgcacgaccggtgctcgatttagagtgagctcgttggggttgggggagaggacgcccagctacgtagggtacgttccggtaggttcgtttcctacgtttcgggntatcagcctacgtagaacacgaggacgtactcactagtggttgtttcggctggacgtcgtttcggttttccttgttcgtacttaagttacgaaaggttcgtacgtagtgtaggtggtcgacgtagggttgggaggacggtcggggtgggaggtcggtacttcggactaccgcggtccgggttcggggtcctagacgtcctcgtccgtggtcgtcgttaggttccttaccggtttcggttaccgtaggtacggtacgggaccttacgaaccgtaggtcgggcgtccggttcgggcccgacggtaggcccgttaaccgggaggggtacggtcgaggtacgtaggtacttccgttaagttactttaagtttagacgggtacggttacgtaccgactaaactaccgtaaaccggtaacgtacgtcgggtaacgacggaccttacgtacccacgtactactaacgaacgtaacgtaacttaacgtaaccgtaaacggtaaactaacgttaagtttactaacgttacgtaacgtaaacgtaacgttaaacgtaaccgaggtaacggtaaccggaacggtaccggaaacgtaccgtaccgttattaacggttacgttacggtaagggttacggtacgggttaacgtaacggtttaccggacccgggttacccgggtacggggaccccggttacgttaccggtaacccgttacgttaccccgttcccgtaccccgtcccggtaaccccggg

SEQ ID NO: 77286 - DNA, 898 bp, Homo sapiens
  misc_feature: GYAE6OF01DMSU0.18.33.C11.1.454.CMB.1.raw
tcagtacgagtatgcacgaccggtgctcgatttagagtgagctcgttgggtttggggggagaggagcccagcactgggattccgaggtgtttccattcggtgatcagcactgaacacagaggactcaccatggtagttttggctgagtcgttgggttttccttgttgtcttatttacgaaaggtgtccagtgtgaggtgcgtaggttggtggagtacgtgggaggtaggcttgactccgacggtccggttacgggggtcccttggacgtaccttccgttaccgttggtgtccgtacggttccgtttccggttcggggtttccgtaccgtagggttccggtaccgtaacgttaaccgtagttcggaacggtccggttaccgggtccccgtaccggtacggtaccgtacccggaagggggtaaccgggtcccggttagggtacggttacggtacgtttaccgttaccgttaaccgttttaagtttacggttaacgggttaccgggttaccggttaaaccgtaaccgttaaacgttaaccgtaaaccgaaccgtaacggtacccgttaccgggtaacgggtaaccgggtcccttaacgtttacccgaaccgttacgttacccgtaacgaacggtaaaccgtaccttaacgttacccgaagtaaacctacgtactttacggtaccttaccgttaacaaagttacgtaaaccgttacgacgtaacggaccgtaccggtaaaggtacccgtaacgtccgtaagttacggttaccttaggtcgggttacggtaccgggtactttacggtttaacccgtaccggggtacccccggttagggggtaaccccgttacccgtcggttaccctacccggttcccctaacccctccgtacccggtaaccgg

SEQ ID NO: 77287 - DNA, 891 bp, Homo sapiens
  misc_feature: GYAE6OF01CRHY7.18.33.C11.1.454.CMB.1.raw
tcagtacgagtatgcacgaccggtgctcgatttagagtgagctcgttggggtttgggggggagaggagcccagcactgggattccgaggtgtttccatttcggtgatcagcactgaacacagaggactcaccatggtagttttggctgagtcgttgggttttccttgttgtctatttacgaaaaggtgtccagtgtggaggtgcgtaggttggtggagacgtgggaggaggtcttgactccgaggccggtcgggggtcctgacgtacctctcctggtcgcgtacgttcgtcggttgggttcgtcgtaggtggaccgacctacgataggacggtccgtcggggtcccgccggacggccgtaccggaacggggaacggccggtagggtaggtggaacgttccttacgttacgttttaagtttagttaggttacgggttacggtaacctaaccgtaattaaaccgtaactaacgtaaccggtaccgttaccgggtacggtaacggggtacccgtacttacccgaaaccttcgtaacccgtagaaacgttaaacgaaaccgttaaacgttaccgaaaacgtaaacctaacttaagtttagttacttaccgtttaaaaccgaaattaaccggtaaaactttaaccgggaacgtaaacgggtaaccggtaaaccggacggaaacccgtaacccggtaaccttaagttaacgtttagtttaaccggtagggttaccgggttacgggttacctttaacggttttaacccgggttccccgggtaaaccccggggtttccgggggggaaacccccggggtacccgtttacgggtaccccccggtttacccccgtaccccccgttaaccccccctaccccggttaacccggaaacccccggg

SEQ ID NO: 77288 - DNA, 818 bp, Homo sapiens
  misc_feature: GYAE6OF01DGWOZ.18.33.C11.1.454.CMB.1.raw
  modified_base (216)..(216): a, c, t, g, unknown or other
  misc_feature (216)..(216): n is a, c, g, or t
tcagtacgagtatgcacgaccggtgctcgatttagagtgagctcgttggggtttgggggggagaggagcccagcactgggattccgaggttgtttccattcggtgatcagcactagaacacagaggactcaccatgggtagttttggctgagtcttgggttttccttgttgcttatttacaaaaggtgtccagtgtggaggtgcgtaggtttgggnggacgagtgggagggaggcttgactaccgacggtccgggttcggggggtccctggacgtaccttccgtccgtgtgcgtgttcgttcggttgggttcgtcgaggtcggacgtaaccttaacagtcgtacgtccgtcggggtcccgaccgaacggtccgtacccgggaagggggtaaccggtccggtagggtaggtacgggtactttacgtacttaacgttttaagtttagtagttaggggtacgtttaacccaacgtaactaacctaacgaactacggtacgtacccgtaggggtaaccgacccgtattacccaactacgtaccgtaacgaagtaaacgtaacctaaacgttacccgaaagaaaactaacttaactttagttaacttaactttaactaaaactaacggtaaacttaaccgtagaggaaacggtaccggaacgtaacgaacgacctagttagttacgttagtcggtaggtggggttacttacggtttacgttacccggtaccccgggtaccgggggtaacccggggtaacccggttaccgggtacccgttacccggttaccccttacccccgaccccgtacccgaaaccccggg

SEQ ID NO: 77289 - DNA, 873 bp, Homo sapiens
  misc_feature: GYAE6OF01EKXUY.18.33.C11.1.454.CMB.1.raw
tcagtacgagtatgcacgaccggtgctcgatttagagtgagctcgttgggttgggggggagaggagcccagcactgggattccgaggtgtttccattcggtgatcagcactgaacacagaggactcaccatggtagttttggctgagcttgggttttccttgttgcttatttacgaaaaaggtgtcctaggtgtggaggtgcgtaggttgggtggagacgtgggagggaggtcttgatccgaggtcccggtgggggggtcccctgacgtacctcctccgtgtgctacgttcgttcgttgggttcgtcgtaggtcggcgtaacctacgagtggaggtcgtcggggtccccgcgacgggcctaccggaagggggacgggtccgtagggacggtggactcgtctaacgttttaagtttagtaggttggtacggtacctaactatacctaacacgtaacgaccgtccgtagggaaccgggtcctacgttaccaacctacgtacctacgaaacgaaacgtaacctaaacttaccgaaacggtaacctaacgttaactttaggttaacctttactttaaaccgtaaaaacttaggtaaaacctttaaaccgtacgggtaacggaaccgggaacccgggtaaacgggaacccgtaacccgggaccttaaaggttcgttaaacggtttccgttaagggtttacggggtcgggttaaccgtttaaaccggtttttccggttaaccccggggttacccccggggttccgggggggaaccccccgggggttaaaccccgttaccggggttaccccccgttaccccgggttaccccccccgtaacccccccttaaccccccggtaacccccggtaaacccccggg

SEQ ID NO: 77290 - DNA, 872 bp, Homo sapiens
  misc_feature: GYAE6OF01AL76Z.18.33.C11.1.454.CMB.1.raw
tcagtacgagtatgcacgaccggtgctcgatttagagtgagctcggttgggtttggggggggagaggagcccagcactgggattccgaggtgtttccattcggtgatcagcactgaacacagaggactcaccatggtagtttggctgagtcgttcggttttcttgttgtcttatttacgaaaggtcgtccagtggtggaggtcgcgtaggttgggtggacgtacggtgggagggtacggtcgttgactaccgacggtccggggttcgggggtccctaggacgtaccgttcctcccgtggtcgccgtagttccgttcggttcgggttcgtcgtaggtcggaccgtacctatacgtggacggtccggttccgggcccgccgacgggcccgtacgggaacgggggtacggccggtaggtacggtagtaccgttctacgttacgttttaagttagttaggtcggttacgtaacccaacgtacttaccgacaacgtacgtacctaccgggtacggtacgggtaccttactacccgtaacctacgtccgtaacgaaacgtaacgaacttaacgttacccgaaacggtaactaaccgttaagtttacgtactttacgttaaacgaaacgttaccgttaaactaaccggtaaggtaacggaaccgaaccgggaaccgtaaccggtacccggtcttaaacgttcgttaacgtttacgggtggttaccgggtacggggtaacccttttaacgtttccgggttacccccgggtaacccggggttaccccgggggtacccgggttaaacccccgttccggggttacccccacccccggtttacccccgaaccccccgtccccggtacccccgtaaaccccgggg

SEQ ID NO: 77291 - DNA, 228 bp, Homo sapiens
  misc_feature: GYAE6OF01C7RN3.18.33.C11.1.454.CMB.1.raw
  modified_base (220)..(228): a, c, t, g, unknown or other
  misc_feature (220)..(228): n is a, c, g, or t
tcagtacgagtatgcacgaccggtgctcgatttagagtgagctcgttgggtttgggggaagaggaagactgacggtcctcccaggagttcaggtgctgggcaccgtgggcagtgggggagtgtgtcacaagatttgggctctgggcacagcggccctgggctgcctggtacaaggactacttcccatactcgtactgagcgggctggcaaggcgcatagnnnnnnnnn

SEQ ID NO: 77292 - DNA, 875 bp, Homo sapiens
  misc_feature: GYAE6OF01DLE7Z.18.33.C11.1.454.CMB.1.raw
  modified_base (208)..(208): a, c, t, g, unknown or other
  misc_feature (208)..(208): n is a, c, g, or t
tcagtacgagtatgcacgaccggtgctcgatttagagtgagctcgttggggtttgggggggagaggagcccagcactgggattccgaggtgtttccattcggtgatcagcactgaacacagaggactcaccatggtagttttggctgagcgttggttttccttgttgtctatttacgaaaggtgtcagtgtgaggtgcgtaggttggnggagacgtgggaggaggtcttggactaccgaggtccggtcggggggtccctaggacgcctctccgtggtcgactacggttcgttccggttggggtttccgtcgtaagggtcgggacgtaaccttacgaagtcggtacggtccgttcgggggttccccgaccggttacggacccgtttacccggggaaagggggaaccggggttcctaggggtaccggtagggtaacttccgttactaacgttttaagtttacggtaggttcgggttacggtaaccaacgtaactacgtaacacgtaacggtacttaccgggaggaccgggtcctaagtttacccactacgttctaacggaacgaacgtaactaacgttaccgaaacggtaaacctacgttaggttaacgttaacttaccttaaagtaaagttaacgtaaaacctttaacggaacggaacggtcccgggtaaccggaacgggaacccgtaacccgggtaccctaaaggtttaccggttaactttaacgggtcgggttcgggtaaccgggtactttaaccgttttaccgggtacccggggtaccccgggttacccggggggttacccggtaaccccgttccgggtacccgtaccccgttaccccgtaccccctaccccggttacccgaaacccccgggg

SEQ ID NO: 77293 - DNA, 675 bp, Homo sapiens
  misc_feature: GYAE6OF01BG6MN.18.33.C11.1.454.CMB.1.raw
  modified_base (259)..(259): a, c, t, g, unknown or other
  misc_feature (259)..(259): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagcttgggttttccttgttgctatttcaaaggtgtcagtgtgaggtgcagttggtggagacgtggaggaggcttgatccgagccgtgggggtccctgacgactctccgtgtgcngtctcgttgggttctcgaggtcggcgacgtacatgacgtcgtgggtccgcgaggcctaccggagggacgggctgggagtggactctacgtacttttagtttataggttggtacggtaccactaactacctacacacgactccggtagaacgggccgtattccacctagtctacaagaacgtaacaacttacccgaagaacactagttacgttaattaccttaacaaacgtataaactaaccgtagaacggacgaccggtaaggaccgaccggtacctagttacgttacttacgtggttcgggtaggggtaccttacgtttaccgtccggtacccgggtcccgggggacccggggtaacccgtcgggttacccgaccccggttaccctccccccgtacccccgtccgaaacccccgg

SEQ ID NO: 77294 - DNA, 979 bp, Homo sapiens
  misc_feature: GYAE6OF01BXN5W.18.33.C11.1.454.CMB.1.raw
  modified_base (155)..(155): a, c, t, g, unknown or other
  misc_feature (155)..(155): n is a, c, g, or t
tcagtacgagtatgcacgaccggtgctcgatttagagtgagctcgttgtggtttggggggggagaggacgcccagcacgtgggattccggaggttgtttccattcgggtgatcagcactgaacacagaggactcaccagtggtagttttggctgngtcgtttgggttttccttgttgtacttatttacgaaaggttcgtcaggtgtggaggtgcgtaggttgggtaggagacggtaggggagggtaggtcttaggactaccggcggtccgggtcggggggtccctaggtacgtaccttccttccggtggtcgtaccgtacgttccgttcggttcggggttacgtacggtacgggtcggtaaccgtaactacgtaggtacggacggtccgggtccggggtcccggaccggtaccgggtacccggtaccggggaacggggggtacgggtaccggtacggggtaggtcgttacgttccttaacgttaacgttttaagttttacggtacggggttacggtaaccgtaaccctaataaccgttaacctaaaccgaacggtaaccggttacccggtaccgggtaacggggtaaccgtacccgttaacttacccgaacctacgttaccgtaacggaaaggtaaacctaaaccgttaaaccgtaaacggtaaaccggaaatttaacgttaacgtttaacggttaacttaaccgttaaaactaaacggtttaacgttaaaaccgtaccgttaagggaaacccggtaacgggtaaccgggaacggtacccggtaacgtacgttaaggtttacgttaacgttacgggtacgggtttacgggtacgggtttacctttaaccgggtttacccggggttacccccgggtcccggggggttacccggggggaaacccccgggttcccgttacccgggttacccccctacccccggtttaccccggtaacccccccgtacccggtaaacccccgg

SEQ ID NO: 77295 - DNA, 703 bp, Homo sapiens
  misc_feature: GYAE6OF01EKX7A.18.33.C11.1.454.CMB.1.raw
  modified_base (378)..(378): a, c, t, g, unknown or other
  misc_feature (378)..(378): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtgagactgggaggaggcttgatccagccgtgggggtccctgagactctcctgtgctagtctgttcgggttcgtcgagtggcgactacatgagtcgtcgggtccgccgaggcctaccggaggggaacgggccgtgggaggtggactctactactttagtttataggtggtacggtaccanatactacacgagctcgtggaacggcctattccacctatctacaagaacgactaactaccgaaggaacaactattagtacttcttaactaaagtagaaacttaccgtagaacgacggacccgtaagggtaccaacccgggtactaacggttagttaacgtttacggttgggttacgggttacggggtaccgtttaacgttttaccggtttaccgggtaaccccccggggttcggggggacccccgggggttaaaccctccgggttacccccgttaccccggtccccctaccccccgttaacccccgtaccccgtaaacccccgggg

SEQ ID NO: 77296 - DNA, 518 bp, Homo sapiens
  misc_feature: GYAE6OF01C55G0.18.33.C11.1.454.CMB.1.raw
  modified_base (469)..(471): a, c, t, g, unknown or other
  misc_feature (469)..(471): n is a, c, g, or t
  modified_base (473)..(518): a, c, t, g, unknown or other
  misc_feature (473)..(518): n is a, c, g, or t
tcagtacgagtatgcacgaccggtgctcgatttagagtgagctcgttgggtttgggattcacgttgcagatgtaggtctgggtgcccaagctgctgaagggccgattcaccatctcagaagacaattccaggaacacattgtatcttcaaatgaataacctgagagccgaggacacggcatgtattactgtgtggggctatttacttgaccccgtggggccggggaaccctggtccaccgtcctccccacctccaccgaacgggcccatccggtccttccccctggccacccctcctaccaacgacgcctaccgtcgtcgggggccaacgacggccggcccgtcggggtcctcggccgtcgggtacaaaccgggtaccttaacccgttcccctaattacccgttcggtaacctggaacggccggggtccgtacgggaccgaaacggggccgaccgtaagttaaggcagnnngnnnnnnnnnnnnnnnnnnnnnnnnnnnnnnnnnnnnnnnnnnnnnn

SEQ ID NO: 77297 - DNA, 833 bp, Homo sapiens
  misc_feature: GYAE6OF01DYDHX.18.33.C11.1.454.CMB.1.raw
  modified_base (356)..(356): a, c, t, g, unknown or other
  misc_feature (356)..(356): n is a, c, g, or t
tcagtacgagtatgcacgaccggtgctcgatttagagtgagctcgttgggtttggggaggagaggagcccagcactgggattccgaggtgtttccattcggtgatcagcactgaacacagaggactcaccatggtagttttggctgagcttgggttttccttgttgcttatttcaaaaggtgtccagtgtgaggtgcgtagttggtggagacgtggagggaggtcttgactccgaggccggtgggggtccctgacgacctctccgtgtgcgagtcgtcgttggttcgtcgaggtggcgactacagtgacggtcgtcgggtccgccgacggccgtaccggaggggacgggccgtggngtgtactctactactttagtttagtaggtggtacgtaccagtaactaccgtaacaacgaacgtaccgtccgggtacggaacgggtaccctactttacccgaaccgttactacccgttaacgaaaacggaaacgtaaacctaaacgttaacccgaaaacgggtaaacccttaaccgttaagttttaaccggtttaactttaacccgtttaaacgtaaaagtaacgttaaaacttaaacccgtaggtaacggaacccggtaccggaaaccgggaacctaaccgggaccgttaagtttacggtttaacgttacggtttcgggttaggggttacggggttacccttttaacggttttacccggttcccggggttaaccccccgggttcgggggggtaacccccgggtaacccccgggtttcgttacccccggtacccccgtttccccccgtaaccccccgtaccccccgtaaacccccggg

SEQ ID NO: 77298 - DNA, 795 bp, Homo sapiens
  misc_feature: GYAE6OF01BWCTH.18.33.C11.1.454.CMB.1.raw
tcagtacgagtatgcacgaccggtgctcgatttagagtgagctcggttgggtttgggggggagaggagcccagcactgggattccgaggtgtttccattcgtgatcagcactgaacacagaggactcaccatggtagttttggctgagtcgttgggttttccttgttgcttatttcaaaaggtgtccagtgtggaggtgcgtaggttggtggagacgtgggaggaggtcgttgactccgacgtccggtcgggggtccctggacgtaccttccgttccgttggtcgtccgtacggttccttcggttcgggtttccgtacgacgggttcggacgtacctacagtaggacgtccggtcgggcccgtccgaacgggtcccgtaccggaaggggacgggtccggtacggaggttacgtacgttaccgttacgttaacctttagttttaacggtaggttcgggttacggtaaccccgtaataacgtaaaccgtaacaacgtaacgtaccgtcggtaacggaaacgggtacctacgttaccgactacgtacctagaaaccgtaataacctagttaacccggaagaaacctagtaacgtttagtaacctttacgaactaaacgcgttaaaactacggtagaacgcggtaccgtacgacgaccgtactacgtagttactacggaggttcggtacggttaattcgtttaccggcccggttaacccgggtcgggtacccgggaacccctttcgggacccttaccccggtaccccttacccccaaccccggtccgtaaacccccggg

SEQ ID NO: 77299 - DNA, 889 bp, Homo sapiens
  misc_feature: GYAE6OF01BDTAZ.18.33.C11.1.454.CMB.1.raw
  modified_base (332)..(332): a, c, t, g, unknown or other
  misc_feature (332)..(332): n is a, c, g, or t
tcagtacgagtatgcacgaccggtgctcgatttagagtgagctcgttggggtttggggggggagaggagcccagcactgggattccgaggtgtttccattcggtgatcagcactgaacacagagactcacagtggtagttttggctgagtcttggttttcttgttgcttattacaaaaggtgtcagtgtggaggtgcgtaggttggtggagacgtgggagggaggtcttgacgtccgacggtccgggttcggggggtccctaggacgtaccttccttccgtgtcgactacgttcgttcggttcgggttccgtgacggtcggaccgtaactanagttaggacgtcggtccgggtcccgcgtacggtccgtaccggaaggggacggtcgtggtacggtagtacttcgtacttattttaacgtttaagtggttaggtacgtaacctaactaacttacaaacgtacgaacgtaccgtaccggtagggaaccggtacctacttaccgaacgtacttaccgtaacgtaaacggaactaacttaacgttacccgaaagtaaacttacgttaagtttaccgttaactttaaccgttaataaaacgtttaagtaaaccgtttaaaccggaggtaaacgggaaccggtaaccgggtaaacgggaaccggtaacccggtaaaccgttaagtttaacgggtttaaccgtttacggtaggggttaccgggttacgggtttaaccgttttaaacggttttacccgggtaccccgggggttaaccccccggggttcggggggtaaccccgggtttaaaccccgttccccggggttaaccccgttacccccgttaccccccgttaacccccccgttaacccggtaacccccggtaaacccccggg

SEQ ID NO: 77300 - DNA, 1013 bp, Homo sapiens
  misc_feature: GYAE6OF01AFJCV.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccatggtagttttggctgagtcgttgggtttttccttgttgcttatttacaaaaggtgtccagtgtggaggtgctaggttggtggagacgtgggagggaggtcgttgactccgacggtccggtcggggggtccctggacgaccttccgtccgttggtcgcgtacgttccgttcggttcggggtttaccgttacgaggttacgggaccgtaaccttaacgtagtacggtaccggtccggttccgggggtcccccggacccggtacgggtacccggtaaccgggaacgggggtaaaccggggtccggttagggggtaacgggttacggtactttcctaactttaacgttttaagttttaacggtacgggtttacggtaccggtaaaccctaaacgtaacgttaaacccgtaacgtaaccgaaccggttaccgtacccggggttaacgggaaaccgggtaccgttacttaccctaccgttaacctacggttaaccgaaacggaaaccgttaacctaaaccggtttaaccccggaaaaggtaaacctaacgtttaacgtttaacggttaactttaaccctttaaacgtaaaacgtttaaccgtaaaccttaaccggtaagggtaaacggaacccggtaaacccgggaacggtaccccggtaaacggaccgttaacgtttaagggttaaccgtttacggttacggggttagggtttaccggggaacctttttaaacggttttacccgggtaaccccggggttacccccgggggttacccggggggtacccccgggggtttaaaccccgttcgggtaaccccccgttaacccccgggttacccccccttaacccccccgtaaccccggtaacccccggtaaaaccccgggg

SEQ ID NO: 77301 - DNA, 1065 bp, Homo sapiens
  misc_feature: GYAE6OF01ALERY.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccagtggagttttggctgagtcttgggttttccttgttgcttatttacaaaaggtgtccagtgtgagggtgcgtaggttggtggagtacgtgggagggtaggcttagactaccgacggtccggtcggggggtccctaggacgtacctccgtccttggtcgtcgtacgttccgttcggttcgggttcgtcgtaggtcggaccgacttacagtgacggtcgttacgggtcccggtaccgacggtaccgtaccggaacggggtaacgggtcccggttagggacgggttccgggtaccgttaccctaaccgttacgtacggaggttaccgtaccgttaacggttacgggtaaacgtacggggtacgaacgttaacggtaaccggtaacggttacggggttaacccgaccgggtaacggggtccggttacccgggggttacggggggtaaccgggggggtttacccgttaacccggtaaacccggttaaggttaacggaacccggtaaagggtaaacccggttaaaccgttaaaacccgtttaaaccccggaaaacgggtaaaacccccggtttaacccgggtttaacccttttaaaccgtaaaccccgtttaaaaaacccgttaaaacggtaacccgggttaaaaccccgggaaccggttaaccccgggttaacggggaaaacccggggtaacccgggggtaaacccccggggaaaccccgggtaaccgggtttaaaccccccgggggttacccggtttttaaaacccgttttcgggttttttaacccggtaacgggggtttaccggttaaaggtaacccgggtaaaagttaacccccgttaaaacggttttaaaaacccccgtttttccccggttttaaacccgtaaggttttttaccccggtttaaggttttaaccgggttaaaggttttacccggggg

SEQ ID NO: 77302 - DNA, 905 bp, Homo sapiens
  misc_feature: GYAE6OF01BZ76W.18.33.C11.1.454.CMB.1.raw
tcagtacgagtatgcacgaccggtgctcgatttagagtgagctcgttggggtttggggggggagaggagcccagcactgggattccgaggtgtttccattcggtgatcagcactgaacacagaggactcacatggtagttttggctgagtcgttcgggttttccttggttgtacttatttacgaaaaggtgtcctagtgtggaggtgcgtaggttggtagggagtacggtgggaagggtaggtcttagactaccgacggtccgggtcggggggtccctaggacgtaccttcctccgtggtcgacgtacgttcgttccggtgggtttccggtacgtaacggttcggaccgtacgtaacgtagtggtacggtccggtcggggttccccgcggtacggccgttaccgggacgggggacgggtccggtggtacggtggtacttcgtacttacgttttaatttacggtagggttacgggtaccgtaactaacgtaacttaaccgtaacgtaaccgtaacggtaccgtaccgggtaacgggtaaacgggtccgtacctacccgaacctacttaacgtacgaaagtaaaccgtaacgttaacctaccggaacgtaactaacgtacgtttagttaacttacttaaacgtaaacgtaacgtaaacgttaacgtacgaacggtaaccggaaccgggtaaccgaaccggtaccgaccgttaagtttacgttaacgtttacggttcgggttaggttaccgggttacgtttaaccggttaccggtttacccggggtacccccggggttacccggggggacccccgggtttaacccgggttaccccgggttaacccggttaccccccgttacccccgtaccccccccgttacccggtaaccccccggtaaaccccgggg

SEQ ID NO: 77303 - DNA, 805 bp, Homo sapiens
  misc_feature: GYAE6OF01AETZL.18.33.C11.1.454.CMB.1.raw
  modified_base (193)..(193): a, c, t, g, unknown or other
  misc_feature (193)..(193): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagtctgggttttccttgttgctatttacaaaggtgtcagtgtgaggtncgagttggtggagacgtgggacggaggtcttgactccgacgccggtcgggggtcctgagtacctcgtccgtgtcgctagtccgttcgttcgggttcgtacgtacggtggtcggtaacctaacgtacgtgacggtcggttccgggtacccggaccggtacgggacctaccggggaacggggaaccggggtccggtaggggtaacggtacggtaccttcttaaccgttaaccttttaaggttttacgtacgggtttacggtaccggtaaccctaacgtaactacccgtaacaacgtacgtacctccgggtagaaccgggtactacgttccaccgtattccgagaacgaaacgaacttaacgttacccgaaaggaaccttatacgttttgaacctttaacctataaacgtaacgtaaacgttaaccgtggaaacgtcggtaacccgggaaggaacctacgggacttaactttggaactttggtcgggtggtaccgggttattaccgtttaccggttaccccggaccggggtaccggggtaaccccgggttaccacccggggtcccttacccccggttccccaaccccccggttacccgtacccggaaaccccggg

SEQ ID NO: 77304 - DNA, 897 bp, Homo sapiens
  misc_feature: GYAE6OF01AXW9D.18.33.C11.1.454.CMB.1.raw
  modified_base (755)..(755): a, c, t, g, unknown or other
  misc_feature (755)..(755): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggtagttttggctgagtcgttgggttttccttgttgtcttatttacgaaaaggtgtccagtgtgaggtgcgtaggttggtggagacgtgggaggaggcttgactccgacggtccggttcgggggtccctgacgtacctccgtccgtgtgcgtacgttcgtcggttcgggttccgtcgtaggtcggacgtaactacgtagtacggaccggtcggtccggggtcccgaccggacgggtcccgtaaccggggacgggggtaaccggggtcggtaggggtagggtcggtaccgttccgttacgttaacgttttaaggtttacggtagggttaccggggtaccgtaacccgtaaactaaccgttaaacctaaccgaaccgtaacggttacccggtaccggtaacgggaaccgggtacctaccgtaaccgtaccctagtacccgtaacgaaaccgggtaaactaacccgttaacgttaaccccgaaacggtaaaccttacggttaaatttaccggttaactttaacctaaacgtaaaagttccgtaaaaccgtttacgaacgggacggtaacccggacgggtaaccgtaaacccggtacggtacctttaacgtggtttaacgttccggngggtttaaccgggcgggtttacctttaccggtttacccggtaccccggggtacccgggttcgggggaccccccggttacgttcccgttaaccccgcccccttacccccccggtacccaccccggttaaccccgaacccgggg

SEQ ID NO: 77305 - DNA, 776 bp, Homo sapiens
  misc_feature: GYAE6OF01D9KBX.18.33.C11.1.454.CMB.1.raw
  modified_base (115)..(115): a, c, t, g, unknown or other
  misc_feature (115)..(115): n is a, c, g, or t
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (547)..(547): a, c, t, g, unknown or other
  misc_feature (547)..(547): n is a, c, g, or t
  modified_base (678)..(678): a, c, t, g, unknown or other
  misc_feature (678)..(678): n is a, c, g, or t
tcagtacgagtatgcacgaccggtgctcgatttagagtgagctcgttgggttgggggggagaggagcccagcactgggattccgaggtgtttccattcggtgatcagcactgaanacagagactcaccatggtagtttggctgagtcttgggttttccttgttgcttatttacgaaaaggtcgtacctagtgtgaggtgngtagttggnggagacgtgggaggaggcgttgacgtaccacggtccggttcgggggtccctaggacgtaccttcctccgtggtacgcgtagttccgttccggttcgggttccgtacgtaggttcggaccgtaacgtaccgtagttacggacggttccgtcgggggttccccgaacccggtcggacccgttaaccgggaacgggggttaaaccgggcccggttaagggaacgggttacggtacgttccttacgtttaacgttttaacgttaagtcggtaggtaccggtacacgtactacgtacacgacgtaaccgtcggtaacgaacggtacctacgtaccacgtaacnctacgaagaaccgtaactacttacgaaacgaacgtactattacgtactacttaacaagttacaaactacgtaggaacgaggaccgacggaaccgcggaactagttacgtaattcggaggttcggtacggtnttaacggtttccggacgtaccccggggtacggggtaccccggtaacggttccggtacccctaccggtacccctaccccctcccgtacccgtaacccgg

SEQ ID NO: 77306 - DNA, 822 bp, Homo sapiens
  misc_feature: GYAE6OF01DSKP0.18.33.C11.1.454.CMB.1.raw
tcagtacgagtatgcacgaccggtgctcgatttagagtgagctcgttggggtttggggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggttggtggagacgtgggaggaggcttgatccgagccgtcggggggtcctgagactctcctgtgcagtctcgttgggttcgtcgaggtcggacgtactacagtgacggcgtcgggtcccgcgacgggtcctaccggagggggacgggtccgtagggaggtcgggacttctacttaacgtttattttagtaggttcggtacggtaaccactaacgttaacctaacacgaacggtaccgtaccggtagggaaaccgggtccgtaacttacccaaccgtactacctacgaaacggaaacgaactaaacgttacccgaaaggtaaacctaactaactttgttaaactttaccgtttaaactaaaacgttaacgttaaaaccgtaaccgttagggaaacggtaaccgggaacccgggaacgggaacccgtacccgggtaacccttaaggttacgtttaacgtttaacggttcgggttacgggttaccggggtactttaacggtttttacccggttacccggggttacccccgggtaccggggggggtacccccgggttaaccccgttcgggttaccccgtaccccggttacccctacccccccgtaccccgtaaccccgtaaccccggg

SEQ ID NO: 77307 - DNA, 907 bp, Homo sapiens
  misc_feature: GYAE6OF01BAFCF.18.33.C11.1.454.CMB.1.raw
tcagtacgagtatgcacgaccggtgctcgatttagagtgagctcgttgggtttgggggggagaggagcccagcactgggattccgaggtgtttccagttcggtgatcagcactgaacacagaggactcaccagtggtagttttggctgagtcgttgggttttccttgttgtcttatttacgaaaaggtgtaccaggtgtaggaggtgcgtaggtttgggtggagacggtgggagggagggtcttgtacgtccgacggtcccggttcggggggtaccctggacgtaccgttcctccgtgtcgctacgttcgttcggttgggttccgttcgtacggtcgggtaccgtaaccttacgtagtcggacggtcggttccggggtaccccgtcggaaccggggttccgttaacccgggaacggggggtaacgggtccggtaggggtaacggtttcgggaactttccgttaacttaaccgtttttaacgttttaacggttagggtttccggggtttaacggtaaccctaaacgttaaccgttaaccgtaaacccgaccgtaacggtaacccgtttaacgggtacggtaaacggggtacccgttaatttacccgaaccgttacttaccttaacgaaacggaacgtaactaaacgttacccgaaacgtaactaacgtatttacgtacttaccgttaactaacttaagtaaccgttaacgtagaacggtcggaaccggtacggaaccgacccggtataaccgttaggtttacgtacggttacggtacgggttggttaacgtttacgtttaccggttacccggtaccccggggttcccgggggtaacccggtaccccggttcggttaacccctaccccgtaccccgtacccccgtaccccgtaccccgtaaaccccggg

SEQ ID NO: 77308 - DNA, 174 bp, Homo sapiens
  misc_feature: GYAE6OF02HBYMJ.18.33.C11.1.454.CMB.1.raw
  modified_base (170)..(174): a, c, t, g, unknown or other
  misc_feature (170)..(174): n is a, c, g, or t
tcagtacgagtatgcacgaccggtgctcgatttagagtgagctcgttgggtttggggaagaggaagactgacggtccccaggagttcaggtgctgggcacagcggccctggctgcctggtcaaggactacttcccatactcgtactgagcgggctggcaaggcgcatagnnnnn

SEQ ID NO: 77309 - DNA, 174 bp, Homo sapiens; identical to SEQ ID NO: 77242
  misc_feature: GYAE6OF02HL4GS.18.33.C11.1.454.CMB.1.raw
  modified_base (173)..(174): a, c, t, g, unknown or other
  misc_feature (173)..(174): n is a, c, g, or t

SEQ ID NO: 77310 - DNA, 203 bp, Homo sapiens
  misc_feature: GYAE6OF02F7JQT.18.33.C11.1.454.CMB.1.raw
  modified_base (168)..(168): a, c, t, g, unknown or other
  misc_feature (168)..(168): n is a, c, g, or t
  modified_base (170)..(203): a, c, t, g, unknown or other
  misc_feature (170)..(203): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatgggattttggctgagcgggctggcaaggcgcatagngnnnnnnnnnnnnnnnnnnnnnnnnnnnnnnnnnn

SEQ ID NO: 77311 - DNA, 193 bp, Homo sapiens
  misc_feature: GYAE6OF02GLOWQ.18.33.C11.1.454.CMB.1.raw
  modified_base (173)..(193): a, c, t, g, unknown or other
  misc_feature (173)..(193): n is a, c, g, or t
tcagtacgagtatgcacgaccggtgctcgatttagagtgagctcggttgggtttggggaagaggaagactgacggtccccaggagttcaggtgctgggcacagcggccctgggctgcctggtcaaggactacttcccatacgtcgtactgagcgggctggcaaggcgcatagnnnnnnnnnnnnnnnnnnnnn

SEQ ID NO: 77312 - DNA, 171 bp, Homo sapiens; identical to SEQ ID NO: 77236
  misc_feature: GYAE6OF02IWOTZ.18.33.C11.1.454.CMB.1.raw
  modified_base (171)..(171): a, c, t, g, unknown or other
  misc_feature (171)..(171): n is a, c, g, or t

SEQ ID NO: 77313 - DNA, 175 bp, Homo sapiens; identical to SEQ ID NO: 77245
  misc_feature: GYAE6OF02F2GCJ.18.33.C11.1.454.CMB.1.raw
  modified_base (173)..(175): a, c, t, g, unknown or other
  misc_feature (173)..(175): n is a, c, g, or t

SEQ ID NO: 77314 - DNA, 173 bp, Homo sapiens; identical to SEQ ID NO: 77247
  misc_feature: GYAE6OF02G24JZ.18.33.C11.1.454.CMB.1.raw
  modified_base (173)..(173): a, c, t, g, unknown or other
  misc_feature (173)..(173): n is a, c, g, or t

SEQ ID NO: 77315 - DNA, 174 bp, Homo sapiens; identical to SEQ ID NO: 77242
  misc_feature: GYAE6OF02GMAI8.18.33.C11.1.454.CMB.1.raw
  modified_base (173)..(174): a, c, t, g, unknown or other
  misc_feature (173)..(174): n is a, c, g, or t

SEQ ID NO: 77316 - DNA, 174 bp, Homo sapiens; identical to SEQ ID NO: 77242
  misc_feature: GYAE6OF02HR0NI.18.33.C11.1.454.CMB.1.raw
  modified_base (173)..(174): a, c, t, g, unknown or other
  misc_feature (173)..(174): n is a, c, g, or t

SEQ ID NO: 77317 - DNA, 532 bp, Homo sapiens
  misc_feature: GYAE6OF02HVD7Y.18.33.C11.1.454.CMB.1.raw
tcagtacgagtatgcacgaccggtgctcgatttagagtgagctcgttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttattatagtggtggtaccacatactacacagactccgtgaagggccgattcaccatctcagaagacaattccaggaacacattgtatcttcaaatgaataacctgagagaccgagacacggccatgtatactgtgtgggctagttacttgacccgtggggacccgggaacctcggtcaccgtctccccaccctccaacccg

SEQ ID NO: 77318 - DNA, 174 bp, Homo sapiens; identical to SEQ ID NO: 77242
  misc_feature: GYAE6OF02GF98K.18.33.C11.1.454.CMB.1.raw
  modified_base (173)..(174): a, c, t, g, unknown or other
  misc_feature (173)..(174): n is a, c, g, or t

SEQ ID NO: 77319 - DNA, 178 bp, Homo sapiens
  misc_feature: GYAE6OF02GV24N.18.33.C11.1.454.CMB.1.raw
  modified_base (173)..(178): a, c, t, g, unknown or other
  misc_feature (173)..(178): n is a, c, g, or t
tcagtacgagtatgcacgaccggtgctcgatttagagtgagctcgttgggtttgggggaagaggaagactgacggtcccccaggagttcaggtgctgggcacagcggccctgggctgcctggtcaaggactacttcccatactcgtactgagcgggctggcaaggcgcatagnnnnnn

SEQ ID NO: 77320 - DNA, 175 bp, Homo sapiens; identical to SEQ ID NO: 77245
  misc_feature: GYAE6OF02GATGL.18.33.C11.1.454.CMB.1.raw
  modified_base (173)..(175): a, c, t, g, unknown or other
  misc_feature (173)..(175): n is a, c, g, or t

SEQ ID NO: 77321 - DNA, 173 bp, Homo sapiens; identical to SEQ ID NO: 77247
  misc_feature: GYAE6OF02F3TFE.18.33.C11.1.454.CMB.1.raw
  modified_base (173)..(173): a, c, t, g, unknown or other
  misc_feature (173)..(173): n is a, c, g, or t

SEQ ID NO: 77322 - DNA, 573 bp, Homo sapiens
  misc_feature: GYAE6OF02GQ2KD.18.33.C11.1.454.CMB.1.raw
  modified_base (183)..(184): a, c, t, g, unknown or other
  misc_feature (183)..(184): n is a, c, g, or t
  modified_base (186)..(186): a, c, t, g, unknown or other
  misc_feature (186)..(186): n is a, c, g, or t
  modified_base (188)..(190): a, c, t, g, unknown or other
  misc_feature (188)..(190): n is a, c, g, or t
  modified_base (192)..(192): a, c, t, g, unknown or other
  misc_feature (192)..(192): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (274)..(274): a, c, t, g, unknown or other
  misc_feature (274)..(274): n is a, c, g, or t
tcagtacgagtatgcacgaccggtgctcgattttagagtgagctcgttgggtttgggggaagagggaagactgacggtcccccagggagttcaggtggcctgggcacgagccggccggtgggctgcctggtcaaggctacttccgatactcgtactgagcgggctggcaaggcgccatacgcnncncnnngnantgagnacngncacntcatgtgcatgancatgcagctcttggagttgcatcaattcaaacgggaaactccccaactccgtnatactactactcgcgtactacttactacgtacggtcggtcgtacgtacgtacgtacgagtagacgagtgtagtacgtacggagagtacgtactactctacacactacacgcgactctcacgacgtacgtacgtacgttacgtactacttacttattactactactacgtacgttacgttaccgttacccgttaccgtaccgtacgggtacgggtacgggtacgtaacggtacggacgtacgacgacgacgtacgtcggtcgtcgtacgacgacgacgtcgttcgttctctcctcctccg

SEQ ID NO: 77323 - DNA, 173 bp, Homo sapiens; identical to SEQ ID NO: 77247
  misc_feature: GYAE6OF02HAI2Z.18.33.C11.1.454.CMB.1.raw
  modified_base (173)..(173): a, c, t, g, unknown or other
  misc_feature (173)..(173): n is a, c, g, or t

SEQ ID NO: 77324 - DNA, 173 bp, Homo sapiens; identical to SEQ ID NO: 77247
  misc_feature: GYAE6OF02FOS53.18.33.C11.1.454.CMB.1.raw
  modified_base (173)..(173): a, c, t, g, unknown or other
  misc_feature (173)..(173): n is a, c, g, or t

SEQ ID NO: 77325 - DNA, 587 bp, Homo sapiens
  misc_feature: GYAE6OF02HRTJE.18.33.C11.1.454.CMB.1.raw
  modified_base (365)..(365): a, c, t, g, unknown or other
  misc_feature (365)..(365): n is a, c, g, or t
  modified_base (385)..(385): a, c, t, g, unknown or other
  misc_feature (385)..(385): n is a, c, g, or t
  modified_base (477)..(477): a, c, t, g, unknown or other
  misc_feature (477)..(477): n is a, c, g, or t
  modified_base (575)..(575): a, c, t, g, unknown or other
  misc_feature (575)..(575): n is a, c, g, or t
tcagtacgagtatgcacgaccggtgctcgatttagagtgagctcgttgggtttggggggagaggagcccagcactgggattccgaggtgtttccattcggtgatcagcactgaacacagaggactcaccatggagttttggctgagcgtggtttccgttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaaggcctggagtggatcgtcacttatttatagtggtggtcgacatactacacanacgtcgtcgaggacggactntacactatcctagaagacaaactactacgaacgacactattagtacttctaaataacgtaataaacctacgagaacgacgaccggagaaccncgactatagtacttagtcgtagggtcggtacttaacgttaccgttccgtacccgggtcggggaacccggtcgtacggcccgtacccgtccctaccccncccgtaacccgg

SEQ ID NO: 77326 - DNA, 557 bp, Homo sapiens
  misc_feature: GYAE6OF02H03IT.18.33.C11.1.454.CMB.1.raw
  modified_base (299)..(299): a, c, t, g, unknown or other
  misc_feature (299)..(299): n is a, c, g, or t
  modified_base (357)..(357): a, c, t, g, unknown or other
  misc_feature (357)..(357): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctggggggtccctgagactctcctgtgcagtctctgggttcgtcagtggcgactacatgagctgggtcccnccaggctccgaggggaagggcctggagtggatctcacttattatagtggtggtaccanatactacacagactccgtgaacgggccgattcaccatctcagaagacaattccaggaacacattgtatcttacaaatagaataacctgagagcgaggacacggccatgtattactgtgtggggctagtttacgttacggacccgtggggacccgggaacccgtggtccgacccgttccgtcccccaccctcccgaacccg

SEQ ID NO: 77327 - DNA, 173 bp, Homo sapiens; identical to SEQ ID NO: 77247
  misc_feature: GYAE6OF02F3FR9.18.33.C11.1.454.CMB.1.raw
  modified_base (173)..(173): a, c, t, g, unknown or other
  misc_feature (173)..(173): n is a, c, g, or t

SEQ ID NO: 77328 - DNA, 547 bp, Homo sapiens
  misc_feature: GYAE6OF02IK0IC.18.33.C11.1.454.CMB.1.raw
  modified_base (357)..(357): a, c, t, g, unknown or other
  misc_feature (357)..(357): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctggggggtccctgagactctcctgtgcagtctctgggttcgtcagtggcgactacatgagctgggtccgccaggctccgaggggaagggcctgggagtggatctcacttattatagtggtggtaccanatactacacagactccgtgaacgggccgattccaccatctcagaagacaattccaggaacacattgtatcttacaaatgaataacctgagagccgaggacacggcatgtattactgtgtgggctagtttactgacccgtggggacccgggaacccgtcggtccaccggtcctcccctaccctccaacccg

SEQ ID NO: 77329 - DNA, 591 bp, Homo sapiens
  misc_feature: GYAE6OF02GSK5I.18.33.C11.1.454.CMB.1.raw
  modified_base (343)..(343): a, c, t, g, unknown or other
  misc_feature (343)..(343): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagcgtggtttcgtgttaggctatttcaaaaggtgtccagtgtgagtgcagttggtggagactggaggaggcttgatccagcctggggggtccctgagactctcctgtgcagtctctgggttcgtcagtggcgactacatgagcgtgggtcccgccagggctccgaggggaaggcctggagtggatctctattatttanaggttggtcggtaccactatactacacaagctccgtagaagggcccgaattcaacctatctacagaagactaattccaaggaacaacattgtacttcttacaaatgaactaactagagagcgacgcaacggccgaatgtacttaacgtgtagtgggtctagtttaccgttcgtaccccggtcggggacccgggtaacccgttcgggtaccgtaccgttccccgtccccctacccgttccccaacccgg

SEQ ID NO: 77330 - DNA, 564 bp, Homo sapiens
  misc_feature: GYAE6OF02G5WPI.18.33.C11.1.454.CMB.1.raw
  modified_base (393)..(393): a, c, t, g, unknown or other
  misc_feature (393)..(393): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaacgggcctggagtggatctcacttattatagtggtggtaccacatactacacagactccgtgaacggccgattcaccatcncagaagacaattccagaacacattgtattctacaaatagaataacctgagagaccgaggacacggccagtgtattactgtgtgggactagtttacgtcgtaccccggtggggacccggggtaaccctcgggtaccgtacccgttcccgtaccccctaccctcccaacccgg

SEQ ID NO: 77331 - DNA, 551 bp, Homo sapiens
  misc_feature: GYAE6OF02H59SI.18.33.C11.1.454.CMB.1.raw
  modified_base (402)..(402): a, c, t, g, unknown or other
  misc_feature (402)..(402): n is a, c, g, or t
  modified_base (418)..(418): a, c, t, g, unknown or other
  misc_feature (418)..(418): n is a, c, g, or t
  modified_base (430)..(430): a, c, t, g, unknown or other
  misc_feature (430)..(430): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtcctgagactctctgtgcagtctctgggttcgtcagtggcgatacatgagctgggtccgccaggctccgagggaagggcctggagtggatctctacttatttagtagtggtggttaccactatactacacagactcgtagaagggccgtatcactatctacagaanacaattccaggaacanattgtatcttanaaatgaataacctgagagccgagacacggcatgtattatgtgtgggctagtttactcgacccgtggggacccgggtaaccgtggtaccacccggttccctacccctaccccaccaacccgg

SEQ ID NO: 77332 - DNA, 545 bp, Homo sapiens
  misc_feature: GYAE6OF02JAHFO.18.33.C11.1.454.CMB.1.raw
  modified_base (359)..(359): a, c, t, g, unknown or other
  misc_feature (359)..(359): n is a, c, g, or t
  modified_base (469)..(469): a, c, t, g, unknown or other
  misc_feature (469)..(469): n is a, c, g, or t
  modified_base (528)..(528): a, c, t, g, unknown or other
  misc_feature (528)..(528): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctgggtccgccaggctccagggaagggcctggagtggatctcacttattatagtggtggtaccacatactanacagactcgtgaaggccgattcacatctcagaagacaattcccaggaacacattgtattcttacaaatgaaataacctgagacgccgagacacggcagtagtacttacgngttgtgggctagtttcttcgacccggttggggcccggtaaccgtggtaccaccgtcccnccccacctccaacccgg

SEQ ID NO: 77333 - DNA, 553 bp, Homo sapiens
  misc_feature: GYAE6OF02GMLM0.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccaggggaagggcctggagtggatctcacttatttatagtggtggtaccacatactacacagactccgtgaagggccgattccacatctcagaagacaattccaggaacacattgtatctacaaatgaataactgagagaccgagacacggtcttgtattactgtgtggggctatttacgtcgtacccgtgggggcccggtacccgtcggtccgaccgtccgtccccacccgtcccgaccgtaaccggg

SEQ ID NO: 77334 - DNA, 529 bp, Homo sapiens
  misc_feature: GYAE6OF02HZ4AD.18.33.C11.1.454.CMB.1.raw
  modified_base (513)..(513): a, c, t, g, unknown or other
  misc_feature (513)..(513): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgcaggctccgagggagggcctggagtggatctcacttattatagtggtgtaccacatactacacagactcgtgaacgggccgattcaccatctacagaagacaattccaagaacacattgtatctacaaatgaatacctgagagcgagacacggcatgtatacgtgtgtgggctagtttactcgacccgtgggacccggaccgtggtccaccgtccnccccaccgtccaaccg

SEQ ID NO: 77335 - DNA, 175 bp, Homo sapiens; identical to SEQ ID NO: 77245
  misc_feature: GYAE6OF02HFJLO.18.33.C11.1.454.CMB.1.raw
  modified_base (173)..(175): a, c, t, g, unknown or other
  misc_feature (173)..(175): n is a, c, g, or t

SEQ ID NO: 77336 - DNA, 660 bp, Homo sapiens
  misc_feature: GYAE6OF02I2OB6.18.33.C11.1.454.CMB.1.raw
  modified_base (419)..(419): a, c, t, g, unknown or other
  misc_feature (419)..(419): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccgaggctccgaggggaacgggcctgggagtggatctcgtacttattataggtggtcgtaccactatacctacacgactaccgtacgtaggacggccgtactaccgaactactctacaaganaactaacgtccgaagaactactactagttacttactaataactagaaacctacgtgaacgcgaacggtacgaacgaccgtactagttacgttacgtagttacggtcgggttacgggactttaaccggtttcggttaacccgggtacccggggtaccgggggaaccccggggttaacccgtccgggtaaccgttacccccgttacccctaccccccgtaacccgtaccccgtaaccccgggg

SEQ ID NO: 77337 - DNA, 175 bp, Homo sapiens; identical to SEQ ID NO: 77245
  misc_feature: GYAE6OF02G6MKZ.18.33.C11.1.454.CMB.1.raw
  modified_base (173)..(175): a, c, t, g, unknown or other
  misc_feature (173)..(175): n is a, c, g, or t

SEQ ID NO: 77338 - DNA, 553 bp, Homo sapiens
  misc_feature: GYAE6OF02H5XBL.18.33.C11.1.454.CMB.1.raw
  modified_base (301)..(301): a, c, t, g, unknown or other
  misc_feature (301)..(301): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
tcagtacgagtatgcacgaccggtgctcgatttagagtgagctcgttgggtttggggggggagaggagcccagcactgggattccgaggtgtttccattcggtgatcagcactgaacacagaggactcaccatggagtttttggctgagctgggttttccttgttgctatttcaaaaggtgtccagtgtgaggtgcagttggtggagactgggaggaggcttgatccagccgtggggggtccctgagactctcctgtgcagtctctgggttcgtcagtggcgactacatgagctgggtccnccgaggctccgaggggaacgggccgtggagtggatctctacttattatagtggtggtaccacatactacacagactcgtgaacggccgattcaccatctacagaacgacaacttccaggaacacattgtatcttacaaatnaatacngagagcgagacacggcatgtatactgtgtgggctagtttactcgtacccggtggggcccggtaacccgtcggtaccacccgtcctccccaccccgtccaacccgg

SEQ ID NO: 77339 - DNA, 667 bp, Homo sapiens
  misc_feature: GYAE6OF02IEHAG.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactgggaggaggcttgatccagccgtggggggtccctgagactctcctgtgcagtctcgtgggttcgtcagtggcgactacatgagctcgggtccgccaggctccgaggggaagggcctggagtggatctctactttatttataggtggtacggtaccatatactacacacgacctccgtaggaacgggccgtattccacctatctacaagaacgaactaacttccgaaggaaccactattagttacttacttaacaaatactaaactaacctaggaagacggaacccgaggaaccgtacggaccctaagtcgttaattaaccgttggtacgggttacggggtactttacgtttaaccgtttaccggaccccggtacgggggggaccccgggtaaccccggttcgggtaccccgtaccccgttccccgtacccccccgtacccccgtacccgtaaaccccggg

SEQ ID NO: 77340 - DNA, 784 bp, Homo sapiens
  misc_feature: GYAE6OF02HJ6XG.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctggagactctcctgtgcagtctctgggttcgtcaggtggcgactacatgagcgtggggtcccgccgaggcctccgagggaacgggccgtgggagtggatcgtctactttattatagtggtaggtaccacatactacacacgactccgtagaacggggtccagttccaccgtatccgtacaaggaacgaacctaaacttacccgaagggaaacctaactaagtttacgtaaactttcctttaacgtaaaaattacggaaaacttaaacccgtaggaaaacggacggtaaccccggaaaggggaacccgtaacccggggaccctaaagtttacgggttaaaacttttaaccgtgggttacgggttacggggggtaacctttaacggttttttaaaccggttcccgggttaaaccccccgggttcggggggggtaaccccccgggggggttaaacccccgtttcgggggtttaacccccgtaacccccgggtttaccccccttaccccccccggtaaccccccgttacccccgtaaaaccccccgggg

SEQ ID NO: 77341 - DNA, 734 bp, Homo sapiens
  misc_feature: GYAE6OF02GQ205.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtgggggtccctgagactctcctgtgcagtctctgggttcgtcagtggcgactacatgagctcgggtcccgccacggcctccgaggggaacgggccgtagggagtggatctctactttattatagtggtacggtaccacatactacacagacctccggtagaacgggccgaattccacctatcctacgaagaaagtaacaacttcccgaaggaaacctactacgtttgttaacttacctttacgaaaattgtaaaaccttaaaccgttggaacggaaccgtacccggaagggaaccctaaccggggcccttaaagttacgggttaacttttaacggtgggtttacgggttacgggggtactttaaccggttttttaaccggttacccggggaaccccccgggtttcggggggggtacccccggggggtaaccccgtttcgggggttccccctaaccccggtttccccccgtaccccccgtaacccccgttccccccgaaaacccggg

SEQ ID NO: 77342 - DNA, 175 bp, Homo sapiens; identical to SEQ ID NO: 77245
  misc_feature: GYAE6OF02FXZF1.18.33.C11.1.454.CMB.1.raw
  modified_base (173)..(175): a, c, t, g, unknown or other
  misc_feature (173)..(175): n is a, c, g, or t

SEQ ID NO: 77343 - DNA, 745 bp, Homo sapiens
  misc_feature: GYAE6OF02HDRKV.18.33.C11.1.454.CMB.1.raw
  modified_base (259)..(259): a, c, t, g, unknown or other
  misc_feature (259)..(259): n is a, c, g, or t
  modified_base (270)..(270): a, c, t, g, unknown or other
  misc_feature (270)..(270): n is a, c, g, or t
tcagtacgagtatgcacgaccggtgctcgatttagagtgagctcgttgggtttgggggggaggaggagcccagcactgggattccgaggtgtttccattcggtgatcagcactgaacacagaggactcaccatggagttttggctgagctgggttttccttgttgtcttttttaaaggtgtccagtgtgaggtgctagctggtggaagtcccgggggaggcttagttcgagccgtggggggtccctggacgactctccngtgcagccctntggatttcacgttctagtcgtcctacgtggatcgcaacgtcggtactccccggacctaacggttccgaaggggaaacgtacggaccgttgggtacggttcgggtaccgttactaacggttaaagtttaaaacgattaggggaaggttcggggggtacgtacccaacgtaacttccccgttaccgggccgggttaaccctcgggttgggaaccgggggtcccacgtttaccacccgtaagtccccgtacccgaacggaaccgtaaacccaaccgaaaaccgaacgaaccgtcttacgtaacttctacggaactaagtacgacgcctagtcggtaggcggttacggacgacgtacgggtccttagttaccgttatacgttcgtgacgtaagggtacgggtaaccgtacggtacgcccggtaagggtcgggttcggtaccccggcccggtacgggacccgtacgggaacccgttccgg

SEQ ID NO: 77344 - DNA, 679 bp, Homo sapiens
  misc_feature: GYAE6OF02HOOTP.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggtttccttgttgctatttcaaaggtgtccagtgtgaggtgcagttggtggagactggaggaggcttgatccagccgtgggggtccctgagactctcctgtgcagtctcgtgggttcgtcagtggccgactacatgagctgggtcccgcgaggcctccgaggggaacgggccgtggaggtggtatcgtactactttaatttagtagtgggtacgtaaccactaatactaacacagaccgtcgaggaacgggaccgacttccgaaccctatcctacgaagaaacgtacaaacttcccgaaaggaaacctaactagttttacgtattacctttaacgaaattgaaacttaacctaggacgtaacgaccggtagacgaccggacctaagtttcggtaatttaccgtgggttaggtacggggtactttacgtttacggttccggaacccccggttcgggggaccccggggtaacccgttcgggttacccgaccccgttccccgtaccccccctacccgtacccccgaacccgg

SEQ ID NO: 77345 - DNA, 574 bp, Homo sapiens
  misc_feature: GYAE6OF02JDU39.18.33.C11.1.454.CMB.1.raw
  modified_base (452)..(452): a, c, t, g, unknown or other
  misc_feature (452)..(452): n is a, c, g, or t
  modified_base (463)..(463): a, c, t, g, unknown or other
  misc_feature (463)..(463): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
tcagtacgagtatgcacgaccggtgctcgatttagagtgagctcgttggggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtggggggtccctgagactctcctgtgcagtctcgtgggttcgtcagtggcgactacatgagcgtgggtccgccgaggctccgagggagggcctggagtggatctcactttatttatagtggtagtaccagatacacacagactccgtgaacgggccgattccaccatctacagaaacgactaaacttccaaggaacactattagtattacttacaaatnaaacttaaccngaagacgacgagacacggcaatgtattagngtaggngggactacgtttctacgacccgtgggggacccggaccctggtaccaccgtcctaccccctacccgtcccaaccgg

SEQ ID NO: 77346 - DNA, 684 bp, Homo sapiens
  misc_feature: GYAE6OF02IL62O.18.33.C11.1.454.CMB.1.raw
  modified_base (266)..(266): a, c, t, g, unknown or other
  misc_feature (266)..(266): n is a, c, g, or t
  modified_base (318)..(318): a, c, t, g, unknown or other
  misc_feature (318)..(318): n is a, c, g, or t
tcagtacgagtatgcacgaccggtgctcgatttagagtgagctcgttggggtttggggggggtaggaggagcccagcactgggattccgaggtgtttccattcggtgatcagcactgaacacagaggactcaccatggagttttggctgagctgggttttccttgttgctatttcaaaggtgtccagtgtgaggtgcagttggtggagactgggaggagggctttgatccagccgtggggggtacccctggagacctctcctggtncagtctcgtgggttacgtcaggttcggcgactacatggagcgtggggtcccnccgaggcctccgaggggaacgggtcctggggagtggacttctactactttagtttactaggtggtcggtaccacattacgtacacgacgaccttccgtaggaaacgggtccctattccaaccataccgtacaagaaacgactaacttccaaagggaacactattaggttaactctttacaaattacaaacttaaccgtacggaagaacgggtacccgaaggaaccaccgggtacctagtagttacttacgtggtggtacgggtacttagtttaccgttaccggccccgggtacgggggtccccgggaaacccgttcggttacccgacccgtttacccgaccccctacccccgttaccaaccccggg

SEQ ID NO: 77347 - DNA, 772 bp, Homo sapiens
  misc_feature: GYAE6OF02IW7RK.18.33.C11.1.454.CMB.1.raw
tcagtacgagtatgcacgaccggtgctcgatttagagtgagctcgttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccggtcgggggtcctgacgacctctcctgtgcagtctcgtgggttcgtcgaggtggccgactacagtgacgtcgtcgggtccgccgacgggcctaccggaggggaacggggtccgtagggaggtcggactccgtactacttttaagtttagtaggtcggttacggtaaccactaactaacctaacacaacgtaccgtaccggtaggaacgggtcccgtaattacccaaccgtacttaccgtaacgaacggaaacgtaactaaacgttaccgaaaggtaacctaacttagttacgttaacttacttaacaaaattacgtaaacttaaccgtagaacgaacggaaccggaaacgggaccaaccgggtactaacgttacgtttaacttaacgttggtacggggttacgggtacttttaacggttttaacccgggtttacccggtaacccccggggttcggggggaacccccggggttaaacccgtcgggttaccccggtaccccgttacccccgttaccccccgaaccccgttaccccggaaccccgg

SEQ ID NO: 77348 - DNA, 579 bp, Homo sapiens
  misc_feature: GYAE6OF02FXA52.18.33.C11.1.454.CMB.1.raw
tcagtacgagtatgcacgaccggtgctcgatttagagtgagctcgttgggtttggggggggagaggagcccagcactgggattccgaggtgtttccattcggtgatcagcactgaacacagaggactcaccatggagttttggctgagctgggttttccttgttgctattttcaaaaggtgtccagtgtgaggtgcagttggtggagactggaggaggcttgatccagcctggggggtccctgagactctcctgtgcagtctctgggttcgtcagtggcgactacatgagcgtgggtccgccgaggcctccgagggaagggcctgggagtggatctcacttatttatagtggtgtaccacatactacacagactcgtgaacgggccgtattccacatctcagaagacaattccaaggaacactattgtattacttacaaattgaaacttaacctagaagtacgaccggaggaccacgggacctagtcgtatactgtggtgggctagtttaccgtcgacccgtggggcccgggtaaccgtcggtaccgacccgtccgtaccccctccctcccgaacccgg

SEQ ID NO: 77349 - DNA, 610 bp, Homo sapiens
  misc_feature: GYAE6OF02FGIYD.18.33.C11.1.454.CMB.1.raw
  modified_base (376)..(376): a, c, t, g, unknown or other
  misc_feature (376)..(376): n is a, c, g, or t
tcagtacgagtatgcacgaccggtgctcgatttagagtgagctcgttgggtttgggggggagaggagcccagcactgggattccgaggtagtttccattcggtgatcagcactgaacacagaggactcaccatcggagttttggctgagctgggttttccttgttgctatttcaaaaggtgtccagtgtgaggtgcagttggtggagactggaggaggcttgatccgagccgtggggggtccctggagactctcctgtgcagtctctgggttctcagtggcactacagtgagcgtgggtcccgccaggcctccgaggggaacgggccctggggagtgggattcgtcgaactttatttataggttggtcggtaccanagtacctacacagacctcgagaacgggcctagttccaccatcctacagaacgaacaaacttcccaaggaaccacattgtattcttacaaatgaatacctgagagcgaggaccgacggtacctagtgtaattcgtgtcggtagggctacgtttacgttccggaccccgtgggggacccgggtaacccgtgggtccctacccggttccctaccccctacccgtcccgtaacccggg

SEQ ID NO: 77350 - DNA, 668 bp, Homo sapiens
  misc_feature: GYAE6OF02I5AES.18.33.C11.1.454.CMB.1.raw
  modified_base (559)..(559): a, c, t, g, unknown or other
  misc_feature (559)..(559): n is a, c, g, or t
tcagtacgagtatgcacgaccggtgctcgatttagagtgagctcgttggggtttgggggggagaggagcccagcactgggattccgaggtgtttccattcggtgatcagcactgaacacagaggactcaccatggagttttggctgagctgggtttccttcgttgtctatttactaaaggtagtcctagtagtgaggtgcagttggtggagactggaggaggcttgataccagccgtcgggggtccgtcgagactctcctgtgcagtcttcgtggttcgtcagtggcgactacatgtagcgtcggtcccggcacggctccgaaggggacgggccgtggagtggatctcgacttatttagttaagtggtcggtaaccactaataccgtaacacgacgacctaccgggtacgtaaacggggccgtaactactaacccgtactaccgtcgtaaagaaacggtaccaaattacccgaaggtaacactagttagtacttatttaccaaagtagtaaactaacctagacgacggaccgagaacgtcgacctattagtatttacgnggtgggtaggtacttagtttcgttacccggacccgggtcccggggtaccgggtacccgttacggtcccggacccttccccgtacccccgtacccgtacccgtaacccgg

SEQ ID NO: 77351 - DNA, 568 bp, Homo sapiens
  misc_feature: GYAE6OF02IHOAV.18.33.C11.1.454.CMB.1.raw
  modified_base (355)..(355): a, c, t, g, unknown or other
  misc_feature (355)..(355): n is a, c, g, or t
  modified_base (420)..(420): a, c, t, g, unknown or other
  misc_feature (420)..(420): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatgggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaaggcctggagtggatctctacttattatagtggtgtaccanatactacacagactccgtagaacgggcctattccaccatctacagaagacaattccaaggaacanattgtattcttacaaatgaaactactagagacgaccgagaccacggcatgtattacgtgtggtgggactagtttactcggaccccgtgggggaccccgggtaaccgtggtaccctaccggtccctacccctaccccgtccgaacccgg

SEQ ID NO: 77352 - DNA, 816 bp, Homo sapiens
  misc_feature: GYAE6OF02IR42Z.18.33.C11.1.454.CMB.1.raw
  modified_base (286)..(286): a, c, t, g, unknown or other
  misc_feature (286)..(286): n is a, c, g, or t
tcagtacgagtatgcacgaccggtgctcgatttagagtgagctcgttggggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtggttcgtcagtggcgactacangagcgtcgggtccgccgacgggcctaccggaggggaacggggcctgggagtggatccgttctactttatttagtaggttggtacggtaccaactaacttacctaacaacctagacccgtaccgtaaggaacggggtcccgtaatttccaaccctatccgttaacgaagaaacgtaactaaacgttcccgaaaggaaacctaacgtaactttacggttaaactttaccgttaactaaaagttacgtaaaacgttaaaccgtaggtaaacggtaccgggacccggtaaacgggaacccgtaaccggggccttaaaagttaccggttaaacgttttaacgttacggggtttaggggttcgggggtaacccgttttaacggtttttaacccggtttaacccggggttacccccgggttaccgggggggtaccccccggggggttaaacccggtttcccggggttaaccccgtaacccccgggtttacccccaccccccccggtttaaaccccccgtccccgtaaacccccgggg

SEQ ID NO: 77353 - DNA, 515 bp, Homo sapiens
  misc_feature: GYAE6OF02HK8HN.18.33.C11.1.454.CMB.1.raw
  modified_base (256)..(256): a, c, t, g, unknown or other
  misc_feature (256)..(256): n is a, c, g, or t
  modified_base (469)..(515): a, c, t, g, unknown or other
  misc_feature (469)..(515): n is a, c, g, or t
tcagtacgagtatgcacgaccggtgctcgatttagagtgagctcgttgggttttgggattcacgttgcagatgtaggtctgggtgcccaagctgctgaagggccgattcaccatctcagaagacaattccaggaacacattgtatcttcaaatgaataacctgagagccgaggacacggccatgtattactgtgtggggctatttactcgaccccgtggggccgggaaccgtggtccaccgtcctaccccaccccnccttaccacgggcccacgtccggtaccttcccccgtcggccaccctccctaccgaacgacgccaccgtcggtacgggggccacgacggccggccccgtcggggcctcggtccgttcggtaccgaaccggtacctttaccgttccctaattaccgttaccgtacgttggacggccgggcgtacgggacgaacgggccgtacaatagcagcagcnnnnnnnnnnnnnnnnnnnnnnnnnnnnnnnnnnnnnnnnnnnnnnn

SEQ ID NO: 77354 - DNA, 798 bp, Homo sapiens
  misc_feature: GYAE6OF02H5R2J.18.33.C11.1.454.CMB.1.raw
tcagtacgagtatgcacgaccggtgctcgatttagagtgagctcgttggggtttgggggggagaggagcccagcactgggattccgaggtgtttccattcggtgatcagcactgaacacagaggactcaccatggtagttttggctgagcgttgggttttccttgttgcttatttacgaaaggtgtaccagtgtgaggtgctaggttgggtggagacgtgggaggaggcttgactccgaggtcccggtcggggggtccctggacgtacctcctccgttaggtgcctaggttccttcggttggggtttccgacggtaggtcggtacgacctaacgtagtcggacgtccggttacgggtccccgccgtacggtccgttaccgggaacggggaagggtccggtagggtaacgggtcggtaacgttccctacgtttaacttttaagtttaaaggtcgggtttacggggtaaccggtaaccctaacttaaccgtaaacctaaccgtaaaccgtaaacggttacccgttaccggggtaacgtaaacccgggggtcccgtaaaccgttaccccgtaaaccgttacttaccgttaacggtaaacgaaaaccggtaacttaaaccgtacccgtaaaagaacccctaagttagttacgttactttaacctaactaataacgtaaactaacgtaggacgtacgacggacgacgaccgactagtgtactagtgtggagtactacggttctccggcggtcccgggtaccggaccttcgggcctcccctcccgtacccaccccgatacccgg

SEQ ID NO: 77355 - DNA, 748 bp, Homo sapiens
  misc_feature: GYAE6OF02HLUDK.18.33.C11.1.454.CMB.1.raw
  modified_base (241)..(241): a, c, t, g, unknown or other
  misc_feature (241)..(241): n is a, c, g, or t
  modified_base (304)..(304): a, c, t, g, unknown or other
  misc_feature (304)..(304): n is a, c, g, or t
tcagtacgagtatgcacgaccggtgctcgatttagagtgagctcgttgggtttgggggggaggaggagcccagcactgggattccgaggtgtttccattcggtgatcagcactgaacacagaggactcaccatggagttttggctgagctgggtttccttgttgctatttcaaaggtgtccagtgtgaggtgcagttggtggagacgtggaggaggcttgatccagccgtgggggtcctgngactctcctgtgcagtctcgtgggttcgtacaggtggcgacgtacagttgagcttggggcccnccgaaggctcccgagggaaggcctggacgtggatctcacgttattacgtagtggtacggtaccacgatacgtaacacgtaagaccttccggtaggaagggtccgatttaccaacctaacgtctacgaggtaaaacggactaaacgtttaccaagggaaaccactaagtttggtaacttacccttaactaaaacgtagggtaaaacttaaaccgtcgtaaaggtaaccgggtaccggaagggttaacccaaccgggccctaaagtttaacccggtaatttaaccgttggtcggttacgggggaccttaaaggttttaacccgttccgggtaacccccggttaccggggggggtaaccccggggtaaccccgttaggggtttacccaaccccggggtttaccccctaaccccccggttacccctcccccgggtaaaaacccccggg

SEQ ID NO: 77356 - DNA, 916 bp, Homo sapiens
  misc_feature: GYAE6OF02HV1ZR.18.33.C11.1.454.CMB.1.raw
tcagtacgagtatgcacgaccggtgctcgatttagagtgagctcgttgggtttggggggagaggagcccagcactgggattccgaggtgtttccagttcggtgatcagcactgaacacagaggactcaccatggtagttttggctgagtcttgggtttttccttgttgtactatttcgaaaaggtgtccgagtgtgaggtgcaggttggtggagacgtgggaggacggcttgactccgagtcccggtcggggggtcccctaggacgtacctccgttccgtgtgacgtacgttcgttcgttcgggttcgtacgtaggtcggtaccgactacgagtgacgtcgttcgggtcccgaccgaggcgtacggaggggtaacgggtcctgggaggtcggtacttccgttacttaacttttagtttaagttacggttcgggtaacggttaaccccgtaataacttacgtaacgaaccgtaacgtacccgtaccgggtaacggaaaccggggtacccgtaacgtttacccaacccgttaactacccggttaacgaaaacggtaaaccggtaaaccttaaaacgtttaccccggaaaagggtaaaaccctaccgtttaaaggtttttacggtaaaacctttaccgtttaaaccgtaaaacgttaacggtaaaaacgttaaccccgtaagggtaacggaaaccgggtacccccggaaaagggtaaacccccgtaaccgggtacccgtttaaagtttcgtttaaaacttccgggtttagggttacgggttacggggttaactttaaaccggtttttaccccggtccggggtaccccgggttaaccggggggaacccggtttaaccccgttcggttacccggtaacccgttcccccgtttaaccccgtccccccaacccggtaccccgg

SEQ ID NO: 77357 - DNA, 750 bp, Homo sapiens
  misc_feature: GYAE6OF02FS5LA.18.33.C11.1.454.CMB.1.raw
  modified_base (514)..(514): a, c, t, g, unknown or other
  misc_feature (514)..(514): n is a, c, g, or t
tcagtacgagtatgcacgaccggtgctcgatttagagtgagctcgttgggtttggggggggagaggagcccagcactgggattccgaggtgtttccattcggtgatcagcactgaacacagaggactcaccatggagttttggctgagcttgggttttccttgttgctatttcaaaaggtgtccagtgtgagggtgcaggttggtggagacgtgggaggaggcttgatccgagccgtggggggtcccctggacgacctctcctgtcgcacgtcctcgttggggttcgtcgtaggtgggccgtaactacgatggacgtcgtcggggtcccgcccgagggcctccggaacggggaacgggccgtagggagtggattcctactactttagtttataggtgggttacggtaaccctacaactacctaacacgtacgtacctccggtaggaacggtccgtaacttccaacctatcctacgaagtaacaactaaacttccgaaaggtaacctactagttntaacttacttaactaaacttacgtaaaacttaaccgtaggaacggacggtaccggacgggtaacccgaccggtcctaattcggttaacgtttacgtggttagggtcgggtacttaacgttttcccggttacccggtaccccggggtaccggggggtaccccgggttaacccggttccgggttacccgttaccccggttcccctccccccgtaccccgtaccccggtaaaccccggg

SEQ ID NO: 77358 - DNA, 758 bp, Homo sapiens
  misc_feature: GYAE6OF02IIWF3.18.33.C11.1.454.CMB.1.raw
tcagtacgagtatgcacgaccggtgctcgatttagagtgagctcgttggggtttggggggggagaggagcccagcactgggattccgaggtgtttccattcggtgatcagcactgaacacagaggactcaccatggagttttggctgagctgggttttccttgttgctattcaaaaggtgtccagtgtgaggtgctagttggtggagactgggaggaggcttgatccaggtccgtggggggtccctggacgtaccttcctcctggtcgcagtcttcgtgggttctcgagtcggcgaactacatgagccgtcgggtccgccgacggcgtaccgaggggacggccgtggagtggatcgtctacttattagtaggtggtacggtaccactactactacacaagcctaccggtagaacgggtcctattaccaccgtatacctacgaacgaaagacctaaacgttccgaaacgtaaccaacgttattacgttaacttactttaaactaaaacgttacgtaaaccttaaaccgttagaacggtaaccgaccgggacgggaaccgtaaccgggacctaagttaccgttaagttacgttagggtacgggttacggggaccttttaacggtttaacccggtacccggtaaccccccggggttacgggggggaaccccccggggtttaaacccggttccggggttaccccgttaacccgggttccccccgtaacccccctcccccccggtaaccggtaaccccccggg

SEQ ID NO: 77359 - DNA, 725 bp, Homo sapiens
  misc_feature: GYAE6OF02IL3IQ.18.33.C11.1.454.CMB.1.raw
  modified_base (315)..(315): a, c, t, g, unknown or other
  misc_feature (315)..(315): n is a, c, g, or t
  modified_base (557)..(557): a, c, t, g, unknown or other
  misc_feature (557)..(557): n is a, c, g, or t
  modified_base (626)..(626): a, c, t, g, unknown or other
  misc_feature (626)..(626): n is a, c, g, or t
  modified_base (712)..(712): a, c, t, g, unknown or other
  misc_feature (712)..(712): n is a, c, g, or t
tcagtacgagtatgcacgaccggtgctcgatttagagtgagctcgttggggtttgggggggagaggagcccagcactgggattccgaggtgtttccattcggtgatcagcactgaacacagaggactcaccatggtagttttggctgagtcgttggtttccttgttgctatttacaaaggtgtcctagtgtgaggtcgctaggttggtggagacgtagggaggaggtcttgactccgagccggtcgggggtccctgacgtactcgtcctggctacgtgtcgtcgtcggttcgtcgtagtcggactacctatacgnggcgtcgtcgggtcccgcccgacggtccgtaccggaacggggtacggtccggtagggtacggtcggacttaccgtaccgttaatttagtttagtacggttcggtaacggtaaccctacgtaactacgtaacaacgtacgtacaccgggtaggaaccggtaccgtactacccaactcgtccgtaagacgtaacacgtaaacgttccgaagaacctgtacttagtaaccttacgtaaactaaanacgtaacctaacgtcgaagtaaccgcggaacgaaccgtaccgtaccgtagttacttaacggttcgtagnggtcgtacgttaccgttccgaccggttacccgggcgggtacccggttaaccgtccggttcccacccgttccctacccccggtaccncccggtaaaccgg

SEQ ID NO: 77360 - DNA, 673 bp, Homo sapiens
  misc_feature: GYAE6OF02I3UXL.18.33.C11.1.454.CMB.1.raw
  modified_base (217)..(217): a, c, t, g, unknown or other
  misc_feature (217)..(217): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(619): a, c, t, g, unknown or other
  misc_feature (618)..(619): n is a, c, g, or t
  modified_base (624)..(625): a, c, t, g, unknown or other
  misc_feature (624)..(625): n is a, c, g, or t
  modified_base (627)..(627): a, c, t, g, unknown or other
  misc_feature (627)..(627): n is a, c, g, or t
  modified_base (629)..(630): a, c, t, g, unknown or other
  misc_feature (629)..(630): n is a, c, g, or t
  modified_base (632)..(632): a, c, t, g, unknown or other
  misc_feature (632)..(632): n is a, c, g, or t
  modified_base (634)..(636): a, c, t, g, unknown or other
  misc_feature (634)..(636): n is a, c, g, or t
  modified_base (638)..(640): a, c, t, g, unknown or other
  misc_feature (638)..(640): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
  modified_base (648)..(648): a, c, t, g, unknown or other
  misc_feature (648)..(648): n is a, c, g, or t
  modified_base (650)..(650): a, c, t, g, unknown or other
  misc_feature (650)..(650): n is a, c, g, or t
  modified_base (657)..(657): a, c, t, g, unknown or other
  misc_feature (657)..(657): n is a, c, g, or t
  modified_base (661)..(661): a, c, t, g, unknown or other
  misc_feature (661)..(661): n is a, c, g, or t
  modified_base (665)..(665): a, c, t, g, unknown or other
  misc_feature (665)..(665): n is a, c, g, or t
  modified_base (668)..(669): a, c, t, g, unknown or other
  misc_feature (668)..(669): n is a, c, g, or t
tcagtacgagtatgcacgaccggtgctcgatttagagtgagctcgttggggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttgggtggagactggaggnggcttgatccagccgtcgggggtccctgacgtactctcctgtcgctagtctcgtcggggttcgtcaggtggcgtaactacagtgaggtcgtcggggtccgccgacggcctccggaggggaacggccgtggaggtggactcgactacttattagtaggttggtacggtacctagtaactagtaacccacgtacgtaccgttccgggttaacggaaacgggggtccctaacgtttacccgaaccctaacgtttacccgttaccggaaaaacggtaaaaaccggggttaaacccctaaaaacggttttaccccccgggaaaaaaaggggtaaaaacccccttaaaaccccggttttaaaaagggttttttttttaaaccccgggggtttttaaaaccccntnannatacnngncnncngnnntnnngngntgtncncgtgcgntgcnctcnccnncacg

SEQ ID NO: 77361 - DNA, 646 bp, Homo sapiens
  misc_feature: GYAE6OF02F2GWK.18.33.C11.1.454.CMB.1.raw
  modified_base (436)..(436): a, c, t, g, unknown or other
  misc_feature (436)..(436): n is a, c, g, or t
  modified_base (518)..(518): a, c, t, g, unknown or other
  misc_feature (518)..(518): n is a, c, g, or t
tcagtacgagtatgcacgaccggtgctcgatttagagtgagctcgttgggtttggggggggagaggagcccagcactgggattccgaggtgtttccattcggtgatcagcactgaacacagaggactcaccatggagttttggctgagctgggttttccttgttgctatttcaaaggtgtccagtgtgaggtgcaggttggtgggagacgtgggagggaggcttgatccaggccgtcgggggtccctgacgactctcctgtcgctgtctcgttgggttcgtcagtggacgtactacatgagtcgtcggtccgcgacggctccgagggacggcgtggagtggatctactactttattataggtcggttacgtaccacgtactaactactacaacgtcgttaccgaggtaacgggcgtacttccactactctacgaanacgaactacgtacaaggaccaatacgttatacttactaataaactagtaaacgtaacctgacgacgacggacacgggtaccncttagttatactacgttcgtagggttcgtactacgttttaccaccggtaccccgggttgggggtaacccgggtaccctacgggttcccctacccgtacccctcccccgtaccgcccgtaaaccccggg

SEQ ID NO: 77362 - DNA, 765 bp, Homo sapiens
  misc_feature: GYAE6OF02JC102.18.33.C11.1.454.CMB.1.raw
  modified_base (177)..(177): a, c, t, g, unknown or other
  misc_feature (177)..(177): n is a, c, g, or t
  modified_base (320)..(320): a, c, t, g, unknown or other
  misc_feature (320)..(320): n is a, c, g, or t
  modified_base (603)..(603): a, c, t, g, unknown or other
  misc_feature (603)..(603): n is a, c, g, or t
tcagtacgagtatgcacgaccggtgctcgatttagagtgagctcgttggggtttgggggggagaggagcccagcactgggattccgaggtgttccattcggtgatcagcactgaacacagaggactcaccatggtagtttggctgagctgggtttccttgttgctatttcaaaggtntcagtgtgaggtgctagttggtggagtacgtggaggaggcttgatcacgccgtgggggtccctgagtctcgtcgtcggtgctacgtcttcgtcgggttctcgaagtcggcgtactaactgtagtacggtcgtacggggtcccncgacggtacctaccgggaacggtaacgggtccgtagggacgtggtaactcgttactaacgtttagttaacgttaaggtcggtaacggtacccgtaacgtaataccgtaaacacgtaacggtaccgtacgtaagggaaaccggtcccggtaattaccgacttaacctgaccaacggtaagtaaccgtaacgttaccgaaagaaactaacgtactttaacggtattaacccttaaggtaaactaccggtaaataacccgtaggagaaccggtcgaacggtaaccnggtaaccttaagttgttaaacgttaacctggttaccggtagggtagtttaccgttacccgggttaacgggccccggttaacggggggaacccgttaaccccggtacggggttacccacccgggttacccctaaccccgggttacccctaccgtaacccgggg

SEQ ID NO: 77363 - DNA, 230 bp, Homo sapiens
  misc_feature: GYAE6OF02IW72O.18.33.C11.1.454.CMB.1.raw
  modified_base (178)..(230): a, c, t, g, unknown or other
  misc_feature (178)..(230): n is a, c, g, or t
tcagtacgagtatgcacgaccggtgctcgattttagagtgagctcggttgggtttgggggggaagaggaagactgacggtccccccaggagttcaggtgctcgggcacagcggccctgggctgcctggtcaaggctacttcccatactcgtactgagcgggctggcaaggcgcatagnnnnnnnnnnnnnnnnnnnnnnnnnnnnnnnnnnnnnnnnnnnnnnnnnnnnn

SEQ ID NO: 77364 - DNA, 737 bp, Homo sapiens
  misc_feature: GYAE6OF02JFTIB.18.33.C11.1.454.CMB.1.raw
  modified_base (211)..(211): a, c, t, g, unknown or other
  misc_feature (211)..(211): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (347)..(347): a, c, t, g, unknown or other
  misc_feature (347)..(347): n is a, c, g, or t
  modified_base (478)..(478): a, c, t, g, unknown or other
  misc_feature (478)..(478): n is a, c, g, or t
tcagtacgagtatgcacgaccggtgctcgatttagagtgagctcgttgggttgggggagaggagcccagcactgggattccgagtgttccattcggtgatcagcactgaacacagaggactcaccatggagtttggctgagtctcgggttttccttgttgccttatttcgaaaggtgtccagtgtgagtgctgttggtgtagactggaggnggcttgactccgagccgtgggggtccctgacgacgtctcgtagtgcgagtcttcgtgggttcnctaggtcggcgtactacgngttacggctacgtcggtccgaccgacgtccgtaccgagggtaacgggcctaggnggtcgggtactacgttctacgtttagttcgtaggttcggtacggtacacgtaacttaacaccgtacgtaacggtactccggtaaggtacccggtcggtacgtaccgtacaccgttacgttcgaacggtaanaccgtacgttacccgtaagaacttaccgaggttactaccgtttcgttaacgtaaacgttgtaacctaacgtcggtacgtaggaaccggagtaaccgtaccgacgttacgttaacgtttacgtaaccgttgggttacgtcggggtactttacgttaaccggtcggttaacccgggttccggggtacgggttacccccggtttagtaaccccggtttacccgtaccccggttacccctaacccgtcccggtttaaccccgg

SEQ ID NO: 77365 - DNA, 850 bp, Homo sapiens
  misc_feature: GYAE6OF02GWDDV.18.33.C11.1.454.CMB.1.raw
  modified_base (581)..(581): a, c, t, g, unknown or other
  misc_feature (581)..(581): n is a, c, g, or t
tcagtacgagtatgcacgaccggtgctcgatttagagtgagctcgttgggtttgggggggagaggagcccagcactgggattccgaggtgtttccagttcggtgatcagcactgaacacagaggactcaccagtggagttttggctgagcgttgggttttccttgttgcttatttacaaaaggtcgtccagtgtagaggtgctaggttggtggagacgtgggaggaggtcttgacgtccgacggtcccggttcggggggttccctggacgtaccttcctccgtgtcgctagttctcgttggggttcgtcgaggtcggaccgtactacattggacgtcggttcgggtcccgccgtacggccgtccggaagggggaacggtcccgtaggggaacggttgggacttcctactaaccgttttatttaaggtacggttggggttaccggtaacccaactacgttaaacctacgaacctaacgtacccgttaccggtaacgggtaaccggggcccgttaattaccgaaccccttatacccttacgaaacggaaactaacctaaaccgtttacccgaaacggtaaacnccgttaagtttacgttaacgttacctttaaacgaaattaacgtaaaccgttaaaccgtacggaacggtaccggtaccgggaacggtacccgaaccgggtcctaagtttaacgttagttaccgttagggtccgggttacgggtactttaacgttttaccggttacccgtacccccgggggttagggggaacccccgggttaaccggttccggttaccccgtaccccggtttaccccacccccccgttacccgtacccccgtaaccccggg

SEQ ID NO: 77366 - DNA, 729 bp, Homo sapiens
  misc_feature: GYAE6OF02HH4R4.18.33.C11.1.454.CMB.1.raw
  modified_base (221)..(221): a, c, t, g, unknown or other
  misc_feature (221)..(221): n is a, c, g, or t
  modified_base (234)..(234): a, c, t, g, unknown or other
  misc_feature (234)..(234): n is a, c, g, or t
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
  modified_base (299)..(299): a, c, t, g, unknown or other
  misc_feature (299)..(299): n is a, c, g, or t
  modified_base (629)..(629): a, c, t, g, unknown or other
  misc_feature (629)..(629): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagcgttgggtttttccttgttgcttatttacaaaaggtgtccagtgtgaggtgctagttggtggagacgtggaggnggtcttgactccngccgtcgggggtcccngacgctcctcngtgcagtctgtcggttcgctaggtcggacgtactatangacgtcgtcggtccgccgacggacgtacggacgggaacgggtccgtgggacggtggactctacgttactttaatttagtagtggtacgtaccgaatactacgttaacacgtaacgtccgtaccgtaggaaccggtccgtacttaccacccttattccctaaccgaacgtaaacgtaaacctaacgttacccgaaaggtaacccgtaacttacgttcgttaaacttcgttaaactaaagttaacgtaaacgtaacccggttagaacggacgaccggaaagggacctaaccggacttacgttacgttaaacgttgtacggtggtaccggttnttaacggtttaccgtccggtacccgggaccggggacccgggttaccgtaccggttccgtaccccgtccccgtaccccgtaccccgtacccgtaaccccgg

SEQ ID NO: 77367 - DNA, 686 bp, Homo sapiens
  misc_feature: GYAE6OF02H14PA.18.33.C11.1.454.CMB.1.raw
  modified_base (471)..(471): a, c, t, g, unknown or other
  misc_feature (471)..(471): n is a, c, g, or t
  modified_base (585)..(585): a, c, t, g, unknown or other
  misc_feature (585)..(585): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaccatggagttttggctgagcttgggtttttccttgttgtcttaattttacgaaaaaggtgtccagtgtgaggtgcgtaggttggtggagacgtgggaggaggcttgacttccacgccggttcggggggtcccctgacgtaccttcctcctggtcgactcgttcgttcggttcgggttccgtcgaggtcggccgtactacagtggacgtcggtcgggtcccgccgacgccgtaccgggaggggacgggcctgggagtggtactcgtactacttagttattaggtcggtacgtaccactatacacacgacgtacgtaccggtggacggtccgtactccgacctancctacgaagaaccgaacgtaactccggaaagaacctacgtagtttaccgtatttaccgtaataaagtactaaacgtaccgtagaacggacgacgaacggacgtaccggctagtntaacgttgtggttaggcgtacttattaccgtccggtacccgggtcgggaccccggtactccggtaccctccggtcccccacccctaccgacccgtaaccgg

SEQ ID NO: 77368 - DNA, 924 bp, Homo sapiens
  misc_feature: GYAE6OF02JPJCS.18.33.C11.1.454.CMB.1.raw
tcagtacgagtatgcacgaccggtgctcgatttagagtgagctcgttggggtttggggggggagaggagcccagcactgggattccgaggtgttccattcggtgatcagcactgaacacagaggactcaccatggagttttggctgagctgggtttccttgttgctatttacgaaaggtcgtcctagtgtgaggtgactaggttgggtggagacgtgggaggaggcttggattccgacgtccggtcgggggtcctagagtacctctccgtgtcgctacgtctcggttcgggttcgtcgtaggtcggacgtacctataacgtggacgtccgtcggggtcccgaccgtacggtccgtaccgggaggggtaacggggtccggtacggggaggttcggtaacgttccgttacgttaaccgtttaacgttttaggtacgggttacgggtacgggttaaccctaaccgtaacgttaaccgtaaccgtaaccgaacggttacccggtaaccggtacggggttaaaccgggtacccggttaaacgtttccgaaacccgtacgtttaacccgtaacgtaacgggtaaaccgtaaacgttaaacccgttacccggtaaaacggtaaacctaaaccggttactttaacgggttaactttaaccgttaaaaccgtttaaaacgttaccggttaaaccttaaaccggtagggtaaaccggtaccgggttaaccccggaagggtaacccggtaaccgggtaccgtaaacgttaccgggttaaacgtttaacccgggttaggttccggggttaacgggtccgttttaaccgtttaaccggttacccgggttaacccgggtaccgggggttacccgggtaacccggttcggacccggtttccccgtacccccgtacccggtacccctacccgtaccccgg

SEQ ID NO: 77369 - DNA, 875 bp, Homo sapiens
  misc_feature: GYAE6OF02GO6WW.18.33.C11.1.454.CMB.1.raw
tcagtacgagtatgcacgaccggtgctcgatttagagtgagctcgttgggtttggggggagaggagcccagcactgggattccgaggtgtttccattcggtgatcagcactgaacacagaggactcaccagtggagttttggctgagcttggttttccttgttgcttaatttcaaaaggtagtccagtgtgaggtgctagttggtggagacgtggacggaggtcttgactccgagccggtgggggtcccctagacgacctcctccgtagtgctagtcttcggtgggtttccgcgtaaggtcggaccgtaactacgtagtggacgtccggtcgggtcccgacgacgggtccgtaccggaaggggaacgggtccgtagggacggtcggtaacttccgtaacgttaacttttagtttaagtacggttacgggtactaaccgtaacctaactaaccttaaccgtaacccgaacgaaccgttaacccgttaccgggtaacggtaaccgggtacccttaaccgtaaccaaaccttcgttaacccgtaaacgaacggttaaaacgtaaccgttaaacccttaacccggaaacggtaaccctaagtttacggttaacttaacccttttccttaaaaacggtaacttaaacgtaaaccttaaccggtggaaaaccggttaccggacccgggtaaccggaaccgttacccggtaaccgtacgtttacggtaaaccttttcgggagggtttacggcggttttaaccgtttaacccgtttacgggtaaccccgggtccccgggggttaaccgggggtaccccggttaacccttcgggttaacccccgtccccgtaccccccttacccccgtaccccgtaacccccgg

SEQ ID NO: 77370 - DNA, 659 bp, Homo sapiens
  misc_feature: GYAE6OF02H4N9D.18.33.C11.1.454.CMB.1.raw
  modified_base (302)..(302): a, c, t, g, unknown or other
  misc_feature (302)..(302): n is a, c, g, or t
  modified_base (454)..(454): a, c, t, g, unknown or other
  misc_feature (454)..(454): n is a, c, g, or t
tcagtacgagtatgcacgaccggtgctcgatttagagtgagctcgttgggtttggggggagaggagcccagcactgggattccgaggtgtttccattcggtgatcagcactgaacacagaggactcaccatggaattggggctgagctgggttttcctcgttgctattttagaaggtgtccagtgtgacgtgcagctggtggagtcgtgggggagcttggtccagccgtgggggtccctgagctctcctgtcgcacggccctgcagttcattctttaatagttatggatgcagtcgggtccncgaggccgtaccggggggaagggcccggaggtggtcgaccaacataagtcgacaagatacggactggaagtaacgtaactagttggtaggtactcgtaggtacggaacggggtacctaatttcccgaacctagttcccacctaaacgggaanaaccctaaacgtaaccgttaaaaggttaacctttacgtaggttaacttcgttacgaaactaagttacgaaacctacggcctacgagaccggccggaagacccgaggtcttaggttacttagttaccgtggtcgaccgggaaagtcgaggtaggtcggaccgtaggggtaactcggtagggtacccgttgggaccggggaaacccg

SEQ ID NO: 77371 - DNA, 768 bp, Homo sapiens
  misc_feature: GYAE6OF02GLAJF.18.33.C11.1.454.CMB.1.raw
  modified_base (180)..(180): a, c, t, g, unknown or other
  misc_feature (180)..(180): n is a, c, g, or t
tcagtacgagtatgcacgaccggtgctcgatttagagtgagctcgttgggtttggggggggagaggaggcccagcactgggattccgaggtgtttccattcggtgatcagcactgaacacagaggactcaccatggagttttggctgagctgggttttccttgttgctatttcaaaggtntccagtgtgaggtgcagttggtggagacgtgggaggaggcgttgactccgagccgtggggggtcccctggacgactcctccgtgtgctagtctcgtgggttccgtcaggtcggcgactacagtgacgtcctcgggtccgccgaggccgtccgaggggaacgggtccgtacgggagtagggatacgtactacgtttaatttagtaggttgggtggtaaccaactaattaactacaactacgtacctccggtaggaacggggccgacttaccgaacctctactaccgaagaaagaacctaaacttacccgaacggtaaacaactaacgttggttaacttaccgtttaacaaaagtctaaaacgttaaccgtacgtaacgggtacggaccggacgggaacccgtaccgggaccctaacgtaacgttaaacgttaaccgttagggttgggtaccgggggtctttaaggtttaacccggttaccggtacccccgggtcggggggtaccccgggggttaacccgtttacggggtacccgttaccccgggttccccgtttaccccccgtacccccgtaaccccgtaacccccggg

SEQ ID NO: 77372 - DNA, 907 bp, Homo sapiens
  misc_feature: GYAE6OF02JRYBE.18.33.C11.1.454.CMB.1.raw
  modified_base (894)..(894): a, c, t, g, unknown or other
  misc_feature (894)..(894): n is a, c, g, or t
tcagtacgagtatgcacgaccggtgctcgatttagagtgagctcgttgggtttgggggggagaggagcccagcactggattccgagtgtttccattcgtgatcagcactgaacacagaggactcaccagtggtacgttttggcttcgaggtcgttcggggtttttccgttggttggtcttagtttacgaaaagggttcgttacctaggttcggtggtacggttgtccgtaggttcgggttacgggaacgtacggttagggagggtcggtccttgtactcccgaggtcccgggttccggggggttcctaggaacggtcctccgttccgtggtcgtctacggttccgttacgggttcggttcggtaccgtagggttccgggacgttaacgttactaggtcggtacggtccgggtccggttcccgacccggacggtcgtaacccggtaaggggaccggggtccttaggggtcggttacgggttactccggttagtttaaccgtttaggttaaggttcggtacgggttaccgttaccaacgttaacgtacccgtagtaaacggcggttacgtacggtacggtaaacggggtcctaaacttacctaccgtaactcccggtaactaaaccggtaacgtaaaccgttacgtaacccgaaaggttacctaggttaacccttagtttaacgttaaccgtttaacgttaaacgtaacgttaaccgttaacggtaacggtacggaaccggtaaaccggttacggacccgaaccggttactaccggttacgtttaaccgttgttacgggttacggtacggttaccgtaacggtttcccggttaccgtaccggggtaccgggacccggttaaccgtcgtaacccgtccgtacccccgaccttacccncccggttaaccgg

SEQ ID NO: 77373 - DNA, 914 bp, Homo sapiens
  misc_feature: GYAE6OF02FZOZF.18.33.C11.1.454.CMB.1.raw
  modified_base (137)..(137): a, c, t, g, unknown or other
  misc_feature (137)..(137): n is a, c, g, or t
  modified_base (188)..(188): a, c, t, g, unknown or other
  misc_feature (188)..(188): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
tcagtacgagtatgcacgaccggtgctcgatttagagtgagctcgttgggtttgggggggagaggagcccagcactgggattccgaggtgtttccattcggtgatcagcactgaacacagaggactcaaccataggngttttaggctgagctggttttccttgttgctatttacgaaaggtgcagtgngaggtgcagttggtggagacgtaggaggaggcttgatccaggccggtgggggtccctggacgtactctcctgtgcagtccgtcgttcgggttcgtntaggtcggacgactaacngtgacgtcggtcgggtacccgacgacgggccgtcccggaagggggtaccgggtcccggtagggtaagggtcggtacgttacgttacccgttaaccgttttaagttttaacggtacggggtttacggggttaccggtaaacccgtaaccgttaaccgtttaaacccgttaaaccgaacccgtaaaacgggttaccgttaccccggggttaaggggtaaaacccgggggttacccggttaaaccttaacccgtaacccttaacggtttacccttaaccgaaagggttaaaacgtaaaccccttaaacgttaaccccgaaaacggtaaccctaaaccgttagttaaacggtttacttaccgttaaactaaaagttaccgtaaaaacgtaccgttaggaacggtaccgggaaccgggtaacggaaccggtaccggtaccgtaacttaacgggttaaactttcgggtacgttaggggtccggtaacgttaccgttttaacggtacccgggtacccccgggttaccgggggaacccggggttacccccggttcgggttaaccccgtacccccggtttccctacccccccggttaccccgtaccccgtaaacccccggg

SEQ ID NO: 77374 - DNA, 621 bp, Homo sapiens
  misc_feature: GYAE6OF02JG7BA.18.33.C11.1.454.CMB.1.raw
  modified_base (201)..(201): a, c, t, g, unknown or other
  misc_feature (201)..(201): n is a, c, g, or t
  modified_base (272)..(272): a, c, t, g, unknown or other
  misc_feature (272)..(272): n is a, c, g, or t
  modified_base (343)..(343): a, c, t, g, unknown or other
  misc_feature (343)..(343): n is a, c, g, or t
  modified_base (368)..(368): a, c, t, g, unknown or other
  misc_feature (368)..(368): n is a, c, g, or t
tcagtacgagtatgcacgaccggtgctcgatttagagtgagctcgttggggtttgggggggagaggagcccagcactgggattccgaggtgttccattcgtgatcagcactgaacacagaggactcaccatggtagttttggctggagtctgggttttcttgtgctattcaaagtgtcagtgtgaggtgcagttggtgganacgtggaggaggcttgactcgacgccgtagggggtcctgacgactctctgtgctagtctcgttggttactntaggtcggcgtactacgattagcgtcgtcgggtccgtccgaggcctaccggaggggtaacggtccgtaggngtggaactctacgtctttacttagngtcggtacgtactactatacctataactagactccggtacggaagggcccgtagtccgaactagtaccacgaagaaacgactaattaccgagtaaacctactattacgttactacttaactaagtacgaaataccaggtaacgacgaccgagtaccgacgcttatcgtaatacgtgtagtggacgtagttccgcggtaccggacgggtacccggtactacgtcgacccgttacctcccgacctcccgtaacgg

SEQ ID NO: 77375 - DNA, 797 bp, Homo sapiens
  misc_feature: GYAE6OF02FHNA1.18.33.C11.1.454.CMB.1.raw
tcagtacgagtatgcacgaccggtgctcgatttagagtgagctcgttgggtttggggggacgaggagcccagcactgggattccgaggtgtttcattcggtgatcagcactgaacacagaggtactcgaccagtggtagtttggctggagtcgttggtttttcctgttgtacttactttacgaaaggtcgttaccgtagtcgtaggagttcgacgttagttgggtaggacggtacgtaggagggtaacgtcggtttacgacgtccgtacggtaccgggttcgggggtacccctggtacgccttacgttccgttgtacgtcgtacgttcgttacggtcggttcctacggtaggtaccgtctactagtgtacgtacggtccggttacggccgtaccgacggtcgtaaccggtacgggtaaccggtggtagggtagtcgtactacttcgtatttagtagtacggtacggtcgtaacatacgttaacacggactaccggtacgtccgggaaagtccggtacttactccggacctcttacaacggtacgaacgtacgttaaccgtacggtaaaccgtaactacggtacgttacttacgttactaacgttaataaccgtaacgttacgaaccgttacgaaccggtaacgtaccggaccgtaaccggtccgttaagttacttaacggttacgtacgttagggtacggttacctacggtttaccgccgggttacccgggttaccggcccggtaccgttccgtccgttacccgtccccggtaccctacccggtacccgtaacccgg

SEQ ID NO: 77376 - DNA, 801 bp, Homo sapiens
  misc_feature: GYAE6OF02HKC1G.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccatggagtttggctgagtcgttggttttccttgttgcttatttacgaaaaggtgtccagtgtgaggtgcgtagttggtggagacgtggaggaggcgttgactccgaggtccggtcgggggtccctggaacgtacctccgtccgtggtcgcgtacgttccgttcggttcggggttctccgaggttcggacgactactagtggacgtcggttccgggtcccgaccgtaacggtccgtaacccggagggggaaccggtccgtagggagtcggtaacttctacgttacgttttaagtttacgtaggtggtacgtacctaatacgttaactactacgacgtaccgtccggtaaggaacggtccgtattaccgaccgtactcgtaacgaaacggtaaactactaacgttaccgaaacggtaccaacttatttacgttaacttaccttaaacgtaaaacgttagtaaaaccttaaccggtacgaaacgggaccggtaaaccccggtaagggaacccgaaccggttacctaagttaagtttaaacccttacgggtgttacggggttacgggtaacttttaaccggtttccggtacccggtacccggggtacggggtaccccggtaccttcgggttaccctacccgtacccccgtacccgtacccccgtaccgtaacccgg

SEQ ID NO: 77377 - DNA, 1000 bp, Homo sapiens
  misc_feature: GYAE6OF02F4N24.18.33.C11.1.454.CMB.1.raw
tcagtacgagtatgcacgaccggtgctcgatttagagtgagctcgttgggtttggggggagaggacgcccagcactgggattccgaggttgtttccattcggtgatcagcactgaacacagaggactcgaccagtggtagtttggctgagtcgtttggttttccttgttgcttaatttacgaaaggtcgtccagtgtggaggtgactaggttggtgagacgtgggaaggtggtctgtactccgacggtccggtcgggggtaccctaggtaccgtaccttccgtcgttggtacgacgttagttccgttccgttcggttccgtcggtacggtcggtacgtaacttaacgtcgtcgtaacggtcggtaccgggtcccgaccggtacggtcccgtaaccgggaaccgggggtaacggtccggtaacgggttacgggtacgtaccgttaccgtttaccgtttaacgttttaaagttttaggttacgggtaccggggtttacgttaaacccctactttaaaccgttaaccgttaacccgtaacggtaaaccgttaacccgggttaacccgggttaggggtaaaccccgggttaacccgtttacccgttacccgttaaacccgttacgtttaacccgtaaccggaaaaccggtaaaacgtaaacccgttaaacgtttaaccccggaaaacggttaccctaaagtttacccgtttaagtttaacccgtttaactttaaaacgtaaaacgttaaacccgttaaccgttaaaacgacgggtttaaaccgccgggtaaacggtaccgaaacccgtacgttaccgttaaacgtacgtttaaacggtacggtttcgggtacgggtttacgtaccggtttaaccgttaacccgggtttcccggaaacccccgggggtttcccgggtaaaacccggggttccccgtttaaccgggaccccgtttcccccggtaccccgttaacccccgtacccggacccccgttaaaccccgggg

SEQ ID NO: 77378 - DNA, 852 bp, Homo sapiens
  misc_feature: GYAE6OF02JLN31.18.33.C11.1.454.CMB.1.raw
tcagtacgagtatgcacgaccggtgctcgatttagagtgagctcgttgggtttgggggggagaggagcccagcactgggattccgaggtgtttccattcggtgatcagcactgaacacagaggactcaccatgggtagttttcggctgtaggtcgttggggtttttccttggtttagtccttagtttacaaaagggttgtccgtagtggtgtagggttcgactagggttgggtacggaggtacgtggggacgggtaggtcgttggacgtacccgtacggtacccgggttcgggggttccctaggtagtacccgtcttcccggtacgtcgtaccgtacgttcgttcggttcggggttacctacggtaggtacggccgtaaccgtagtactcggtagtcgggttccgggaccccgtccgtacgggtaccgtaccggtaaggggggaccgtccggttgggacgtacgtcgttcgttacttacgttaagttaaggtcggtacggtacggtacctacgtaaagtacccaacggtacgaacgttccggtacggttaacggtaaccgggtccttaacgttaaccctacgtacgtaccgtaacgaacgtaaccgtaactaaccgttaccgaacgaacgtaccgtaagtacgttaacgtactttaaacgaagttacgaacgttacgtaccgtaaggacgtaccggaacggaccgtacgtaccgttagttaacgtttacgtacggtcggtaacgggtagttacgttaccgtttacgggtacccgggttccgggtacgggtacccggttaccgtaccggttcccggtaaccttccccggtaacccctccgtacccgtaaccgg

SEQ ID NO: 77379 - DNA, 201 bp, Homo sapiens
  misc_feature: GYAE6OF01CUX4L.49.81.H04.1.454.CMB.1.raw
  modified_base (201)..(201): a, c, t, g, unknown or other
  misc_feature (201)..(201): n is a, c, g, or t
tcagagtcgagagacacgaccggtgctcgatttagtagtgtagattcgcgggcacgaccggtgctcgatttagtagtgtagattccgcgggcacgaccggtgctcgatttagtcacgcgagaaaggaaggggctggccctgacgtgttctgttcccgccctcctctctctcgactctgagcgggctggcaaggcgcatagn

SEQ ID NO: 77380 - DNA, 165 bp, Homo sapiens
  misc_feature: GYAE6OF01DDASJ.49.81.H04.1.454.CMB.1.raw
  modified_base (165)..(165): a, c, t, g, unknown or other
  misc_feature (165)..(165): n is a, c, g, or t
tcagagtcgagagacacgaccggtgctcgatttagtagtgtagattcgcgggcacgaccggtgctcgatttagtcacgcgagaaagggaaaggggctggccctgacgtgtttctgttcccaccctcctctctctcgactctgagcgggctggcaaggcgcatagn

SEQ ID NO: 77381 - DNA, 203 bp, Homo sapiens
  misc_feature: GYAE6OF01DRBKI.49.81.H04.1.454.CMB.1.raw
  modified_base (202)..(203): a, c, t, g, unknown or other
  misc_feature (202)..(203): n is a, c, g, or t
tcagagtcgagagacacgaccggtgctcgatttagtagtgtagattcgcgggcacgaccggtgctcgatttagtagtgtagattccgcgggcacgaccggtgctcgatttagtcacgcgagaaagggaaggggctggccctgacgtgtttctgttcccacctcctctctctcgactctgagcgggctggcaaggcgcatagnn

SEQ ID NO: 77382 - DNA, 203 bp, Homo sapiens
  misc_feature: GYAE6OF01BRQ8V.49.81.H04.1.454.CMB.1.raw
  modified_base (202)..(203): a, c, t, g, unknown or other
  misc_feature (202)..(203): n is a, c, g, or t
tcagagtcgagagacacgaccggtgctcgatttagtagtgtagattcgcgggcacgaccggtgctcgatttagtcgagctctctcgcgggcacgaccggtgctcgatttagtcacgcgagaaagggaaggggctggccctgacgtgtttctgttcccgccctcctctctctcgactctgagcgggctggcaaggcgcatagnn

SEQ ID NO: 77383 - DNA, 501 bp, Homo sapiens
  misc_feature: GYAE6OF01DO497.49.81.H04.1.454.CMB.1.raw
  modified_base (217)..(217): a, c, t, g, unknown or other
  misc_feature (217)..(217): n is a, c, g, or t
  modified_base (473)..(473): a, c, t, g, unknown or other
  misc_feature (473)..(473): n is a, c, g, or t
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtaccagcagttcccaggaacgccccagactctcattcatgacaataacaagcgagtcccagagattcctgaccgattctctggctccaagtctggcacctcagcaccctggccatcacggctccagactggggacaggccgattatactgcggaacatgggattccagcctgagtggtgtcagggtgttcggcggagggaccaagctgaccgtctaggtcagccaaggctggcccctggcnctctcgttcccgcctctctctctcgtac

SEQ ID NO: 77384 - DNA, 487 bp, Homo sapiens
  misc_feature: GYAE6OF01BXPCN.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaatcccctaacctcctgatctacgatgcatccaatttgaaatagggtccatcaaggttcagtgaagtggatctgggacgtatttacttcactatcatcaactgcagcctgaggatattgacaacataattactgtacaacaatatgataatctaccatcactttcgacggtacggaccaggtggagatacgaaacgtatgtgctgactacatctgtcttcgtac

SEQ ID NO: 77385 - DNA, 502 bp, Homo sapiens
  misc_feature: GYAE6OF01AHZ13.49.81.H04.1.454.CMB.1.raw
  modified_base (496)..(496): a, c, t, g, unknown or other
  misc_feature (496)..(496): n is a, c, g, or t
tcagagtcgagagacacgaccggtgctcgatttagtagtgtagattcgcggggagtcccaaccaggacacagcatggacatgagggtccctgctcagctcctggggctcctggtgctctggctctcaggtgccagatgtgacatccggatgacccagtctccatcctccctgtctgcatctgtaggagacagaatcaccatcacttgccaggcgactcaggacattagcaactatttaaatggtatcagcagaaaccaggaaagcccctaaacctcctgatctacgatgcatccaatttggaaataggggtcccatcaaggttcccagtggaagtggatctgggacgtattttactttcaccatcatcaacctgcagcctgaggatattgcaacatattactgtacaacaatatagataatctaaccactctactttcggcggagggaccacggtggagatacaaacgaacgtgtggctgcaccatctgtcttcgnttcccg

SEQ ID NO: 77386 - DNA, 508 bp, Homo sapiens
  misc_feature: GYAE6OF01DGDVD.49.81.H04.1.454.CMB.1.raw
  modified_base (424)..(424): a, c, t, g, unknown or other
  misc_feature (424)..(424): n is a, c, g, or t
tcagagtcgagagacacgaccggtgctcgatttagtagtgtagattcgcgggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaaacattgggaagaattatgtatcgtggtaccagcagttcccaggaacggccccagactcctcattcatgacaataacaagcgagtcccagagattcctgaccgattctctggctcaagtctggcactcagccaccctggccatcaccggactccagactggggacaggccgattattactgacggaacatgggattccagcctgagtggtgtcagggtnttcggcggagggaccaagctgaccgtctaggtcagccaaggctggcccctggtcactctgttcccgcccttctctctctcgtac

SEQ ID NO: 77387 - DNA, 538 bp, Homo sapiens
  misc_feature: GYAE6OF01DL6PH.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatccctccctgtctgcatctgtaggagacagaatcaccatcacttgccaggcgactcaggacattagcaaactatttaaattggtatcagcaagaaaccagggaaacgcccctaacctcctgatctacgatgcatccaatttaggaaatagggtcccatcaaggttcagtgaagtgatcgtgggtacttattttacttcacctatcatcaactgcagctgagtatatgacaacatatttactagtacaacgtaattatagaattaactctaacccgtattcctaacgtttcgggacgggtagggaaccctagggttaggagtagtaccgaaaacggtactgggtcgacttgacctaccattctcgttccttctacc

SEQ ID NO: 77388 - DNA, 489 bp, Homo sapiens
  misc_feature: GYAE6OF01BYH5V.49.81.H04.1.454.CMB.1.raw
  modified_base (485)..(485): a, c, t, g, unknown or other
  misc_feature (485)..(485): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcacatcatcaacctgcagcctgagatattgcaacatattactgtcaacaatatgataatctaccactcactttcggcggagggaccaggtggagatacgaaacgtatggtggctgcacatctgtcttntacc

SEQ ID NO: 77389 - DNA, 510 bp, Homo sapiens
  misc_feature: GYAE6OF01C2PY3.49.81.H04.1.454.CMB.1.raw
  modified_base (215)..(215): a, c, t, g, unknown or other
  misc_feature (215)..(215): n is a, c, g, or t
  modified_base (300)..(300): a, c, t, g, unknown or other
  misc_feature (300)..(300): n is a, c, g, or t
  modified_base (388)..(388): a, c, t, g, unknown or other
  misc_feature (388)..(388): n is a, c, g, or t
  modified_base (494)..(494): a, c, t, g, unknown or other
  misc_feature (494)..(494): n is a, c, g, or t
tcagagtcgagagacacgaccggtgctcgatttagtagtgtagattcgcgggggacaatcttcatcatgacctgctcccctctcctcctcacccttctcattcactgcacagggtcctgggcccagtctgtgttgacgcagccgccctcagtgtctgcggcccaggacagaaagtcaccatctcctgctctggaagcagctccaacattgggaanaattatgtatcgtggtaccagcagttcccaggaacggccccagactcctcattcatgacaataacaagcgagtccagagattccngaccgattctctggctccaagtctggcactcagccaccctgccatcaccggactccagactgggacgaggccgattatactgcggaanagtggattccagctgagtgtgtcgagggtgtcgggcggagggaccaagctacgaccgtcctaggtccagcccaaggctcggccccctggtccactctcgttccccnccctctctctctcgac

SEQ ID NO: 77390 - DNA, 507 bp, Homo sapiens
  misc_feature: GYAE6OF01CNWOM.49.81.H04.1.454.CMB.1.raw
  modified_base (217)..(217): a, c, t, g, unknown or other
  misc_feature (217)..(217): n is a, c, g, or t
  modified_base (497)..(497): a, c, t, g, unknown or other
  misc_feature (497)..(497): n is a, c, g, or t
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtacagcagttccagaacgccccagactctcattcatgacaataacaagcgagtccagagattcctgaccgatctctggctccaagtctggcacctcagccaccctggccatcaccggactcagactggggacaggccgattatactgacggaacagtgggaattccgagcctgagtggtgtcgagggtgttcggcggagggacaaggctgaccgttcgaggtcagcccaaggctggcccctggtcactctcgttcccgcctcctntctctcgtac

SEQ ID NO: 77391 - DNA, 514 bp, Homo sapiens
  misc_feature: GYAE6OF01CFS22.49.81.H04.1.454.CMB.1.raw
  modified_base (265)..(265): a, c, t, g, unknown or other
  misc_feature (265)..(265): n is a, c, g, or t
  modified_base (398)..(398): a, c, t, g, unknown or other
  misc_feature (398)..(398): n is a, c, g, or t
  modified_base (422)..(422): a, c, t, g, unknown or other
  misc_feature (422)..(422): n is a, c, g, or t
  modified_base (487)..(487): a, c, t, g, unknown or other
  misc_feature (487)..(487): n is a, c, g, or t
  modified_base (504)..(504): a, c, t, g, unknown or other
  misc_feature (504)..(504): n is a, c, g, or t
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggcccaggacagaaagtcaccatctcctgctctggaagcagctccaacattgggaagaattatgtatcgtggtaccagcagttcccaggaaccggccccagactcncattcatgacaataacaagcgagtcccagagattcctgaccgattctctggctccaagtctggcacctcacgccaccctgccatcacccggactccgagacgtggggaccaggccgattactactgacggaanagtgggaattccgagcctgagtgngtcgagggtgttcggcggagggaccaagcgtagaccgtcaggtcagccaggctcggccctggtcnctctcgtcccgcctccntctctcgtac

SEQ ID NO: 77392 - DNA, 512 bp, Homo sapiens
  misc_feature: GYAE6OF01CBM3I.49.81.H04.1.454.CMB.1.raw
  modified_base (217)..(217): a, c, t, g, unknown or other
  misc_feature (217)..(217): n is a, c, g, or t
  modified_base (479)..(479): a, c, t, g, unknown or other
  misc_feature (479)..(479): n is a, c, g, or t
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtaccagcagttcccaggaacggccccagactcctcattcatgacaataacaagcgagtcccagagattcctgaccgattctctggctccaagtctggcactcagccacctggccatcaccggactccagactggggacaggccgattatactgacggaacatgggattccagcctgagtggtgtcagggtgtcggcggagggaccagctgaccgtctaggtcagccaaggcctacggcccctggccnctcctgttccccgccttcctctctcctcgtacc

SEQ ID NO: 77393 - DNA, 696 bp, Homo sapiens
  misc_feature: GYAE6OF01C1T0T.49.81.H04.1.454.CMB.1.raw
  modified_base (220)..(220): a, c, t, g, unknown or other
  misc_feature (220)..(220): n is a, c, g, or t
  modified_base (313)..(313): a, c, t, g, unknown or other
  misc_feature (313)..(313): n is a, c, g, or t
tcagagtcgagagacacgaccggtgctcgatttagtagtgtagattcgcggggggacaaggtcttcatcatgacctgctcccctctcctcctcacccttctcattcactgcacagggtcctgggcccagtctgtgttgatgcagccgccctcagtgtctgcggccccaggacagaaagtcaccatctcctgctctggaagcagctccaacattgggaaanaattatggtaactcgtggtaccagctagttcccaggtaacggccccagactcctcattcatgaacaataaccaagcgagtcccagagattccngaccgtattcctctggcctccaagtctggcacctcgacgccacccgtggcccaatccacccgggtactcccgaagaccgtgggggaccgagggcccgtaagtttaagttaccgtgggacgggaacctaaggttcggggtaactttacccgaggtcccgttaggacggttcgggttcgtcggtaagggggtttcggtttaaccggggacggggtaacggggaaccctaaaggtcgttcgggtaacccggttccgtaaggggttacccaagggtcccccgtaaagggcccgttaccgggcccccgtttaccgggtccaaacccgtttccgtacccggtttcccccgcccccgttcccgttacccctcccgttcccgttaccccgg

SEQ ID NO: 77394 - DNA, 521 bp, Homo sapiens
  misc_feature: GYAE6OF01CUHNY.49.81.H04.1.454.CMB.1.raw
  modified_base (269)..(269): a, c, t, g, unknown or other
  misc_feature (269)..(269): n is a, c, g, or t
  modified_base (474)..(474): a, c, t, g, unknown or other
  misc_feature (474)..(474): n is a, c, g, or t
  modified_base (517)..(517): a, c, t, g, unknown or other
  misc_feature (517)..(517): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaaacttatttaaattggatcagcaagaaaccagggaaacncccctaaactcctagactctacgatgcatccaatttggaaatgggtccatcaaggttcagtggaagtgatctagggtacttattttactttcactatcatcaacctgacagtcctagacggattagtgtacaaactattattactagtacaactaatatagaataactctaccatcacgtttcgggacgagggaaccaggtgganatacgaaacgactggtgactagctaaccgattacctgtccttntacc

SEQ ID NO: 77395 - DNA, 638 bp, Homo sapiens
  misc_feature: GYAE6OF01CMB6Z.49.81.H04.1.454.CMB.1.raw
  modified_base (218)..(218): a, c, t, g, unknown or other
  misc_feature (218)..(218): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtaccagcagttccaggaccgccccagactctcattcatgacaataacaagcgagtcccagagattcctgaccgattctctggctccaagtctggcacctcacgcccaccctggccatccaccggactccgagaccgtggggacgaggccgtaattattacgtgacggaaacagtgggaacttccgagtcctggacgtgggtgtcgaggggttcggttcgggacgggtaacggggaccctaaagggtccgtacggaaccccggttccgtagggtccaacgggtccccgaaacgggtccgtaccggggtccccccgttcggggtaccctacccgttcccgttcccggtttacccccctacccccgtttcccctttcccgttaccccttcccgttcccggttaccccg

SEQ ID NO: 77396 - DNA, 534 bp, Homo sapiens
  misc_feature: GYAE6OF01BWCQZ.49.81.H04.1.454.CMB.1.raw
  modified_base (155)..(155): a, c, t, g, unknown or other
  misc_feature (155)..(155): n is a, c, g, or t
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (316)..(316): a, c, t, g, unknown or other
  misc_feature (316)..(316): n is a, c, g, or t
  modified_base (338)..(338): a, c, t, g, unknown or other
  misc_feature (338)..(338): n is a, c, g, or t
  modified_base (524)..(524): a, c, t, g, unknown or other
  misc_feature (524)..(524): n is a, c, g, or t
  modified_base (529)..(529): a, c, t, g, unknown or other
  misc_feature (529)..(529): n is a, c, g, or t
tcagagtcgagagacacgaccggtgctcgatttagtagtgtagattcgcgggggggacaatcgttcatcactgacctgctcccctctcctcctcacccttctcagttccactgcacagggtccgtggcccagtctgtgttgacgcagccgccctnagtgtctgcggcccaggacagaaagtcaccatctcctgctctggaancagctccaacattgggaanaattatgtatcgtggtaccagcagttcccaggaacgcccagactctcattcatgacaataacaagcgacgtcccagacgattcctgaccgattcnctggctcaagtctaggcacctnagccaccctggccatcacggactcgagactggggacaggccgattacttactgacggtaaacagttgggattccgaagtccgtagagttggtgtctaagggttgtttcggcgggtaggaccaagtctggacctcgtagtcaggtcccaaaggctacggccctggcactcgtacgtcccacctcctntcctncgtac

SEQ ID NO: 77397 - DNA, 562 bp, Homo sapiens
  misc_feature: GYAE6OF01CWCQ0.49.81.H04.1.454.CMB.1.raw
  modified_base (379)..(379): a, c, t, g, unknown or other
  misc_feature (379)..(379): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacgccccagactcctcattcatgacaaataacaagcgagtcccaagagattccagaccgtattctctggcctccaagtctggcacctcacgcccaccctggccatcaccggactcagacgtggggacnggacctaattattacgtgacggaaactagtgggtaacttccgagtcctgagtggtgtcgagggtgttcgggcggaagggaccaagcgtacgaccgtccgtaggtcgaacgcccgaagggcctcggcccccttggtccaccgttccgttcgttcccccgcccttccgtcttcctcttccgaccg

SEQ ID NO: 77398 - DNA, 517 bp, Homo sapiens
  misc_feature: GYAE6OF01BIU6C.49.81.H04.1.454.CMB.1.raw
  modified_base (217)..(217): a, c, t, g, unknown or other
  misc_feature (217)..(217): n is a, c, g, or t
  modified_base (486)..(486): a, c, t, g, unknown or other
  misc_feature (486)..(486): n is a, c, g, or t
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtaccagcagttcccaggacgccccagactctcattcatgacaataacaagcgagtcccagagattcctgaccgattctctggctcaagtctggcacctcacgcccaccctggccatccaccggactccagacgtggggacgaggccgattatactgacggacatgggattccagtcctgagtggtgtcgagggtgttcggcggagggaccaaggctgaccgtcgtaggtcagcccaaggctcggcccctggtcnctctcgttccccaccctcctctctctcgtac

SEQ ID NO: 77399 - DNA, 515 bp, Homo sapiens
  misc_feature: GYAE6OF01AL640.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaatagggtcccatcaaggttcagtggaagtggatcgtgggtacgtattttacttcactatcatcaacctgcagcctgagtatattgactaacatattactgtacaacaatatgaataatctaccactctacgtttcggacggacggaccacgggtggacgaataccgaaaacgtactggtcggactgacctaccattacctgttcttctacg

SEQ ID NO: 77400 - DNA, 525 bp, Homo sapiens
  misc_feature: GYAE6OF01DJ1F4.49.81.H04.1.454.CMB.1.raw
  modified_base (407)..(407): a, c, t, g, unknown or other
  misc_feature (407)..(407): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcacatcacttgccaggcgactcgaggacattagacaacttatttaaattggtatcagcaagaaaccagggaacacccctaactcctgatctacgatgcatacctaatttaggaaatacggggtacccatacaaggttcagtggaagtggatcgtagggtacttattttacttcactatacatactaacctgcagcctagagtatatgacaanatattactagtacaacaattatgaataatctactaccttcactttcgggacggacgggaccgaaggtgaaggataccgaaacgacgttgcggctagactaccattctcgttctctacc

SEQ ID NO: 77401 - DNA, 526 bp, Homo sapiens
  misc_feature: GYAE6OF01EJ72I.49.81.H04.1.454.CMB.1.raw
  modified_base (218)..(218): a, c, t, g, unknown or other
  misc_feature (218)..(218): n is a, c, g, or t
  modified_base (496)..(496): a, c, t, g, unknown or other
  misc_feature (496)..(496): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtaccagcagttcccaggaacggccccagactcctcattcatgacaataacaagcgagtcccagagattcctgaccgattctctggctccaagtctggcacctcagcccaccctggccatcaccggactccagacgtggggacgacggccgtaattattactgacggaaacagtgggattccgagtcctgagtggtgtcgtagggtgttcgggcggagggaccaagctgaccgtcgtaggcacgccaggctcggcccctggtcnctcgtcgtccccgcctctctctcgtcgtac

SEQ ID NO: 77402 - DNA, 567 bp, Homo sapiens
  misc_feature: GYAE6OF01D755E.49.81.H04.1.454.CMB.1.raw
  modified_base (268)..(268): a, c, t, g, unknown or other
  misc_feature (268)..(268): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagatcaccatcacttgccaggcgactcaggacattagcaactatttaaattggtatcagacaagaaaccagggaaacncccctaaacctcctagatctacgatgcatccaattggaaatgggtccatcaaggttcagtggaagtggatcgtagggtacgttattttacttacgactatctatacaactgcagcctagagtatatgacaacataacttactagtcaaacaattaatgaaattaattacctaacctacttactaccgtttcgggaccggtagggacccgtagggtaggaagtaacgtaccgaaaacggtaacgttaggtacgggtcctacggacctaccttacgtactttccggtctttacgtaacccg

SEQ ID NO: 77403 - DNA, 751 bp, Homo sapiens
  misc_feature: GYAE6OF01BV03J.49.81.H04.1.454.CMB.1.raw
tcagagtcgagagacacgaccggtgctcgatttagtagtgtagattcgcggggggacaatcttcatcatgacctgctcccctctcctcctcacccttctcattcactgcacgaggtccgtcggcccagtctgtgttgacgcagcccgccctcagtgtctcgccggccccaggacagaaagtcaccatctcctgctctggaagcagcctaccaacattagggaagtaattatgtatcgtggtaccagcagttcccgaggaaccggccccagacctcctcattcatagaacaataacaagcgacgtacccagacgtacttccgtcgaccgtattctcgtcggcctaccgaagtccgtcggccacctcacgcccacccgtggccactccgacccggactccgacggtaccggtacgggggaaccgacgggtacccgtaagtttaacttaccgtacgggaaccgggtaaactaggttacggggtaactttccccgaaggtcccgttagggtacggtttcgggttacggttccgggtaaggggggtttccgggttaccgggggacggggtaacggggaaccctaagggtcccgttacgggtaccccggttccggttacgggtacccgaaccgggaccccgtaaaggggtcccgttcccggggtcccccgttcggggtaccctacccggtttcccgttcccggtttcccccccgtcccctttcccgttacccgtttcccttcccgtcccggtacccg

SEQ ID NO: 77404 - DNA, 537 bp, Homo sapiens
  misc_feature: GYAE6OF01CFLWN.49.81.H04.1.454.CMB.1.raw
  modified_base (504)..(504): a, c, t, g, unknown or other
  misc_feature (504)..(504): n is a, c, g, or t
tcagagtcgagagacacgaccggtgctcgatttagtagtgtagattcgcgggggggacaatcttcatcatgacctgctcccctctcctactcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttccaggaacggccccagactcctcattcatgacaataacaagcgagtcccagagattcctgaccgattctctggctccaagtctggcacctcacgccaccctggccatcaccggactccagacgtggggacggcgctattactagtgacgagtagtaggtactcgcgtcgtgagtgtcgtggtgggtcggtcgggacggacggaacgacgtcgtaccggcctacggtacgacgaccgacgacgtcgcccggtccgtcgtcncttcgtccgtcccctcctctcctctcgtctccg

SEQ ID NO: 77405 - DNA, 536 bp, Homo sapiens
  misc_feature: GYAE6OF01BIPJE.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaacgcccctaacctcctgatctacgatgcatccaatttggaaatagggtcccatcgaaggttcagtggaagtggatcgtagggtacttattttacttcactatcatcaacctgcagcctgaggtatagttagctaacattatactgtacaacaattatagaataatcctaccacttactacgtttcggacggagggacctacggtggaactacgtacgaaacgtagtaggtcggtactcgaccgtaaccctagttcctggttccttcgttacc

SEQ ID NO: 77406 - DNA, 553 bp, Homo sapiens
  misc_feature: GYAE6OF01CHNW3.49.81.H04.1.454.CMB.1.raw
  modified_base (508)..(508): a, c, t, g, unknown or other
  misc_feature (508)..(508): n is a, c, g, or t
tcagagtcgagagacacgaccggtgctcgatttagtagtgtagattcgcggggcagtcccaaccaggacacagcatggacatgagggtccctgctcagctcctggggctcctgctgctctggctctcaggtgccagatgtgacatccggatgacccagtctccatcctccctgtctgcatctgtaggagacagaatcacatcacttgccaggcgactcaggacattagacaacttatttaaatggtatcagcaagaaaccgaggaaacgcccctaacctcctagactctacgatgacataccaatttaggaaactaggggtacccagtctaaggttcaggtaggtaaagtggattcgtgggtaacgttatttttacttcaacctatacattacaacctgcagtcctaggagtatattgacaactattattactgtacaaactaatatagtaataacttctaacctacttctaacgtttcgggacggaacgggacctaacgggtggaanacgtaacaaacggacttggacgactcgaccacatctgtcttaccg

SEQ ID NO: 77407 - DNA, 566 bp, Homo sapiens
  misc_feature: GYAE6OF01D5Q5Z.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagacaagaaaccagggaaacgcccctaacctcctgatctacgatgacatcaatttaggaaatacgggtccatcaaggttcagtggaagtggatcgtgggtacgttattttacttcactatctatacaactgacagcctgagtatattgactaactatattactagtacaacaatatagaataactcctaaccacttactaccgtttacgggacggtacgggaccgtacgggtaggaacgtaagtaccgtaaaacggtaacgttacggtcggaccttggaaccctaaccgtacttaccgtttcgttccttcctaacccg

SEQ ID NO: 77408 - DNA, 566 bp, Homo sapiens
  misc_feature: GYAE6OF01CG4A1.49.81.H04.1.454.CMB.1.raw
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgattctctggctccaagtctggcacctcagccaccctggccatccaccggactcccgagactggggacgaggccgattattactgcggaacagtgggattccagcctggagtggtgtcgagggtgttcgggcggagggaccaagtcgtacgaccgtccgtaggtccacgcccgaaggccgttacgggcccccttgggtacccaccgttccgtccgtttcccccaaccccgttcccttacctccttccgtccgtacccg

SEQ ID NO: 77409 - DNA, 698 bp, Homo sapiens
  misc_feature: GYAE6OF01CUAQC.49.81.H04.1.454.CMB.1.raw
tcagagtcgagagacacgaccggtgctcgatttagtagtgtagattcgcggggtaggtcccaaccaggacacagcatggaccatgagggtccctgctcagctcctggggctcctgctgctctggctctcaggtgccagagtgtgacatccggtatgacccagtcttccatcctccctgtctgcatctgtaggagacagaatcgacatcacttgccagggccgactcaggaccattagctaacttaatttaaacttggtaatcaagacaagtaaaccagggtaaacgcccctaactcctagacttcgtaacgatcgacacgtaccgaagtttaggaaagtacgggtacccaagtacgtaaaggttcaaggtagggaaagtggaattacgtagggtaacttattttaacgtttacaaccgtattacctaagttaccgtaaaccgtcgtacgtacggtacccgtaggtaacggtaacttaagttacgaaaccctaaataaactttaaacgtttaacctaaggtaacctaaacttaaagttattaacgtaaattaaacttaccctaacccgtaaccttacgtaaccgtttcggggaaccggtaaggggaacccctaggggtacgaaggtaacttaacggaaaacgtaacgtggtaccgggtactagggaaccctacgtagttacctcggttcttacgtaccg

SEQ ID NO: 77410 - DNA, 503 bp, Homo sapiens
  misc_feature: GYAE6OF01CTTXL.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcaagaaaccaggaaacgcccctaacctcctgatctacgatgcatcaatttaggaaatagggtcccatcaaggttcagtggaagtggatctgggtactatttacttcacatcatcaactgcagcctgaggatattgacaacatattactgtacaacaatatagataatctaacctactctacgtttcggacggagggaccaggtggaacgatacgaaacgaattggtcggcagactaccatctcgtcttcgtac

SEQ ID NO: 77411 - DNA, 535 bp, Homo sapiens
  misc_feature: GYAE6OF01EEJP2.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgactctacgatgcatccaatttggaaataggggtcccatcaaggttcagttggaagtggatcgtagggtacgttattttactttcaccatcatacaactgcagcctgaacggatagttgacaactattattactgtacaactaatatagaataatactacccacttccaactttcgggaccggacgggacccgtaacgggtaggacgaactacgaaaacgtactggtggactcggacacctatctgtcttctaccg

SEQ ID NO: 77412 - DNA, 726 bp, Homo sapiens
  misc_feature: GYAE6OF01D3TUT.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactcctcattcatgacaataacaagcgagtcccagagattcctgaccgatttcctcgtcggcctaccgtaagtcgtcggacctacctcacgcccacccgtcggacctaactccgacccggtacctcccgaaggtacgtcgggggaacgacgggtacccgtaagtttaacttacgtggaaccgggtaaactaggttacggggtaactttacccgacggtcccgttagggtaacgggttgggttacgggttacggtacgggggtttcggttaccgggggaaccggggtaacgggaacccgtaaggtccgtacggtacccggttaccgtacgggtccgaaccggtacccggaaacgggtccggttacccgggtccccccgttcgggttaccctaacccgttcccgtttcccgttaacccccccgtaccccttcccgttaccccttcccttcccgtcccggttaacccg

SEQ ID NO: 77413 - DNA, 758 bp, Homo sapiens
  misc_feature: GYAE6OF01CSWEK.49.81.H04.1.454.CMB.1.raw
  modified_base (337)..(337): a, c, t, g, unknown or other
  misc_feature (337)..(337): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctgccggccccaggacagaaagtcaccatctcctgctctggaagcagctaccaaacagtttagggaagtaatttatgtaatcgtaggtaccagcagttcccaaggaaccggccccagactcctcattcatgaacaaactaacaagcgaacgtcccagacgtacttcctagaccgtattcncgttcggcctaccgtaagtcctacggcctaaccctcgacgtcccacccgtcggacccaacgtccgaacccgggactcccgaaggtaaccggtcgggggaaccgaacgggcccgttaatttacgtacgtacgggacggtaaactaggttacgggaacctttcccgaacggtcccgttagggtacggttcgggttggttaccgggtaggggggttcggtttacccggggggaacggggtaacggggtaaccccgtaaagggtcccgttaccggggtaaccccgttaccggttaacgggtacccgtaaacgggacccccgaaaggggtcccgttacccgggaccccccgttcgggtaccctaccggttcccgttacccgttaccccctacccccgttcttacccttcctccgttacccgtaccg

SEQ ID NO: 77414 - DNA, 523 bp, Homo sapiens
  misc_feature: GYAE6OF01CRC4G.49.81.H04.1.454.CMB.1.raw
  modified_base (302)..(302): a, c, t, g, unknown or other
  misc_feature (302)..(302): n is a, c, g, or t
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactctcattcatgacaataacaagcgagtcccagagattccngaccgattctctggctcaagtctggcacctcagccaccctggccatcaccggctccagactggggacgaggccgattatactgcggaacagtgggattccagcctgagtggtgtcgagggtgttcggcggagggaccaaggctggaccgtccgtaggtcagcccgaaggcctggcccctggtccactccgtcgttccccacccttcctctcctctcgtacc

SEQ ID NO: 77415 - DNA, 554 bp, Homo sapiens
  misc_feature: GYAE6OF01DR1G7.49.81.H04.1.454.CMB.1.raw
  modified_base (514)..(514): a, c, t, g, unknown or other
  misc_feature (514)..(514): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgattctctggctcaagtctggccacctcacgcccaccctggcccatccaccggactccagacgtggggacgagggcccgtaattacttacgtgacggaacagtgggattccgagcctggagtggtgtcgagggtgttcgggcgggaacgggaccaaggccgtcgaccgtccgtaggcacgcccgaaggcctcggcccctggtccncgtccgtcgttcccccgtccctcctcctcctctcgtaccg

SEQ ID NO: 77416 - DNA, 485 bp, Homo sapiens
  misc_feature: GYAE6OF01CBVVF.49.81.H04.1.454.CMB.1.raw
  modified_base (482)..(482): a, c, t, g, unknown or other
  misc_feature (482)..(482): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaactcctgatctacgatgcatccaatttggaaataggggtcccatcaaggttcagtggaagtggatctgggacgtattttactttcacatcatcaacctgcagcctgaggatattgcaacatattactgtacaacaatatgataatctaccactcactttcggcgaggaccacggtggagatcaaacgaatgtggctgcacatctgtcttntac

SEQ ID NO: 77417 - DNA, 521 bp, Homo sapiens
  misc_feature: GYAE6OF01D6V2O.49.81.H04.1.454.CMB.1.raw
  modified_base (218)..(218): a, c, t, g, unknown or other
  misc_feature (218)..(218): n is a, c, g, or t
  modified_base (490)..(490): a, c, t, g, unknown or other
  misc_feature (490)..(490): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtaccagcagttcccaggaacggcccccagactcctcattcatgacaataacaagcgagtcccagagattcctgaccgattctctggctccaagtctggcacctcacgccaccctggccatcaccggactccagactggggacgaggccgattattactgcggaacagtgggattccagcctgagtggtgtcgagggtgttcgggcggagggaccaagcgtgaccgtctaggtcagcccaaggcctcggcccctggcnctcgtcgtccccgcctcctctcctctcggtc

SEQ ID NO: 77418 - DNA, 693 bp, Homo sapiens
  misc_feature: GYAE6OF01C4W45.49.81.H04.1.454.CMB.1.raw
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgccggcccaggacagaaagtcaccatctcctgctctggaagcagctaccaaacagttaggggaaagtaatttatgtatcggtaggtaccagcagttcccgaaggaaccgccccagacctcctcattcatgaacaataacaagcgacgtccagagtacttcctagacgtattctcgtgctacaagtcagcacctcagcccaccgtcggacctactccgaaccggactccgaaggaccggtacgggggaacgaacgggaccgtaatttaacgttaccgtagggaccggtaaactaggtacgggtacttaccgacgtccgtaggtacggttggttacggtcggtaggggttcggttacggggacgggtaacgggacccgtaaggtccgtacggtacccggttaccgtacgggtaccgaacggtccccgaaaggggtcccgttcccgggcccccgttacgggaccctacccgttcccgttcccggtttacccccctaacccccgttcccttacccgttcccgttccccgtcgttaccccg

SEQ ID NO: 77419 - DNA, 673 bp, Homo sapiens
  misc_feature: GYAE6OF01DQJD8.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctcctgtctgcatctgtaggagacagaatcaccatcactgccaggcgactcaggacattagctaactaatttaaattggtatcagacagaaaccaggaacgcccctaacctcctagactctacgatcgacatacctaagttttaggaaacgttacggggtaccccaagttaccgaaagggttacgaaggttagggaaaggttggaagttcgtagggtaacgtttaatttttacgtttacctacctactactaactctaaaccctggacctaggtaccccgttaggaacggtaactttaagttacgaacttaaacgtattaactttaacgttacgttactaaaaccgtaaattaattaagtaaacttaaactaccttaaccctaacgttacccttaaccggtttaccgggacgggtacgggtaaccgacgggtaggaacgtaactacgaaaaccggtacgtaggtcggactacgtaccctaacctacttacctcgttccttcgtacccg

SEQ ID NO: 77420 - DNA, 537 bp, Homo sapiens
  misc_feature: GYAE6OF01AV333.49.81.H04.1.454.CMB.1.raw
  modified_base (496)..(496): a, c, t, g, unknown or other
  misc_feature (496)..(496): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactcctcattcatgacaataacaagcgagtcccagagattcctgaccgattctctggctccaagtctggcacctcagccaccctgccatcaccggactccagactggggacgaggccgattatactgacggaacagtgggattccgagtcctgagtggtgtcgagggtgttcggcggacgggaccagctcgaccgtcgtaggtcacgcccgaaggccgtcgggcccctgggtccncttcctcgttcccccacccttccctcctcctccgtcgtccc

SEQ ID NO: 77421 - DNA, 675 bp, Homo sapiens
  misc_feature: GYAE6OF01BGCHZ.49.81.H04.1.454.CMB.1.raw
  modified_base (307)..(307): a, c, t, g, unknown or other
  misc_feature (307)..(307): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaagcagctccaacagttgggaataattatgtatcgtggtaccagcagttcccaggaaccgccccagactctcattcatgacaataacagcgacgtcccagagtacttccngaccgtattctcgtcggctaccaagtctggcacctcacgcccaccctggcccatccgaccgactacccgaggaccgtaggggaccgaggccgtaatttacttacgtcggacggaacgtagtgggtacttccgaacgtcctggtacgtgggtacgtcgtaggggtcggttcgggccgggtaacgggtacccgaacggtccgtacgggacccgttaccgtacggtacccgtaacgaccccgtaaagggccccggttaccgggccccccgttacgggtaccccgttaccgttccccgtttacccggtttccccccctaccccggtttaccccttacccgtttccccgtttacccggtcccgttaaccccgg

SEQ ID NO: 77422 - DNA, 610 bp, Homo sapiens
  misc_feature: GYAE6OF01EPQX6.49.81.H04.1.454.CMB.1.raw
  modified_base (280)..(280): a, c, t, g, unknown or other
  misc_feature (280)..(280): n is a, c, g, or t
tcagagtcgagagacacgaccggtgctcgatttagtagtgtagattcgcgggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccgaggcgactcgaggactagttagctaaacttaatttaaattggtatcagacaagaaaccgaagggaaccncccctaactctgactctagatgacactacctaagtttacggaaagttcgggtaccagtacgtaaggttcagtggaagtggatcgtaggtacgttactttacttacactatctactacaactgacacgtcctagaacggtattaacgttacgaactaaactattaactttacgtagtaacaaactaatttaactagtaaacttaacttacctaacctacttacgttacggtttcgggacggtacggaccgtacgggtagaacgtaagtaaccgaaacgtacgtaggtcggaccttacgacctaaccgtattacgttcgtcttccgtacccg

SEQ ID NO: 77423 - DNA, 530 bp, Homo sapiens
  misc_feature: GYAE6OF01AWZKE.49.81.H04.1.454.CMB.1.raw
  modified_base (217)..(217): a, c, t, g, unknown or other
  misc_feature (217)..(217): n is a, c, g, or t
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtaccagcagttcccaggaacggcccccagactcctcattcatgacaataacaagcgagtcccagagattcctgaccattctctggctccaagtctggcactcagccaccctggccatcaccggactccagactggggacgaggccgattattactgcggaacagtgggattccagcctgagtggtgtcgaggggtgttcgggcggagggtacccaaggctaggaccgtccgtaggtccaggtcccaaggctcggcccctggtcaccgtctcgttccccgcccttctctcctctcgtac

SEQ ID NO: 77424 - DNA, 666 bp, Homo sapiens
  misc_feature: GYAE6OF01AEP8A.49.81.H04.1.454.CMB.1.raw
tcagagtcgagagacacgaccggtgctcgatttagtagtgtagattcgcgggggggacaactacttcatcatgacctgctcccctctcctcctcacccttctcattcactgcacagggtcctgggcccagtctgtgttgacgcagccgccctcagtgtctgcggcccaggacagaaagtcaccatctcctgctctggaagcagctccaacagttggggaagaattatgtactcgtggtaccagcagttcccaggaaccggccccgagactcctcattcatgacaataacaagcgagtcccagagacttcctgaccgattctcgtggctccaagtctcggccacctcacgccacccgtggccatccgaccggactccaagtacgtcgggacgacggccgtattacgtacgtggaccggtaaacagttacgggtactttaccgaggtccgtaggaacggttggttcggtcggtaggggttcgttccggggccgggtaacggggaaccgtaacggttccgttaccgggtaacccggttcccggtacgggtaccaccgggtaccccgtaaagggtcccgttccgggtcccccgtcggttcctaccgttcccgtcccggtttacccccgaaccccttcccctaccgtttcccgtcccgttcccggtacccg

SEQ ID NO: 77425 - DNA, 493 bp, Homo sapiens
  misc_feature: GYAE6OF01C51KF.49.81.H04.1.454.CMB.1.raw
  modified_base (483)..(483): a, c, t, g, unknown or other
  misc_feature (483)..(483): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaaattggtatcagcaagaaaccagggaaacgcccctaaacctcctgatctacgatgcatccaatttggaaatagggtcccatcaaggttcagtggaagtggatcgtgggacgtatttacttcacatcatcaactgcagcctgagatattgacaacatattactagtcaacaatatagataatctaccactctactttcggacggacgggaccacggtgagatacaaacgatggtgctgacacatntgtcttctac

SEQ ID NO: 77426 - DNA, 617 bp, Homo sapiens
  misc_feature: GYAE6OF01B1FCU.49.81.H04.1.454.CMB.1.raw
  modified_base (325)..(325): a, c, t, g, unknown or other
  misc_feature (325)..(325): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttccaggaacgccccagactcctcattcatgacaataacaagcgagtccagagattcctgaccgattctctggctccaagtcnggcactcagccaccctggccatccaccggactccagacgtggggacgaggccgtattactacgtggacggaaacagtgggaacttccgagtccttggacgttggtgtcgtaggggttcggttacgggacgggacgggaaccaaggtccgtacggtacccgttccgtacggtaccgacggtacccgaaaggccgtaccgggcccccgttacgggtccctaacccgttcccgtttacccgttaccccccgtaaccccttcccgttacccttcccttcccgtcccggttaacccg

SEQ ID NO: 77427 - DNA, 579 bp, Homo sapiens
  misc_feature: GYAE6OF01EJTAH.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcaagaaaccagggaaacgcccctaacctcctgactctacgatgcatccaatttggaaatagggtcccatcaaggttcagtggaagtggatcgtgggtacgttatttacttcactatcatacaacctgacagcctgattgatattagacaactatattactgtacaaactaatatagtaataactcctaacctaccttacgtaaccgtttcgggacgggtaacgggtaccaacggggttaggaaacggtaacgtaaccgaaaaaccggtaacgttcgggtagggtacccgttagaccctaaccgtaatttccttcggtttcctttacccg

SEQ ID NO: 77428 - DNA, 545 bp, Homo sapiens
  misc_feature: GYAE6OF01DGUWV.49.81.H04.1.454.CMB.1.raw
  modified_base (274)..(274): a, c, t, g, unknown or other
  misc_feature (274)..(274): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcacatcacttgccaggcgactcaggacattacgactaaacttaatttaaattggtatacagcaagaaaccagggaaacncccctaactccagactctacgatgcatacaatttggaaatcgggtaccagtacaaggttcaagtggaagtggatcgtgggtacttattttacgttacacctatcatcctaactgacacgctagagtattattgacaactatactatacgtacaaatataatgaattactactacccgtacttactaacggttcggaacgggacggacccgtaggttaggatactaacgaaacgacgtggtcgactgacctactactcgtcttcctgtaccc

SEQ ID NO: 77429 - DNA, 496 bp, Homo sapiens
  misc_feature: GYAE6OF01BHTHQ.49.81.H04.1.454.CMB.1.raw
  modified_base (491)..(491): a, c, t, g, unknown or other
  misc_feature (491)..(491): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaacgcccctaacctcctgatctacgatgcatccaatttggaaatagggtccatcaagttcagtggaagtggatctgggacgtatttactttcacctatcatcaacctgcagcctgaggatattgcaacatattactgtacaactatatagataatctaccactctactttcggcggacggaccagggtgagatacgaaacgtatagtggactgcctacatctgtcttntaccg

SEQ ID NO: 77430 - DNA, 609 bp, Homo sapiens
  misc_feature: GYAE6OF01AB8T7.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagacaacttatttaaattggtatcagacagaaaccaggaaacgcccctaacctcctagactctacgatgcatcctaatttaggaaatacggggtacccagtacaaggttcagtggaagtggatcgtaggtacgttatttacttcactatcatcaactgcagcctgagtatattgactaacattaacttactacgtaacaaacgtaattactaagtaattaacttacctaaccctaccttaccgttaaccgttttacgggaccgggtaacgggaacccgtaacggggtaggaaacgtacgttaacccgaaaacggttaaccgttaggtcgggtaccgtacggacccgtaaccgtacttaccgttcgttccgtttccgtaacccg

SEQ ID NO: 77431 - DNA, 508 bp, Homo sapiens
  misc_feature: GYAE6OF01CNEBK.49.81.H04.1.454.CMB.1.raw
  modified_base (299)..(299): a, c, t, g, unknown or other
  misc_feature (299)..(299): n is a, c, g, or t
  modified_base (477)..(477): a, c, t, g, unknown or other
  misc_feature (477)..(477): n is a, c, g, or t
tcagagtcgagagacacgaccggtgctcgatttagtagtgtagattcgcgggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttccaggaacgccccagactctcattcatgacaataacaagcgagtcccagagattccngaccgattctctggctccaagtctggcactcagccaccctggccatcaccggactccagactggggacaggccgattatactgacggaacagtgggattccgagcctgagtggtgtcgagggtgttcgggcgagggaccaagctgaccgtcaggtcagcccaggctggcccctggtcnctctcgttccccacctcctctcctctcgtac

SEQ ID NO: 77432 - DNA, 496 bp, Homo sapiens
  misc_feature: GYAE6OF01ADBNY.49.81.H04.1.454.CMB.1.raw
  modified_base (395)..(395): a, c, t, g, unknown or other
  misc_feature (395)..(395): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactattaaattggtatcagcagaaaccagggaaacgcccctaacctcctgatctacgatgcatccaatttggaaatagggtcccatcaaggttcagtggaagtggatcgtgggacgttattttacttcactatcatcaacctgcagcctgaggtatattgacaanataattactgtacaacaatatagaataatctacactcactttcggacggaggaccaggtgagatacgaaacgtataggtcgctgctaccatctntntctac

SEQ ID NO: 77433 - DNA, 598 bp, Homo sapiens
  misc_feature: GYAE6OF01DO74I.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagactaactaattttaaattggtaatcagacaagaaaaccagggaaacgcccctaacctcctagactctacgatgcatcctaatttggaaatagggtacccagtacaaggttcagtaggaagtgatcgtggtacgttattttacttacaccattcatactaacctgacacgccgtaggaggtattattagactaaactatactttacgagtaacaactaaagtatagtaattaactacctaacctaccttactaccgtttcggacgggaacgggaccgtaacgggtaggaacgtaagttaaccgaaaacggtattacggttccgggacttacggacctaaaccctagttactttcgttcttccgttaacccg

SEQ ID NO: 77434 - DNA, 542 bp, Homo sapiens
  misc_feature: GYAE6OF01BKVB1.49.81.H04.1.454.CMB.1.raw
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacgccccagactcctcattcatgacaataacaagcgagtcccagagattcctgaccgattctctggctccaagtctggcacctcacgccaccctggccatccaccggactccagacgtggggacgacgggccgtattacttaccgtgacggaaacagtgggacttccgagcctgagtggtgtcgagggtgtcgggcggagggaccaggctaggacccgtcgtaggtccagcccgaaggcctcggcccctgggtcaccgtctcgttccccacccttcctctcctccgtcgtcc

SEQ ID NO: 77435 - DNA, 604 bp, Homo sapiens
  misc_feature: GYAE6OF01DIQG6.49.81.H04.1.454.CMB.1.raw
  modified_base (277)..(277): a, c, t, g, unknown or other
  misc_feature (277)..(277): n is a, c, g, or t
  modified_base (390)..(390): a, c, t, g, unknown or other
  misc_feature (390)..(390): n is a, c, g, or t
tcagagtcgagagacacgaccggtgctcgatttagtagtgtagattcgcggggagtcccaaccaggacacagcatgggacatgagggtccctgctcagctccctggggctccgtgctgctcctggctctcaggtgccagatgtcgacatccggatgacccagtctccatccctcctgtctgctatctgtaggagacagaatcaccatcactgccaggcgactcaggacattagacaacttatttaaattggtaatcagacaagaaaccagggaaacncccctaactctgactctacgatgcatacctaatttaggaaatcgggtacccatcgaaagttcagtggaagtgatcgtaggtacttatttacttcactatctaactcaacgttnactacgcctgaaggtattattacgactaaatattaactttactactacaaacttaaatactagtaaattaactaccctaactacttaccgtaccgtttacggggaaccgggacgggtaaccgtaacgggtaggagtaaacgtaacgtaaaacggtaacgttggtacgggtactcggaacctaacccgtattccctttcggttcttcctaacccg

SEQ ID NO: 77436 - DNA, 591 bp, Homo sapiens
  misc_feature: GYAE6OF01DQ2AR.49.81.H04.1.454.CMB.1.raw
  modified_base (394)..(394): a, c, t, g, unknown or other
  misc_feature (394)..(394): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccactcctccctgtctgcatctgtaggagacagaatcaccatcacttgccaggcgaactcaggacattagactaacttaatttaaattggtatcaagacaagaaaccgaaggaaacgacccctaacctctagactctacgatcgcatccaatttaggaaagtacgggtacccatacgtaaggttcagtaggaagtggatcgtaggtacttactttacttcactatcatcaactncagtcctagacgtatatagactaatataattactagtacaaactaataatagtaataacttactaaccctacttaccgtacgtttaccgggcgggtaacgggaaccgtacgggtacggaacgaaacttaaccgaaacggtaactcgggttacggaccgtacgacctaccctactacgtttacgtccgttactacccg

SEQ ID NO: 77437 - DNA, 555 bp, Homo sapiens
  misc_feature: GYAE6OF01CE5KI.49.81.H04.1.454.CMB.1.raw
  modified_base (517)..(517): a, c, t, g, unknown or other
  misc_feature (517)..(517): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtgtaccagcagttccaggaacggccccagactcctcattcatgacaataacaagcgagtcccagagattcctgaccgtattctctggctccaagtctggccacctcacgcccaccctggcccactccaacccggactccaagacgtggggacgaggccgattacttacctggacggaacagtcgggacttccgagcctgagtggtgtcgagggtcgttcggcgggagggaccaaggtctacggaccgtcgtaggtcacgcccgaaggccgtcggccccgtcggtccncctcgtcgttcccctaccctcctcctctcgtcgtaccg

SEQ ID NO: 77438 - DNA, 567 bp, Homo sapiens
  misc_feature: GYAE6OF01BL6ZW.49.81.H04.1.454.CMB.1.raw
  modified_base (406)..(406): a, c, t, g, unknown or other
  misc_feature (406)..(406): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacagttgggaagaattatgtatcgtggtaccagcagttcccaggaaccggccccagactcctcattcatgacaataacaagcgagtacccagagattcctgaccgtattctctggctcaagtctggcacctcacgcccaccctcggccactccgacccggactccgagacgtcggggacgacggccgtattacttacgngacggaactagtggtacttaccagtcctgagtggtgtcgagggttcgttcgggacggacgggaccgaagtcgtcggtacccgtcgtacggtcacggccgaaggcctcggccccgtggtcacgtccgtccgttccccacccttcctctcctccgtcgtaccg

SEQ ID NO: 77439 - DNA, 632 bp, Homo sapiens
  misc_feature: GYAE6OF01CDAFF.49.81.H04.1.454.CMB.1.raw
  modified_base (269)..(269): a, c, t, g, unknown or other
  misc_feature (269)..(269): n is a, c, g, or t
  modified_base (309)..(309): a, c, t, g, unknown or other
  misc_feature (309)..(309): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaaacattgggaaagtaattatgtatcgtggtaccagcagttccaggaaccgccccagactccncattcatgaacaaataacaagcgagtcccaagagattccngaccgattctcgtggccttaccaagtctggcacctcaacgcccaccctggcactccgaccggactcccgaagacgtcggggacgacggccgtaattattacgtaggaccggaaactagtgggtaacttccgaagcctaggacgttgggtagttccggaaggggttgttccggggacggaacggggtaccaaaggtccgttacgacccgttaccgtaggtccacggtaccccgaaagggtcctccgggacccccgttgggtacctaaccgtcccgttccgttccccccgcccgttacccttcccgttccttccgtccggtaccc

SEQ ID NO: 77440 - DNA, 587 bp, Homo sapiens
  misc_feature: GYAE6OF01CG3CR.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagacaacttatttaaattggtatcagacaagaaaccagggaaacgcccctaacctcctagatctacgatgcatacctaatttaggaaatacggggtacccatactaaggttcagtggaagtggatcgtggtacgtattttacttcactatcatcaactgacagcctgaggtatattgacaactatattactgtacaactaatatagaataactactacctacttactacgtttacgggcgggtacgggaccgtacggggtaggaacgtaacgtaaccgtaaaaccggtaacgttagggtacgggtaccgttacggacctaacccgtaagttccctttacggttccctttaccgttaacccg

SEQ ID NO: 77441 - DNA, 651 bp, Homo sapiens
  misc_feature: GYAE6OF01CPJE6.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaaccggccccagacctcctcattcatgacaataacaagcgagtcccagagattcctgaccgattctctggctccaagtctggcacctcacgccaccctggccactcacccggctaccagacgtggggacgaggccgtattagttacgtggacggaaactagtgggtaacttcccgagcccgttggacgggtggtggtacgtaggggttcggttcggggacgggtaacggggtaacccaagggtccgtacggtaccccggttaccgttacggggtaccaacgggaccccgaaagggcccgtaccgggtccccccgttacgggttcccaacccgtttcccttccggttttccccccgacccccgtttccccttccctttcccgttcccgtcccggttaacccg

SEQ ID NO: 77442 - DNA, 493 bp, Homo sapiens
  misc_feature: GYAE6OF01BM98Q.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccaggaaacgcccctaactcctgatctacgatgcatccaattggaaatagggtccatcaagttcagtggaagtggatctgggtactatttacttcactatcatcaactgcagcctagagatattgacaacattaattactgtacaactaattatagaataactctaccactctactttcggacgaggaccaggtgagatacgaaacgtaactggtcgctagcacatctgtctctacc

SEQ ID NO: 77443 - DNA, 491 bp, Homo sapiens
  misc_feature: GYAE6OF01BM99I.49.81.H04.1.454.CMB.1.raw
  modified_base (384)..(384): a, c, t, g, unknown or other
  misc_feature (384)..(384): n is a, c, g, or t
  modified_base (487)..(487): a, c, t, g, unknown or other
  misc_feature (487)..(487): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccaggaaagcccctaactcctagatctacgatgcatccaatttggaaatagggtcccatcaaggttcagtggaagtggatctgggactatttacttcacatcatcaactgcagctgagatattgcaanatatactgtacaacaatatagtataatctaccactctactttcggcgtaggaccaggtggagtatacgaaacgaatggtcgcttgactaccatactgtccttntacc

SEQ ID NO: 77444 - DNA, 528 bp, Homo sapiens
  misc_feature: GYAE6OF01DZU2N.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgtattctctggctcaagtctggcacctcagcccacctggccatccaccggactccagacgtggggacaggccgattacttacgtgacggaacagtgggattccgagcctgagtggtgtcgagggtgtcggcggagggaccagctgaccgtcgtaggcagcccgaaggcctcggcccctggtccactccgtcgttccccacctcctctcctcgtcgtacc

SEQ ID NO: 77445 - DNA, 601 bp, Homo sapiens
  misc_feature: GYAE6OF01BOXG7.49.81.H04.1.454.CMB.1.raw
  modified_base (188)..(188): a, c, t, g, unknown or other
  misc_feature (188)..(188): n is a, c, g, or t
  modified_base (270)..(270): a, c, t, g, unknown or other
  misc_feature (270)..(270): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtagganacagaatcaccatcacttgccaggccactcaggacattagacaactatttaaattggtatcagcaagaaaccgagggaaacnccccgtaacctcctgactctacgatcgacactcctaatttaggaaattaggggtacccagttacgaaggttcaggtaggtaagtggatcgtgggtaacgtttatttacttcactatacatcaactgcagcctagagtatatgacaactatattactatacaacaattatagtaataacttacctaaccgtaccttacgtacgtttaccgggacgggtacggtacccgtacgggttaggtaagtaacgttaacgaaaaccggtaacgttaggtacggggccttacggacccgtaaccgtacttacccgtttacgttcctttacgttaacccg

SEQ ID NO: 77446 - DNA, 621 bp, Homo sapiens
  misc_feature: GYAE6OF01B8KFY.49.81.H04.1.454.CMB.1.raw
  modified_base (410)..(410): a, c, t, g, unknown or other
  misc_feature (410)..(410): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcactcaggacattagacaactatttaaattggtatcagcaagaaaccagggaaacgaccccctaacctcctgactcctacgatgacatacctaatttaggaaataggggtacccatactaaggtcagtaggaagtggatcgtggtacttattttacttacactatcatacaactgcagcctagagtatatagactaanattattactacgtactaaacgtaataacttagtaacttaactaccttaaccaacctttaccgtaaccggttttaccgggaccggggtaacgggtaacccggtaacggggttacggaacggtaaacgtaaccgaaaaccggttaacggttaggttacggacgttacgaccctaaccgtacgtttaccgttcggtttccttaccgttaacccg

SEQ ID NO: 77447 - DNA, 564 bp, Homo sapiens
  misc_feature: GYAE6OF01AMYIP.49.81.H04.1.454.CMB.1.raw
  modified_base (400)..(400): a, c, t, g, unknown or other
  misc_feature (400)..(400): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaaccgccccagactcctcattcatgacaataacagcgagtcccagagacttcctagaccgtattctcgtggcctaccaagtctcggcacctcacgcccaccctggccatccaccggactccagacgtgggacgacggcctattactacgnggacgaacagtgggacttccgagtcctggagtggtgtcgagggttcgttcgggcgggaggaccgaaggtccgtacgacccgtcgtaggtccacggcccgaaggtccgtcggccccgttggactccgtccgtcgttccccgcccttcctctctccgtccgtaccg

SEQ ID NO: 77448 - DNA, 584 bp, Homo sapiens
  misc_feature: GYAE6OF01B41E2.49.81.H04.1.454.CMB.1.raw
  modified_base (221)..(221): a, c, t, g, unknown or other
  misc_feature (221)..(221): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaaacattggggaaanaattatgtatcgtggtaccagcagttcccaggaaccggccccagactcctcattcatgaacaataacaagcgagtcccagagacttcctgaccgtattctctggctccaagtctggcacctcagccaccgtgccatccaccggactccgagacgtcggggacaggccgtaattacttacgtagcggaaactagtgggtacttccgagtccgtagacggtggtgtcggtaaggggttggttcgggacgggaacgggtaaccgaaggtccgtacggaccgtaccgtaggtcacggcccgaaggccgtcgggcccctcggtacacgtcttccgttccccacccttcctccttcctccgtcgtaccg

SEQ ID NO: 77449 - DNA, 528 bp, Homo sapiens
  misc_feature: GYAE6OF01EOGNO.49.81.H04.1.454.CMB.1.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaacncccctaacctccngatctacgatgcatccaatttggaaatacgggtccatcaaggttcagtggaagtggatcgtgggtacttattttacttcactatcatcaactncanctgagtatatgacaactntattactgtacaanaatatgaataactactaccactctacgtttcggcggtacggaccagggtgagtaactacgaaaacgtacgttggtcggtactggaccctaaccgtacttacgttcgttcctcgttacccg

SEQ ID NO: 77450 - DNA, 524 bp, Homo sapiens
  misc_feature: GYAE6OF01B8856.49.81.H04.1.454.CMB.1.raw
tcagagtcgagagacacgaccggtgctcgatttagtagtgtagattcgcggggcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcaagaaaccagggaaacgcccctaacctcctgatctacgatgcatacctaagtttaggaaatacggggtacccatacaaggttcagtaggaagtggatcgtgggtacttattttacttcactatcatcaacgtgcagcctagagtatattagacaactattattactagtacaaactaatatagtaattaatcctaactactactacgtttcggacggacggacctagggtgagactacgaaacgtacgtgacgctcgacacatctgtcttac

SEQ ID NO: 77451 - DNA, 873 bp, Homo sapiens
  misc_feature: GYAE6OF01C2LYP.49.81.H04.1.454.CMB.1.raw
  modified_base (223)..(223): a, c, t, g, unknown or other
  misc_feature (223)..(223): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctgccggccccaggacagaaagtcaccatctcctgcctctggaagcagctaccaacattggggaanaattatgtatcgtaggtaccagctacgttcccgaaggaaccggcccccagacctcctcacttcatgaacaaataacaacgcgaacgtcccaagacgtacttccgacggtacccgtattttccgtacgtcggtaccttacccgtaaaggttccgtcgggacctacccgttaccgaaccggtaccccctaacccccggttcgggtacccctaacgtaccccggtaaaccccggggtacccttacccggaaacgggtaccgggttaccgggggggaacccggtaccggggtacccggttaaacgttttaaccggtttaacccggttacgggaaacccggggtaaaaccgttaagggttaccggggggttaacctttaccccggaaccgggtcccgttaggggtaacgggtttcggggttacggttaccggggtaacgggggtttcgggtttaccgggggaaccggggtaacgggtacccgaacggtccggtaccggtaccccggttaccggttacggaccgtacccggtaacccggtaacgggtcccggtccgggtccccccgtacggggttacctaccccgtttcccgttacccccgtttacccccgtaaccccttccccgtttccgttcccccttccgttacccgtacccg

SEQ ID NO: 77452 - DNA, 561 bp, Homo sapiens
  misc_feature: GYAE6OF01D8D50.49.81.H04.1.454.CMB.1.raw
  modified_base (217)..(217): a, c, t, g, unknown or other
  misc_feature (217)..(217): n is a, c, g, or t
  modified_base (337)..(337): a, c, t, g, unknown or other
  misc_feature (337)..(337): n is a, c, g, or t
  modified_base (407)..(407): a, c, t, g, unknown or other
  misc_feature (407)..(407): n is a, c, g, or t
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtaccacgcagttcccaggaaccggccccagactcctcattcatgacaataacaagcgagtcccagagattccagaccgattctcgtggctcaagtctggcacctnacgccaccctggcccatccgaccggactccgagacgtggggacgacggcgatttattacgtgacggaacngtagggattccgagtcctgagtgtgtcgagggtgtcggcggagggaccaaggtctacggacccgtcgtacggtcacgcccgaaggccgtcggcccccgtggtcccacgttccgttcgttaccccctacccttcccgtcttcctccgtcgtaccg

SEQ ID NO: 77453 - DNA, 688 bp, Homo sapiens
  misc_feature: GYAE6OF01A1QE3.49.81.H04.1.454.CMB.1.raw
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaaagaattatgtatcgtggtaccagcagttcccaggaaccggccccagacctcctcattcatgacaataacaagcgacgtcccagacgtacttccgtgaaccgtatttctcgtcggcctccgaagtctcggccacctcacgcccacccgtcggcccactccacccggtacctccgaggacgtcggggacgacgggccgtaatttacgttacgtaggacggaactagtagggtaactttaccgacgtccgtaggaggttcgggtacgtcggtaggggttcgggttacggggccgggtaacgggaccgaaggtccgtaccggtacccgttaccgtacgggtaccgaaccggtaccccgaacgggtcccgttaccgggtccccccgttaccgggttacccgtacccgttcccggttccccggtttaccccccgtcccccgtttaccccttcccttcccttcccgttccggtaccccg

SEQ ID NO: 77454 - DNA, 743 bp, Homo sapiens
  misc_feature: GYAE6OF01DG4MD.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggcccaggacagaaagtcaccatctcctgctcgtggaagcagcctaccaaactagttagggaaataatttatgtagtcgtaggtaccagctacgttacccgaggaacccggccccaagacctcctacattcatgaacaaataaacgaagcgacgtccaagacgtacttcctaggacctattctacgtcggacctaccgaagttcgtggaccctacctcgaaccgccccaacccgtcgaccctaacgtccgaacccgtacctaccgaaggtaccgggtacggggaaccgtacgggaccttaatttaacgttacgtacggaaccgggtaaacgtacggttacgggttaaccttcccggaacgttcccgttagggtacgggtttgggtacggttaccgggtagggggtttaccgggtccggggaccgggtaacgggtaaccgaacggtccggtaccggtacccggtttaccgtagggtacccaacggacccgtaagggtcccttacccgggtcccccttggtaccctaccgttcccgtacccgttcccccctacccttcctaccttcccgtccgtcccgttaccg

SEQ ID NO: 77455 - DNA, 743 bp, Homo sapiens
  misc_feature: GYAE6OF01DMVGO.49.81.H04.1.454.CMB.1.raw
tcagagtcgagagacacgaccggtgctcgatttagtagtgtagattcgcgggggggacaatcttcatcatgacctgcctcccctctcctcctcacccttctcattcactgcacagggtcctgggcccagtctgtgttgacgcagccaccctcagtgtctgccggccccaggacagaaagtcaccatctcctgctctaggaacgcacgctacctaactagttaggggaaataattaatagttaatcgtaggtaccagctagttcccaaggaaccggccccaagacctcctacacttcaatacgaactaaactaacaagtcgaacgtacccaagacgtacttccgtacgaccgtattctacgtcggctaccgaagtcgtggcctacctcgacgccctacccgtggacccactaccgaaccggactacccgagtaccggtacggggaacggtacgggaccgttaattaacgttacgtacggaaccgggtaaatacggttacgggtaacttcccgacggtaccgtaggtacggttggttacgttcggtaggggttcgttacggggacgggtacgggaaccaagggtcgtaacggtacccgttacgtagggaccgaaccgacccggtaaggtcccgtacccgggtccccgttacgggttaccctaaccgtttcccggtttaccccgtttaccccccgtaaccccgtttcccccgttacccgtttacccttcccgtacccgttaacccg

SEQ ID NO: 77456 - DNA, 680 bp, Homo sapiens
  misc_feature: GYAE6OF01ALBG5.49.81.H04.1.454.CMB.1.raw
  modified_base (220)..(220): a, c, t, g, unknown or other
  misc_feature (220)..(220): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctgccggccccaggacagaaagtcaccatctcctgctctggaagcagctccaacattgggaanaattatgtatcgtggtaccagcagttcccaggaaccggccccagacctcctcattcatgaacaataacaagcgacgtcccagagtacttcctgaaccgtatttctcgtcggcctaccaagttcctggccacctcacgcccacccgtggccctatcccgaacccggtacctcccgaacggaccggtgggggaaccgacgggtcccgtaatttacgttaaccgtcggaccggaaacgtagtaggggtaacctttcccgaacgtcccgttaggtaggttcggtcgtacggtagggttgggttaccggggacggggaacgggtaacccgaaggtccgtacggtacccggttaccgtacggtccgacggaccccgaacggtccgtacccgggtcccccgttggtaccctccgttccgttcccgttccccctaccccttcccttccctccttcccgtcccgtaccg

SEQ ID NO: 77457 - DNA, 573 bp, Homo sapiens
  misc_feature: GYAE6OF01CBYOW.49.81.H04.1.454.CMB.1.raw
  modified_base (403)..(403): a, c, t, g, unknown or other
  misc_feature (403)..(403): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaaagaattatgtatcgtggtaccagcagttcccaggaaccggcccccagactcctcattcatgacaataacaagcgagtcccagagattcctgaccgtattctctggctccaagtctggaccacctcacgcccacctggccatcaccggactccagacgtggggacaggcctattattactgcggaanagtgggacttccagtcctgagtggtgtcgagggtcgttcgggcgggagggaccaaggcgtacggacccgttccgtagggtaccacggtacccgaaagggccgtcgggacccccgtcggtacaccttccgtcgtttcccccgacccttccctccttcctccgtccgtaccg

SEQ ID NO: 77458 - DNA, 686 bp, Homo sapiens
  misc_feature: GYAE6OF01EIDNA.49.81.H04.1.454.CMB.1.raw
  modified_base (221)..(221): a, c, t, g, unknown or other
  misc_feature (221)..(221): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaaacagttgggaaanaattatgtatcgtggtaccagcagttcccaggaaccggccccagacctcctcattcatgacaataacaagcgagtcccagagacttcctgaccgtattctcgtggctccaagtctcggccacctcacgcccacccgtggccactccaccggactccgaaggacgtaggggacgacgggaccgtaatttacttacgtcggacggaactagtcgggtacttcccgaggtcccgtaggtacggttgggtcgtcgtaggggttcggttcgggacgggtaacggggaacccgaaggtccgttacggtaccccggttaccgtagggtcccaacggtaccccgaaacgggtcccgttacccggggtccccccgttacgggtaccctacccgttcccggtttaccccggtttccccccccggtccccctttccccgtttacccgttccccgtttcccgtcccggttaaccccg

SEQ ID NO: 77459 - DNA, 654 bp, Homo sapiens
  misc_feature: GYAE6OF01B4B3I.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaaagaattatgtatcgtggtaccagcagttcccaggaaccgccccagactcctcattcatgaacaataacaagcgagtcccagagtacttcctagaccgtattctctggctaccaagtctcggcctacctcgacgcccacctggcccactccacccggactccgacggacgtcggggacgacgggaccgtaattacttacgtcggacggtaaacagtagggacttccgagtccgtagagttggtgtcgtaggggttcggttcgggccgggtaagggacccgaaggtccgtacggtacccggttcgtacgggtccgaacggtaccccggaaacgggtcccgtaccggggtcccccgttagggttccccaccggtttccccgtttcccggttaccccccgcccccgtttccctcccgtttccttcccggtcccgttacccg

SEQ ID NO: 77460 - DNA, 678 bp, Homo sapiens
  misc_feature: GYAE6OF01DAAJT.49.81.H04.1.454.CMB.1.raw
  modified_base (221)..(221): a, c, t, g, unknown or other
  misc_feature (221)..(221): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctgccggcccaggacagaaagtcaccatctcctgctctggaagcagctccaaacagttgggaanaattatgtatcgtggtaccagctagttcccaggaaccgccccagactcctcattcatgaacaataacaagcgaacgtccaagagtacttccgtacggacctattcctacgtcggccttaccgaaagtcgtggcaaccctcacgtcccacccgtggacccactccgaacccggacctccgaacgacggtacgggggaacgacggtacccgtaatttacgttaacgtgtaccggaactagtacgggtacttccgaacgtccgtagtaggtcggtgtcggtagggttggttcggggcggtaacgggaacccaaggtccgtaaccggtacccggttaccgtacggtaccgacggtaccccggaaaggccgtacccggtcccccgtcgggttccaacccgtttccgttaccccgtttccccctaccccgttcccttacccttccgttcccgtccgtacccgg

SEQ ID NO: 77461 - DNA, 872 bp, Homo sapiens
  misc_feature: GYAE6OF01D9NU1.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacgagggtcctgggcccagtctgtgttgacgcagccgccctcagtgtctgccggcccaggacagaaagtcaccatctcctgctcgtggaagcagcctaccaaactagttaggggaaataatttatgtacgttcggtacggtaccagctacggttacccgaacgggaaacccggcccccaagtaccctccctactatttacaatacgaaacaaaataaaccaaggaccggtaacgtacccaaggaacgtactttcccgtacggtaaccgtactttccttccgtcgggtacccttacccgtaaacggttccgtacggaccctaacccgtaccgaaccggtccccctaacccggttcgggacccctaacgtacccggaaaccccggtaccctacccggaaacgggtaccgggtacggggggaaccgtaacggggtacccgttaagttttaaccgtttaaccgtacgggaaaccggtaaactacgggtacgggtaacctttcccggaacggttccgttagggtacgggtttcgggtacggttacgggttacgggggtttcgggttaccgggggaacgggaacgggtaacccgaaggtcccggttaccgggtaacccggttaccggtaacgggtaccgaacccggtaccccggtaaagggtccccggttacccgggtcccccgtttagggtacccctacccgtttcccggttccccggtttcccccgtcccctttcccgttcccgttccgtcccgtccggttacccg

SEQ ID NO: 77462 - DNA, 709 bp, Homo sapiens
  misc_feature: GYAE6OF01BPL2C.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattggggaagaattatgtatcgtaggtaacagcagttccaggaacggccccagacctcctcattcatgacaataacaagcgagtcccagagacttcctagaccgtattctcgtcggcctaccaagtcgtcggcacctcacgcccacccgtggcccactccgaacccggtacctacccgacggacgtacggggacgacgggaccgtatttacgttacgtcggacggtaaactagttacgggtacttacccgagtcccgttggtaggttcgggttggtacggtaggggtttacgggttccgggggacgggaacggggtaacccaagggtccgttacgggtaccccggttacccggtaacgggtccgaaccgggaccccgtaaacgggtcccgttacccgggtccccccggttcgggttacccgtaccgttcccgttccccgggtttccccccgtcccccgtttccccttacccctttccccgttcccgttcccggtaccccg

SEQ ID NO: 77463 - DNA, 669 bp, Homo sapiens
  misc_feature: GYAE6OF01C8PCK.49.81.H04.1.454.CMB.1.raw
tcagagtcgagagacacgaccggtgctcgatttagtagtgtagattcgcggggggacaatcttcatcatgacctgctcccctctcctcctcacccttctcattcactgcacagggtcctgggccagtctgtgttgacgcagccgccctcagtgtctgccgcccaggacagaaagtcaccatctcctgctctggaagcagctaccaaacagttagggaaagtaattatcgtatcgtggtaccagctagttcccgaaggaccgccccagactctcattcatgaacaataacaagcgagtccagatactctgacgtattctctcgctcagtcgtgcacctcacgtcccaccgtggacctacgtccgaaccggtacctaccgaaggtaccggtacgggggaaccgacgggtccgtaatttaacgttaaccgtcggacggtaaactaggttacgggtacttccgaagtccgtaggagttgggtcgtacgtaggggttcggttcggggacgggtaacgggacccgtaaaggtcccgtacggacccgttaccgtacggacgtaccggcccggaaacgggtccgtacccgggccccttacggggtcctaaccgtttcccgtacccgtttaccccccgtacccctttccctaccgtttcccttccgtcccggtaaccg

SEQ ID NO: 77464 - DNA, 550 bp, Homo sapiens
  misc_feature: GYAE6OF01DBZZA.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctcctgtctgcatctgtaggagacagaatcaccatcacttgccaggcgactcaggacattagacaactatttaaattggtatcagcaagaaaccagggaaagcccctaacctcctagactctacgatgcatccaatttaggaaataggggtcccatcaaggttcagtggaagtggatcgtgggtacgttattttacttcaccatcatacactgcagcctgagattattagacaactattattactagtacaactaatatagaataatcctaaccacttctacgtttcgggacggagggacccgaacgggttggaagtactaacgtaaaacgtacgttaggtcggaccgttaggaccctactaattccgttactctttcgtaaccc

SEQ ID NO: 77465 - DNA, 817 bp, Homo sapiens
  misc_feature: GYAE6OF01DHEOO.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaagtcaccatctcctgctctggaagcagctaccaacagttagggaataattatgtatcgtggtaccagctagttcccgaaggaaccggccccagacctcctcattcatgaacaataacaagcgagtacccagagtacttcctagaccgtattccgtacgtcggcctaccaagtccgtacggccaccgtcacgccccacccgtcggaccctacgtccgaacccggtacctaccccgaacggacggtacgggggaacccgtaacggggtacccgttaacgtttaacgtttaaccgtacgggaacccgggtaaacgtacggttacggggtaacctttcccgaaccgggtcccgttagggtaacgggtttcgggttacggttacccgggtaagggggtttccgggttaccgggggaaccggggtaacggggtaacccgtaacggggtcccgttaacgggtaccccgttaccggttacgggtaccgaacccggtaccccggaaacgggtccccgttacccggggccccccgttaccggggttacccctaaccccggttttcccgttacccccggggtttcccccccccgtacccccgttttccccgttaccccgtttcccgtttaaccccggttcccggttaaccccgg

SEQ ID NO: 77466 - DNA, 630 bp, Homo sapiens
  misc_feature: GYAE6OF01COEA8.49.81.H04.1.454.CMB.1.raw
  modified_base (311)..(311): a, c, t, g, unknown or other
  misc_feature (311)..(311): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggcccaggacagaaagtcaccatctcctgctctggaagcagctccaaacagttagggaagtaattatgtatcgtggtaccagcagttcccaggaccgccccagactcctcattcatgaacaataacaagcgacgtcccagacgtacttccngaccgtattctcgtggcctaccgaagtctggcctacctcacgcccacccgtcggcccatccaccggctccagcgtggggacgacggccgtaattacttacgcggacgaactagtgggtacttccgacgtccgtaggtacggtggtacgtcggtagggttggttccgggacgggtaacgggaccgaacggtcgtacggaccccgttacgtacgggtaccacggtcccgaacggtccgtacccgggtccccttacgggtacctaccgttccgtcccggtttcccccgaccctttcccgtccttccctccgttcccgtaccg

SEQ ID NO: 77467 - DNA, 668 bp, Homo sapiens
  misc_feature: GYAE6OF01APDXF.49.81.H04.1.454.CMB.1.raw
tcagagtcgagagacacgaccggtgctcgatttagtagtgtagattcgcgggggggacgaatcttcatcatgacctgctcccctctcctcctcacccttctcattcactgcacaggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacgccccagactcctcattcatgacaataacaagcgagtccagagattcctgaccgtatctctggctccaagtctggcactcacgccaccctggccatcaccggactccagacgtggggacgacgggcctaattacttaaccgtggtaccgggaaacaggttgggactttaccgacgtccgtggacggttcgggtgtcgaggggttcgttccggggcgggaacggggacccgaaggtccttacgggacccgttaccggttaagggcccgtaacggcccccgtaaaggggtccccttaccgggggtccccccttccggggtcctaaccccggtttcccgttacccgggttttccccccccggtcccccggtttaccccttcccccgtcccgttttcccgtccccgggtttaaaccccg

SEQ ID NO: 77468 - DNA, 769 bp, Homo sapiens
  misc_feature: GYAE6OF01A6VXT.49.81.H04.1.454.CMB.1.raw
  modified_base (220)..(220): a, c, t, g, unknown or other
  misc_feature (220)..(220): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctgcggccccaggacagaaagtcaccatctcctgctctggaagcagcctccaacattgggaanaattatgtatcgtggtaccagcagttcccaggaaccggccccagacctcctcattcatgacaataacaagcgacgtcccagagacttccgagaccgattctcgtggctccaagtcgtggccacctcacgcccaccctggcccactccgacccggtactcccgaaggaccggtcgggggaaccgacgggtaccgtagtttaacgttaccgtacggaccgggtaaactaggttacgggtaactttccccggaacgtcccgttagggaacgggtttcgggttacggtacgggttagggggtttcgggtttccgggggaaccggggtaacggggtaaccccgtaaagggtcccgttaccggggtaacccccggtttaccggttaacgggtacccgaaccgggaccccgtaaacggggtccccgttaccccggggacccccccgtttccggggttaccctaccccggtttaccccgttcccccgggtttacccccccggttcccccctttcccccggtttacccttacccccgttccgttaccccggtaacccg

SEQ ID NO: 77469 - DNA, 757 bp, Homo sapiens
  misc_feature: GYAE6OF01B5ZP3.49.81.H04.1.454.CMB.1.raw
  modified_base (272)..(272): a, c, t, g, unknown or other
  misc_feature (272)..(272): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctaccaacagttagggaagaattatgtatcgtggtaccagcagttccgaggaaccgccccagacctcctnacttcatagacaataacagaccgagtcccaagacgtacttccgtacgaccgtattccgtctggtcctaccgtaagtccgtacggcctacctacgaccgaccctaacccgtcggaccctaacgtaccgacccggtacctaccgaacggtacggtacggggaccgacgggtaccgtaagtttaacgttaccggtacggacggtaaacgtacggttacggggtaccttaccggacgtcccggtttagggaaggtttggggttacggttacgggtaaggggttccgggtttacggggaaccggggtaacgggggaacccgtaacggtcccggttaaccggtacccggttaccggtaacgggttccgaaccggtacccgaacgggtcccggtacccgggtcccccgttgggttaccctaccggttcccgtttccccgggttccccccgtaccccctttccccgcctttcccgttcccgtcccggtacccg

SEQ ID NO: 77470 - DNA, 568 bp, Homo sapiens
  misc_feature: GYAE6OF01D5UTA.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaataattatgtatcgtggtaccagcagttcccaggaaccgccccagactcctcattcatgacaataaccaagcgagtccaagacgtattccgtagaccgtattctcgtgcctcaagtctggacacctcacgcccacccgtggaccactccgacccggactaccgaggacgtggggacgaggccgtaatttactacgtgacggaacagtcggtattccagcctgagtggtgtcgtagggtcggttcgggacgacgggaccgaagtcgtacggtaccgtcgtacggtcacgcccgaaggtcgtcggccccgtggtccacgtccgtcgttcccccgccttctcctctcctcgtacc

SEQ ID NO: 77471 - DNA, 631 bp, Homo sapiens
  misc_feature: GYAE6OF01EPB24.49.81.H04.1.454.CMB.1.raw
  modified_base (279)..(279): a, c, t, g, unknown or other
  misc_feature (279)..(279): n is a, c, g, or t
  modified_base (470)..(470): a, c, t, g, unknown or other
  misc_feature (470)..(470): n is a, c, g, or t
tcagagtcgagagacacgaccggtgctcgatttagtagtgtagattcgcgggggagtcccaaccaggacacagcatggacatgagggtccctgctcagctcctgggggctcctgctgctctggctctcaggtgccagatgtgacatccggatgacccagtctccatccctccctgtctgcatctgtaggagacagaatcaccatcacttgccaggccgactcaggacattagactaacttaatttaaattggtatcagacaagaaaccgagggaaaccncccctaaacctcctgatctacgatgacatcctaagtttaggaaagtacgggtacccagtacgtaaggttcaggtaggaagtggatcgtagggtacttattttacttacactatctataccaactgacacgtctaggaaggtattaatgaactaaactatttaacttacgtacgtacaaactaattaagtanaattaacctacctaaccctacgtttccgtaacgttttaccggggaccgggtaacggggtacccgtacggggtagaaaggtaaccttaacgaaaacggttacgtacgggtcgggccttacggaccctaaccgtatttacccgttcgttcccttacctacccg

SEQ ID NO: 77472 - DNA, 583 bp, Homo sapiens
  misc_feature: GYAE6OF01D84NZ.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcacatcacttgcaggcgactcgaggactagttacgactaacttaagtttaaattggtatacgagacaacggaaaaccgagggaaaccgtacccctaacctccgtagactcgtaacgatacgactactacctaagtttacggaaacgtacgggtacctagtacgtaaggttcgaggtaggaagtgtatcgtaggtacttacgtttacttacactatacataccaactgacacgctaggagtatatagactaagtattatacgtataacaataatatagaattactacctacctactactacgttacggacggacggacgtagggagtacgagtaaccgaaacgtagtaggcgtccgaggtacctactacttcctacgtcctacgtaccc

SEQ ID NO: 77473 - DNA, 528 bp, Homo sapiens
  misc_feature: GYAE6OF01EQPKH.49.81.H04.1.454.CMB.1.raw
  modified_base (270)..(270): a, c, t, g, unknown or other
  misc_feature (270)..(270): n is a, c, g, or t
tcagagtcgagagacacgaccggtgctcgatttagtagtgtagattcgcgggggagtcccaaccaggacacagcatggacatgagggtccctgctcagctcctgggggctcctgctgctctggctctcaggtgccagatgtgacatccggatgacccagtctccatcctccctgtctgcatctgtaggagacagaatcaccatcacttgccaggcgactcaggacattagacaactatttaaattggtatcagcagaaaccagggaaacncccctaacctcctgactctacgatgcatccaatttagaaatagggtccatacaaggttcagtggaagtggatcgtggacttatttacttcactatcatcaactgacagctagaggtatagttgacaaactatattactgtacaacaatatgataatactaccactctacgtttcgggacgtacgggacctagggtaggagtaagtacgaaaacggtatcggtggacttagacctaccgtattcgtcttccgtctaccg

SEQ ID NO: 77474 - DNA, 719 bp, Homo sapiens
  misc_feature: GYAE6OF01ASLOC.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacagttgggaataattatgtagtcgtggtaccagcagttcccaggaaccggccccagacctcctcattcatgacaataacaagcgagtccagacgtacttccgtgaccgtatttctacgttggccttaccgaacgttctaggcctaacccttccgacggaccccacccgtcggaccctactacccgaacccgggtaccttacccgaaggtaccggttcggggggaaccgtaacgggtcccgtaagtttaacgtttaaccgtcggaaccgggaaactaagggttacggggtaactttccgacgtcccgttaggtaggttgggtcgtacggtaggggttggtttaccggggacgggtaacgggaccgtaagggtccgtacggtaccgtaccgtacgggtaccgacggaccccgtaagggtcccgtaccgggtcccccgttggtacctacgttcccttaccgggttccccccctaacccgttcccttacccttcccgtccgttaacccggtcccg

SEQ ID NO: 77475 - DNA, 679 bp, Homo sapiens
  misc_feature: GYAE6OF01CTCP6.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccactcctcctgtctgcatctgtaggagacagatcaccatcacttgccaggcgactacaggacattagactaaacttaatttaaattggtatacagacaacgaaaccgaacgggaaaccgacccctaactcctacgtactactacgatcactactactaagtttacggaaacgtacggggtaccctagtacgaaggttacgaggtaggtaagtaggtagtacgtaggtactttatttacttactacgtatactacgtactacttagcgtacgtccgtaggaagtacttaagttacgaactaacgttaattaacttaacgttacgtaaactaaacttaagttaacttaagtaacttaacttaaccttaaccctaccgtacttaccgggtttaccgggacggggtaaccgggtaaccgtaacggggtaacgtaacggtaaacgtaacgtaaacggtaacgttacgggtcgtaccgtacgacccgttaaccttacttccgttacgttccgtttaccgtaccg

SEQ ID NO: 77476 - DNA, 576 bp, Homo sapiens
  misc_feature: GYAE6OF01AV3VF.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaacttatttaaattggtatcagacaagaaaccagggaaacgcccctaacctcctgatctacgatgcatacctaatttaggaaagtacggggtcccagtacgaaggttcagtaggaagtggatcgtaggtacttatttacttcactatcatcaacctgcagcctaggaggtattagttgactaaactattaacttactagtacaactaattatagaattaactacctaacctactacctaccgtttcgggacggacgggaccgtacgggtaggaacgtaacgtacgaaaacgtacgttaggtcggactacggaccctaaccgtacttaccgtcgttccttccgtaccg

SEQ ID NO: 77477 - DNA, 605 bp, Homo sapiens
  misc_feature: GYAE6OF01DIMI6.49.81.H04.1.454.CMB.1.raw
  modified_base (220)..(220): a, c, t, g, unknown or other
  misc_feature (220)..(220): n is a, c, g, or t
  modified_base (414)..(414): a, c, t, g, unknown or other
  misc_feature (414)..(414): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattaggggaanaatttatgtatcgtggtaccagcagttcccaggaccggccccagacctcctcattcatgacaataacaagcgagtcccagagtattccagaccgtattctcgtggcctaccaagtctggcctacctcgacgcccacccgtggcccagtccaccggactccgagacgtcggggacgacggcctagttacttacgngacggaactagtgggacttccgagccgttagaggtggtcgtcgtaggggttcgttacgggcggaagggaccaagggtccgtacggacccgttaccgtaggccaacggcccgaaggtccgtacgggccccttgggtcctaccgttccgtccgtttcccccacccgtttccctacgttccctcgtccgtaccg

SEQ ID NO: 77478 - DNA, 656 bp, Homo sapiens
  misc_feature: GYAE6OF01B60KL.49.81.H04.1.454.CMB.1.raw
  modified_base (222)..(222): a, c, t, g, unknown or other
  misc_feature (222)..(222): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagcctaccaacagttagggaanaattatgtatcgtggtaccagcacgttcccgaggaaccggcccccagacctcctcattcatgacaataacaagcgagtcccagagtacttcctgaccgtattctcgtggcctaccgaagttccgtcggccacctcgacgcccacccgtggacccatccgacccggacctccgagtacggtcggggacgacggccgtaatttacgttacgtgaacggaacagtacgggacttccgagtccgtaggaggtggtcgttacggtaggggttcggttacgggacggggtaacgggaacccgtaaggtccgttacggacccgtaccgtacggtaccacggacccgaagggtcccgtccgggcccccttcgggtaccctaccgttcccgttacccgttcccccctacccgttcccctaccttcccctccgttccgtacccg

SEQ ID NO: 77479 - DNA, 548 bp, Homo sapiens
  misc_feature: GYAE6OF01BQHWE.49.81.H04.1.454.CMB.1.raw
  modified_base (267)..(267): a, c, t, g, unknown or other
  misc_feature (267)..(267): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaacncccctaacctcctgactctacgatgcatccaatttggaaatagggtcccatcaaggttcagtggaagtggatcgtgggacttatttacttcactatcatcaactgcagcctgagtatattgacaacattattactagtacaactaatatagaataactctaacctacttactacgtttcgggacggtacgggacccgtagggtaggagtaataccgaaaacgtacgttggtcggtacctacggacctaaccgtacttaccttcggttcctttcgtaacccg

SEQ ID NO: 77480 - DNA, 598 bp, Homo sapiens
  misc_feature: GYAE6OF01DFSAJ.49.81.H04.1.454.CMB.1.raw
  modified_base (279)..(279): a, c, t, g, unknown or other
  misc_feature (279)..(279): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatcgacccagtctccatcctcctgtctgcatctggtaggagacagaatcaccatcacttgccaggcgactcgaggactattagactaacttattttaaattggtaatcagacaagaaaaccgagggaaacnccccctaacctcctagactactacgatgactatacctaagtttaggtaaagtacggggtcccaagtacgaaggttacaggtaggaaggtggtagtcggtaggtacgttacttttacttcgtactatctactacgactgcacgctagagtatatacgacaactatacttacgtcgtaccaataatatagtaataactactacctactcttaccgttcggacggtacggaccgtacgggtagacgtagtaaccgaaacggtacgttacggtcggtacgtacgacctacccttacgtacctttacgtccgtttctaaccccg

SEQ ID NO: 77481 - DNA, 555 bp, Homo sapiens
  misc_feature: GYAE6OF01BBAUH.49.81.H04.1.454.CMB.1.raw
  modified_base (391)..(391): a, c, t, g, unknown or other
  misc_feature (391)..(391): n is a, c, g, or t
tcagagtcgagagacacgaccggtgctcgatttagtagtgtagattcgcgggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaacttatttaaattggtatcagcagaaaccagggaacgcccctaacctcctagactctacgatgcatcctaagtttaggaaagttacggggtacccagtacaaggttcgaaggtggaagtggatcgtagggtacgttattttacttcactatctatcactncagctagagtatatacgacaacattattactgtactaactaattatagtattaactactaccacttactacgtttcgggaccggagggacccgtagggtaggacgtaagtaccgaaacgtacgtaggtcgacgtcgacctacacttctcgttcgttcgtacccg

SEQ ID NO: 77482 - DNA, 750 bp, Homo sapiens
  misc_feature: GYAE6OF01CHHC4.49.81.H04.1.454.CMB.1.raw
  modified_base (233)..(233): a, c, t, g, unknown or other
  misc_feature (233)..(233): n is a, c, g, or t
tcagagtcgagagacacgaccggtgctcgatttagtagtgtagattcgcgggggggacaatcttcaatcatgacctgctcccctctccctcctcacccttctcattcactgcacagggtcctgggcccagtctgtgttgacgcagccgccctcagtgtctgccggccccaggacagaaagtcaccatctcctgctctaggaagcagcctccaactagttggggaaataattangtaatcggtgtaaccagcagttcccaggaaccgccccagtactcctcaagttcagtgaacaataacgaagcgaacgtcccagatacgttccagaaccgtattcgtctaggcctaccgaagtcctaggaccctaccgtccaacgacccgtaacccgtcggacccactaccgaacccggtacctaccgaacggaccggtacgggggaaccgtaacgggtacccgtaaatttaacgttaacggtacggtaacgggaaactacgggttacgggtaacctttaccggaaccgggtaccgttagggaacggtttcggtacgggttacggtagggggttaccggttacggggtacggaacggggtaacccgaagggtcccgttaacgggtaacccgttcggtaacggttacccgaacggtaccccgaaacgggtcccgttaaccgggtcccccttacgggttaccacccgttccggttacccgttaccccctaccgttcccgtccttcccgtcgtcccggtacc

SEQ ID NO: 77483 - DNA, 563 bp, Homo sapiens
  misc_feature: GYAE6OF01BZ2BR.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaacgccccctaacctcctgatctacgatgcatccaagtttggaaagtacgggtccatacaaggttcagtggaagtggatcgtggtacgttattttacttcactatacatcactgcagctagagatatgacaatatattactgtacaactaatatagtaataatacctacctacttactaccgtttacgggacggtacgggaccgacgggtaggtaacgaacgtaaccgaaacgtaacgttcggtacgggaccttacggacctacccgtagttaccctttcgttcccgttaccgttacccg

SEQ ID NO: 77484 - DNA, 558 bp, Homo sapiens
  misc_feature: GYAE6OF01BI7MQ.49.81.H04.1.454.CMB.1.raw
  modified_base (381)..(381): a, c, t, g, unknown or other
  misc_feature (381)..(381): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactcctcattcatgacaataacaagcgagtcccagagacttcctgaccgattctctggctccaagtctggcacctcacgcccacccgtggccatccaccggactccagaccgtggggacnggccgattactacgngacggaacngtagggacttccgagcctagagtggtgtcgtagggtcgttcgggcggagggaccaagccgtaggacccgtcgtaggtcacggcccaagggcctcgggcccctgggtccacgttctcgttcccccacccttccctacctcttccgtccgtaccg

SEQ ID NO: 77485 - DNA, 858 bp, Homo sapiens
  misc_feature: GYAE6OF01EK3RY.49.81.H04.1.454.CMB.1.raw
tcagagtcgagagacacgaccggtgctcgatttagtagtgtagattcgcggggggacaatcttcatcatgacctgctcccctctcctcctcacccttctcattcactgcacagggtcctgggcacagtctgtgttgacgcagccgccctcagtgtctgccggccccaggacagaaagtcaccatctcctgctctggaagcagcctaccaaacagttgggaaagaattatgtatcgtggtaccagcagttcccaggaaccggccccagacctcctcattcatagaacaataacaagcgacgtcccgagacgtacttcctgaccgtacttctcgtcggcctaccgaagtcctcggacctacctcacggccccacccgtggacccacgtcccgaacccggaccttccgaacgtaccggtcgggggaaccgacggaccgttaatttaacgttacgtacgggtaccgggaaacgtaggtacggggtaactttacccgaacggttcccgttagggtaacgggtttcggggttacggtttaccggggtacgggggtttacgggtttaccggggggaacccgggggtaaacgggggtaacccccgtaaaacggggtcccggtttaacccggggaaaccccggggtttaccccggttaaacgggggttaccccgtaaccccgggtaaaccccccgggtaaaacggggttccccgggtttaacccccggggtcccccccgtttaccgggggttacccccttaacccggtttcccccggtttacccccggggtttttccccccccggtacccccccgttttacccccgtttaccccgttttccccccgttcccggtttaaccccccggg

SEQ ID NO: 77486 - DNA, 737 bp, Homo sapiens
  misc_feature: GYAE6OF01BDF2Z.49.81.H04.1.454.CMB.1.raw
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgccggcccaggacagaaagtcaccatctcctgctctggaagcagctaccaaacagttaggggaaataatttatgttaatcggtacggtaaccagctacggttcccaaggaaccggcccccagacctcctcattcatcgaacaactaacaagcgacgtcccagagacttcctgaccgtattctctggcctccaagtcctaggccactcacgccaccgtggaccatccaacccggtactccgagacgtcggggacgacggtaccgtaagtttactacgtcggaccgtaactacgtcgggtaacttaccgaggtaccctaggtaacgggttcgggtacgttacgggtaacggggtttcgggtttaccggggccgggtaaacgggggtacccgtaagggtcccggttacggtaaccccggttaccggtaacggggttaccccgaacggtaccccgtaacggggtcccgttacccggggtcccccgttaccgggttccctaaccgtttccccgttccccgggtttacccccccggtccccgtttcccccgttaccgtttccccgttccgttcccggttaaccccg

SEQ ID NO: 77487 - DNA, 207 bp, Homo sapiens
  misc_feature: GYAE6OF01DYQTQ.49.81.H04.1.454.CMB.1.raw
  modified_base (203)..(207): a, c, t, g, unknown or other
  misc_feature (203)..(207): n is a, c, g, or t
tcagagtcgagagacacgaccggtgctcgatttagtagtgtagattcgcgggcacgaccggtgctcgatttagtagtgtagattccgcgggcacgaccggtgctcgatttagtcacgcgagaaagggaaggggctggccctgacgtgtttctgttcccgccctcctctctctcgactctgagcgggctggcaaggcgcatagnnnnn

SEQ ID NO: 77488 - DNA, 727 bp, Homo sapiens
  misc_feature: GYAE6OF01BABRU.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggcccaggacagaaagtcaccatctcctgctctggaagcagcctccaacagttagggaagaatttatgtatcgtggtaccagcagttcccaggaaccgccccagacctcctcattcatgaacaataacaagcgacgtacccagacgtacttcctcgaccgtattcctcgtcggcctaccgtaagttctggacctacctaccgacgccccacccgtggacccactccgacccggtacctccgacggaccggtacggggaacgacgggtaccgtatttaacgttaccgtacggaccggtaaacgtaggttggggtaacctttccccgaacgggtacccgttagggtacggttgggtacgttacgggtagggggttccgggtttaccggggccggggtaacgggtaacccgaaaggtcccggttacgggtaccccgttaccggttaacggtccgaacggaccccgtaagggtcccgttcccgggtcccccgttcgggtacctacccgttcccgttaccgttacccccctaccccgttcccttaccgttcccgttccgttccggtacccg

SEQ ID NO: 77489 - DNA, 581 bp, Homo sapiens
  misc_feature: GYAE6OF01DEJU8.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctcctgtctgcatctgtaggagacagaatcaccatcacttgccaggcgactcaggacattagacaactattaaattggtatcagcagaaaccagggaaagcccctaacctcctgatctacgatgacatccaatttaggaaataggggtcccatcaaggttcagtggaagtggatctgggtacttattttacttctacatcatcactgcagcctgaggatattgactaactatattactagtacaactaattaatagaattaaacttacctaaccctacttctaccgttttacgggacgggacgggaaccctacgggttagggaacgtacgtaaccgaaaaccggtaacgttagggttcgggtaccgtacggacccaacccgttaacttcccgtttcggttacctttccttaacccg

SEQ ID NO: 77490 - DNA, 549 bp, Homo sapiens
  misc_feature: GYAE6OF01AQ94E.49.81.H04.1.454.CMB.1.raw
  modified_base (188)..(188): a, c, t, g, unknown or other
  misc_feature (188)..(188): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtagganacagaatcaccatcacttgccaggcgactcaggacattagcaactatttaaattggtatcagcaagaaaccagggaaacgcccctaacctcctagatctacgatgcataccaatttaggaaatacgggtccatacaaggttcagtggaagtggatcgtggtacttatttacttcactatcatcaactgcacgcctgaggtatattgacaactattacttactgtacaactaattatagtaattaactacctaacctacttctaaccgtttcggacggtacggaccgtacgggtaggagaacgtacgaaacggtacttaggtcgaccgtagacctacctagttccttcgttccttcgtaccg

SEQ ID NO: 77491 - DNA, 713 bp, Homo sapiens
  misc_feature: GYAE6OF01BHZDH.49.81.H04.1.454.CMB.1.raw
  modified_base (200)..(200): a, c, t, g, unknown or other
  misc_feature (200)..(200): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaancagctccaaacagttgggaaagtaattatgtatcggtggtaccagctagttcccaggaaccggtccccaagacctccctcattcatcgaacaataacaagccgagtcccaagacgtacttccctaggacccgtatttcctcgtcgggtaccttacccgtaaagttccgtacgggacctacccgttcaaccggccccctaaccccgtcggacccctacgtcccgaaccccggtacctacccgaggtaccggtcgggggaaccgacgggtacccgtaatttacgttaccgtacggaccggtaaactaggttacgggtactttacccgacgtacccgttaggaggtttcggtacgtacggtagggggttcggtttcggggcgggtaacggggacccgaagggtccgtacggtacccgtaccgtacggtcgacggacccgaggccgtccggccccgtacggtcctacctcccgttaccgtccccctacccgttccctaccttcctccgtccgtaccg

SEQ ID NO: 77492 - DNA, 516 bp, Homo sapiens
  misc_feature: GYAE6OF01C3J35.49.81.H04.1.454.CMB.1.raw
  modified_base (425)..(425): a, c, t, g, unknown or other
  misc_feature (425)..(425): n is a, c, g, or t
tcagagtcgagagacacgaccggtgctcgatttagtagtgtagattcgcggggagtcccaaccaggacacagcatggacatgagggtccctgctcagctcctgggggctcctgctgctctggctctcaggtgccagatgtgacatccggatgacccagtctccatccctcctgtctgcatctgtaggagacagaatcaccatcacttgccaggcgactcaggacattagacaacttatttaaaattggtatcagcaagaaaccagggaaaacgccccctaaacctcctgatctacgatgcatccaatttaggaaagtagggtacccatacaaggttcagtggaagtggatcgtgggtacgtattttactcacatcatcactgcagcctgagatatgacaacatattactagtacaactaatatanataactctaccacttcacgtttcggacggaggaccaggtaggatagtacgaaacgtatggtcggcttcgctacctatccttgtcttctacg

SEQ ID NO: 77493 - DNA, 576 bp, Homo sapiens
  misc_feature: GYAE6OF01CAY1S.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaaccggccccagactcctcattcatgacaataacaagcgagtcccagagacttcctgaccgattctctggctccaagtctggcacctcacgcccaccctggccatccacccggactccagacgtggggacgacgggccgattacttactggcggaacagtgggattcccgagtcctggacgttggtgtcgaggggttcgttcggggacggtagggacccaaggccgtacggacccggttcgtaggtccacggcccgaagggcctcgggccccctggtaccaccttccgtccggttcccctacccttcctacctccttcctcgtccc

SEQ ID NO: 77494 - DNA, 850 bp, Homo sapiens
  misc_feature: GYAE6OF01B202Q.49.81.H04.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
tcagagtcgagagacacgaccggtgctcgatttagtagtgtagattcgcggggggacaatcttcgatcatgacctgctccccgtctcctcctcacccttctcattcactgcacaggtccttggcccagtctgtgttgacgcagccgcctcagtgtctgcggcccaggacagaaagtcaccatctcctgctctggaancagctcaacnttagggaanaattatgtatcgtgtaccagcagttccaggacgccccagactcctacattcatgactaataacaagcgaacgtacccagacgacttccgagtaccgtacttctactggtccttccgaaagtcctacggtaccacctacacgtccctacccgtcggaccctacttacccgacccgggtactcccgaacggtaccgttacgggggaccgtaacgggttacccgttaacgtttaaccgtttaaccgttcggaacccggggtaaacctaaggttacgggggttaacctttaccccggaacgggtaccccgttaggtaaccgggtttacggggtttacggttaccggttaacgggggtttaccggtttaccgggggtaaccgggtaaacgggggtaacccctaaaagggttacccgttaccgggtaaccccggtttaccccggttaacggggttacccgaacccgggtacccccggtaaaacgggggttcccggttacccccggggtacccccccttaacggggggttacccctaaaaccgtttcccggttaacccccgggttttaaaccccccctcccccgggttttaccccgtttacccgtttccccgttcccccggtttacccggttaacccccgg

SEQ ID NO: 77495 - DNA, 710 bp, Homo sapiens
  misc_feature: GYAE6OF01BCNTH.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatcgacccagtctccactccctccctgtctgcatctgtaggagacagaactcacatcacttgccgaggcgactcgaggactaattacgactaaacttaattttaaagttggtatacaagacaaaggaaacccgaagggaaaccgtaccccctaacctcctagactcctaacgatcgactaactacctaagttggaaacgttacgggtaccctaagtacgtaaggttacgaaggttggtaaggtggtacgttcgggtttacgggttaacgtttactttttacgttacccaactacgttacaacttaccgtaaccgtagaccgtactaccgtaggtagtattaagttacgaacctaaagtacttactttaacgtacgtaactaaacgaatttaacaagttaacttaacttaccctaaccctaactttaccgtacggtttaccggggaccgggtaacggtacccggtaagggtacgggtaactaaccgttaaaccgaaacggttagttcggtacggacctacgtaccccgtaacttacggttattccggttacttaccgtacccg

SEQ ID NO: 77496 - DNA, 632 bp, Homo sapiens
  misc_feature: GYAE6OF01E35Z6.49.81.H04.1.454.CMB.1.raw
tcagagtcgagagacacgaccggtgctcgatttagtagtgtagattcgcgggggggacgaatcttcatcatcgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagattatgtatcgtggtaccagcagttcccaggaaccggccccagactcctcattcatgacaataacaagcgagtcccagagattcctgaccgattctctggctccaagtctggcacctcacgcccaccctggccatcacccggactccaagcgtggggacgaggccgattatactgcggaaacagtagggattccgagtccgtaggaggtgggttggtcgtagggggtcggtttcggggccggggaacggggacccgaagtccgtacggtaacccgttccgtaacgggtccctaacgggaccccgtaaacgggccgttaccgggccccccgttacggggtaccctacccgtttccgtccggttttcccccccgccccgttcccttcccgttcccctttccgtcccgttacccg

SEQ ID NO: 77497 - DNA, 787 bp, Homo sapiens
  misc_feature: GYAE6OF01CQR7T.49.81.H04.1.454.CMB.1.raw
  modified_base (193)..(193): a, c, t, g, unknown or other
  misc_feature (193)..(193): n is a, c, g, or t
  modified_base (317)..(317): a, c, t, g, unknown or other
  misc_feature (317)..(317): n is a, c, g, or t
  modified_base (769)..(769): a, c, t, g, unknown or other
  misc_feature (769)..(769): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacagtccggatcgacccagtcctccactccctccctgtctgcatctgtagganacagaatccacatcactcgcgacggcgactcgaggactatacgactaacttaagtttaagttcggtatacaagaaccaaaacgacgggtaaaccacccctaaccgtctacgtaactcctaacgntacgactaacttaaccgtaagtttaacgggaaaacggttccggggtacccctaagttaaccggttaaacgggtacgttaaggggtaacgggtaaagggttacggtaacggttacggttaacgggggtttaacctttttaaacgttttttacccttaaccttaaacccgtacgtttaaccctaaaccgtttaacccaacccggttacgtacccgtaacggtcccgtttaagggaaggttaacttacgtttaacgaactaaacgttaactttaacgttaaccttaagtaaaccctaaaattaacgtattaacgtaaacttaccttaacctaacccgtacttacccggtacggttacggggacggtaaccggacccgggtaaagtacggaactaaacgtaaccgaaaggtacccgtaggtacggacctcggaccctaacgtacttccggtttacncttcctacccgttacccg

SEQ ID NO: 77498 - DNA, 506 bp, Homo sapiens
  misc_feature: GYAE6OF01DVJ7R.49.81.H04.1.454.CMB.1.raw
  modified_base (487)..(487): a, c, t, g, unknown or other
  misc_feature (487)..(487): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacgccccagactctcattcatgacaataacaagcgagtcccagagattcctgaccgattctctggctccaagtctggcactcagcccaccctggccatcaccggctccagactggggacgaggccgattatactgcggaacatgggattccagcctgagtggtgtcgagggtgttcggcggagggaccaagctgaccgtctaggtcagccaaggctggccctggcactctgtcccnccctcctctctcgtcgtac

SEQ ID NO: 77499 - DNA, 655 bp, Homo sapiens
  misc_feature: GYAE6OF01CCZXN.49.81.H04.1.454.CMB.1.raw
  modified_base (437)..(437): a, c, t, g, unknown or other
  misc_feature (437)..(437): n is a, c, g, or t
  modified_base (615)..(615): a, c, t, g, unknown or other
  misc_feature (615)..(615): n is a, c, g, or t
tcagagtcgagagacacgaccggtgctcgatttagtagtgtagattcgcgggggagtcccaaccaggacacagcatggacatgagggtccctgctcagctcctggggctcctgctgctctggctctcgaggtgccagatgtgaacatccggatcgacccagtcctccatccctccctgtctgcattcgtaggtaggagacagaaactccaactactcaacgttcgacgacggcactcaaggactattacgactaacttaatttaaatggtatcgaagacgaaagaaaccgaagggaaacctcccctaaactccgtagactacgtacgattcatactactaagttaggaaacgtcgggtaccagtacgtaaggttcaaggtggaaagtggtatcggtaggtaactttactttacttacactatactagtaccaacgtnagtacgtccgtaggtaacgtatttaacgtacgaactaaacctttagtaactttaaccgagttaacaaaacgtaattagtaaagtaacttaaacaccgtaccctaacgttaccttacggttacgggaacggtaacgggtacgacgggtagaacgttacgaaacgtaaacggagttcggnaccgtccgtaaactctagttcctagttccgtacttacccg

SEQ ID NO: 77500 - DNA, 595 bp, Homo sapiens
  misc_feature: GYAE6OF01BS0ZY.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactcctcattcatgacaataacaagcgagtcccagagacttcctgaccgattctctggctccaagtctggcacctcacgcccacctggccactcgacccggactccagacgtggggacgacggccgtaatttacgttacgtggacgggaaacaggtgggaactttcccgagtccctaggaggttggtgtcgaggggttgttacgggcgggagggaccaaggcgtcggaccgttccgtagggtccacgaccccgaaggccgttccgggccccgttaggtcctaccgttccttcccggttcccccaccccttccctaccttcctccgtacgtaacg

SEQ ID NO: 77501 - DNA, 702 bp, Homo sapiens
  misc_feature: GYAE6OF01BU9KA.49.81.H04.1.454.CMB.1.raw
  modified_base (208)..(208): a, c, t, g, unknown or other
  misc_feature (208)..(208): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggcccaggacagaaagtcaccatctcctgctctggaagcagctccaanattaggggaataattatgtatcgtggtaccagcagttccgaggaaccggccccagactcctcattcatgacaataacaagcgagtcccagagacttcctgaaccgtattcctactcggcctacccgaagttcctgggcctaacctcaacggcccaccccgtggcccaatccgaacccggacctcccgaacggacgtgggggtacgacgggccgtatttacttacgtggacggaacagttacggggtaacttccaaggcccgtggaacggttgggtcggtcgtagggggttcgtttcggggaccggggaagggtacccgaagggtcccgtacgggtaccccgttacgtacggggtacccaacgggtacccccgaaaggggtcccgttacccggggccccccgtttacgggtaccctaccccgtttccgttaccccgtttccccccgtaccccctttcccccgtaccctttccgtttcccgtccccggttaacccg

SEQ ID NO: 77502 - DNA, 768 bp, Homo sapiens
  misc_feature: GYAE6OF01EPT7J.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacaggtcctgggcccagtctgtgttgacgcagccgccctcagtgtctgcggccccaggacagaaagtcaccatctcctgctctggaagcagctccaacagttagggaaagtaattatgtatcgtggtaccagcacgttcccaggaaccggccccagacctcctcattcatagacaaataacgaagcgacgtcccaagaggtacttcctcgaaccgtatttcctcgtcggacctaccgtaagttccgttcggcctaaccctccgaccgccccgtaccccgtcgggaccctaacgtacccgacccgggtaacccttacccgaaacggtaaccgggtacgggggaacccggtaacggggacccgttaaagtttaaccgtttaccgtacgggaaccggtaaaccgtaggtacggggtaacctttccccgaagttcccgtaggacggttgggtcggtacggtacggggttcggttccgggggacgggtaacggggacccaacgggtccgttacggtaccccggttccgttaacgggtaccgaccggtaaccccgtaaaggggcccgttaccgggcccccgttcgggtacccgttacccgttcccggttcccgtttccccccgtccccgtttccccttaccttcccgttcccgtccggtacccg

SEQ ID NO: 77503 - DNA, 673 bp, Homo sapiens
  misc_feature: GYAE6OF01AWLWD.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaactagttgggaataattatgtatcgtggtaccagcagtccaggaccgccccagactcctcattcatgacaataacaagcgacgtcccagagacttccagaccgtattctacgtggcctaccgaagtcgtcggcctaccctcgaccgcccacccgtggacccatcccgaacccggtactccgacggacggtggggacgacgggtcctaatttacttacgtacggaccggtaaactaggttacgggtaaccttaccgacggtccgtagggtacggttacgggttcgtacgggttaggggttcgggttaccggggacgggtaacgggacccgtaagggtccgtacggtacccgtccgtaggtaccgacggtacccgaacgggtccgtcccgggtccccgtggtaccctaccgttcccgtccccggttacccccgtcccttccgttacccttccgtcgtcccggtacccg

SEQ ID NO: 77504 - DNA, 649 bp, Homo sapiens
  misc_feature: GYAE6OF01CIPVX.49.81.H04.1.454.CMB.1.raw
  modified_base (503)..(503): a, c, t, g, unknown or other
  misc_feature (503)..(503): n is a, c, g, or t
  modified_base (641)..(641): a, c, t, g, unknown or other
  misc_feature (641)..(641): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctcctgtctgcatctgtaggagacagaatcacatcacttgcaggcgactcgaggacattacgactaaacttaattttaaagtggtaactacgagacaaacggaaaccgaaggggaaaccctcccctaaactccgtagaacttaccgtaacgatcgacctaacgttaccgtaaagtttacgggaaaagtccggggtaccctaagtaccgtaaggttccgtaggtagggaacgttggtaacttcggttagggtaacttttaattttaccttaccactattacacttacgacctggacctacgtccgtaggaagtactattacgaactaatattattacgngtaaccaataactatagaacttaactccgtaccacgttacgtacgttcgggacggacggtaccgagggtacgaagtactaaccgtaaacgtcgtacggttcggacttaccgactaaccgttacttccgtacttccctntaaccccg

SEQ ID NO: 77505 - DNA, 664 bp, Homo sapiens
  misc_feature: GYAE6OF01ACUNH.49.81.H04.1.454.CMB.1.raw
  modified_base (204)..(204): a, c, t, g, unknown or other
  misc_feature (204)..(204): n is a, c, g, or t
  modified_base (283)..(283): a, c, t, g, unknown or other
  misc_feature (283)..(283): n is a, c, g, or t
tcagagtcgagagacacgaccggtgctcgatttagtagtgtagattcgcgggggagtcccaaccaggacacagcatggacatgagggtccctgctcagctcctggggctcctgctgctctggctctcaggtgccagatgtgacatccggatgacccagtcctccatcctccctgtctgcatctggtaggagacagaatcaaccntcacttgcagggcactcaggacctattacgactaaacttatttaaagttggtaatcagcaacgaaaccgaggggaaccncccctaactcctagtactaccacggtatcgctactaccgtaagtttagggaaacgtcgggtcccaagttacgtagtcgaggtaggtacgtgacttcggtagggtacctttatttaccgttacaacttactctaacgtacctaacgtcgactaccgtcgtaggtaaggttacttgttacgacttaaacgactttacgtttaacgtactaaccaagttaagttacgttagtaactttaaccgtaacccgtacctacgttacgtaacccggtttcgggaacggtaccgggtaacctacggggtacgtaagtaaacccgtacgtaaaccggagtttcggacgttaccacggtacctacgtacttcggtacttactttcaacccgg

SEQ ID NO: 77506 - DNA, 617 bp, Homo sapiens
  misc_feature: GYAE6OF01DTM4J.49.81.H04.1.454.CMB.1.raw
  modified_base (606)..(606): a, c, t, g, unknown or other
  misc_feature (606)..(606): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctcctgtctgcatctgtaggagacagaatcaccatcactgaccaggcgactcgaggactattagactaacttaatttaaagttggtatcagacgaagaaaccgacgggaaactaccccctaacctccgtagactacgtacgatcgactactaccgtaagttaggaaacggtcgggtacctaagtacgtaagtacgaggtaggaagtggatcgtagggttacttactttactcactatacatacctacgcgacgacgtcgtaggtagtatactacgaactaatacttaacttactagtaacctaattaatatacgtaaacttaaccgttaccctaaccgtaccttacgttacggttccggggaacggtaccgggtacgtacgggtaggaacgtaactaaccgaaacgtacgtggtcgaccgtgacctactacttacttcgtnttccttacccg

SEQ ID NO: 77507 - DNA, 709 bp, Homo sapiens
  misc_feature: GYAE6OF01A9IE7.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctcctgtctgcatctgtaggagacagaatcaccatcacttgccaggcgactcgaaggactattacgactaacttaatttaaagttggtactcgaagacgaagaaacccgaagggtaaaccgaccccctaaacctccgtagtactccgtacgatcgactactacctaagtttacggaaagtacggggtaccctagtacgtaaggttacgtaacggtaggtaagtcggtagttacgttagggttacgtttacttttacgttacccgtactacgttacctacttaccgtaacctcgaccgtacgtaccgtaggtaaggtaacttacttacgaactaactagtttacttacgtagtaacaaactaacttataagtacttaaactccttaacgacctttacgtaacggtttacgggaccgggtaacggacccggtaagggtacgggtaacgtaaacgttaccgaaaaccgggttagtacgggttacggtaccgttaaccggacccgtaccttacgttaaccgttcgtttaactttccccgttaaccccg

SEQ ID NO: 77508 - DNA, 737 bp, Homo sapiens
  misc_feature: GYAE6OF01A1FL8.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctcctgtctgcatctgtaggagacagaatcacatcactgccaggcgactcaggacatacgactaacttaatttaaagttggtatcagacaagaaaccgaaggaaaccgacccctaaccgtcctaggtactaccgttacgacgttacgactaacgtacctaaagtttagggtaaacgtaccggggttacccaacgttacgtaaacggttccgtaaggtagggtaagtacggtacgttacggttacggggttaaccgttttacgtttttaacctttaccctaaccgtaataccctaacttacctaacccgtgtaccgtacgtaccgtaggaacgggttaattacgttacgtaacgtaaacttaacttaacgttaaccgttagtaaaccaaacgttaaacttaattaacgtaaatttaaacctacctttaaccctaaccgtttaccgtaaccggttttaccgggaaccggggtacgggaacccggtaacgggttacggaagtaacctaaccggaaacggttaacgtgggtacgacgtaccgactaacccgtataccgttcgttcttacgtacccg

SEQ ID NO: 77509 - DNA, 850 bp, Homo sapiens
  misc_feature: GYAE6OF01EDLOE.49.81.H04.1.454.CMB.1.raw
  modified_base (189)..(189): a, c, t, g, unknown or other
  misc_feature (189)..(189): n is a, c, g, or t
  modified_base (271)..(271): a, c, t, g, unknown or other
  misc_feature (271)..(271): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatcgacccagtctccatcctccctgtctgcatctgtagganacagaatcaccatcattcgcaggcactcaggactatacgactaactaatttaatggtatacagacaagaaaccgaggaaacncccctaactcgtacgtaactcgtaacgatacgacacttaccgtaatttagggaaaacgttccgggtaaccctaagtaccgtaaggttttaccgaaggttagggtaaaggttcgggtaaacgttaccgggtacggggtttaaaccgtttttaacgttttttaacccgtttaccccgtaaacccgttaagtttaacccgtaaacgtttaacccccttaaaccgggtttacggaccccccgttaaacggttacccgggttaagggttaaccggggttaatttaaaccgtttaacgggtaaccctaaaacttaaacgtttttaaaccttaacggtttaacgtaaacccgttaaaaattaaacgtttaaaccgtttaaggaaaaccttttaacttaaccccgttaaaccctaccgtttaaaccccgttacgtttaaccgggggaacccgggtaacccggggtaaaccgttaacgggggtaaggtacgaaaccgtttaaacggaaaaccggttagtacgggttccggacgttaccgacccgttaacccaagtttacctttacgggttacctttcccgtaacccgg

SEQ ID NO: 77510 - DNA, 748 bp, Homo sapiens
  misc_feature: GYAE6OF01DK1WK.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctgcggccccaggacagaaagtcaccatctcctgctctggaagcagctccaaacattgggaaagtaattatgtatcgtggtaccagcagttcccaggaaccggccccagactcctcattcatgaacaataaacaagcgagtcccagagattcctagaccgtattctactggctccaagtctggccacctcacgcccaccgtcggccatccgacccggactccaaggacgtggggaaccgagggaccgtaatttacgtaacgtggaccggtaaactagtacggggtactttacccgagtccgttaggtaggttcggttcggttcggtaagggggtttcgggtttccggggacggggtaaccgggggaaccgtaaacgggtccgttaccgggtaaccccgggtttaccgttacggggttaccccgtacgggaacccccgtaaagggggtccccgttacccgggggtacccccccgtttacgggggttccccttaaacccgtttcccggttttaccccggtttacccccccccgttaacccccgtttcccccttacccgttttcccccgttacccgttccccggttaaacccgg

SEQ ID NO: 77511 - DNA, 667 bp, Homo sapiens
  misc_feature: GYAE6OF01DRP8W.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctaccaacattgggaaagaattatgtatcggtggtaccagctacgttcccaaggaaccggcccccaagacctcctcattcatgaacaaataacaagcgagtcccaagagattccagaccgattctctggctccaagtcgtgccacctcacgccaccctcgccatccacccggactccgagtacgtggggacgacggactattagtacgtgacggaactagtcgggtaacttcccgaagtccgtaggtacgtgggtcgtacgtaggggttcggttccgggacggggtaacgggaaccgtaaggtccgtacgggtacccggttcccgtaagggtccaacggaccccgaaagggtccctacccggggtcccccgttacggggtccctaacccgttcccggtttcccggtttacccccccgtccccgtttcccctcccgtttacccgttcccgttccccggttaaccgg

SEQ ID NO: 77512 - DNA, 568 bp, Homo sapiens
  misc_feature: GYAE6OF01BNH3Z.49.81.H04.1.454.CMB.1.raw
  modified_base (188)..(188): a, c, t, g, unknown or other
  misc_feature (188)..(188): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtagganacagaatcaccatcacttgcccaggcgactcaggacattagcaactatttaaatggtatcagcagaaaccagggaaacgcccctaacctcctgatcacgatgcatccaatttggaaatagggtcctatcaaggttcagtggaagtggatcgtgggtacttatttacttcacctatcatcaacctgacagcctggagtatattgactaatattattactgtacaactaatatagtaataatcctaacctactactaccgtttcgggacgggtacggtaaccgacgggtacggacgtaagtaaccgaaaacggtacgttacggttcgggtaccgttacggaccctacccgtaagttcccgttcgttacccgtttcgtacccg

SEQ ID NO: 77513 - DNA, 774 bp, Homo sapiens
  misc_feature: GYAE6OF01EC8BK.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggcccaggacagaaagtcacatctcctgctctggaagcagctccaacagttgggaagaattatgtatcgtaggtaccagcagttcccgaaggaaccggccccagacctcctcattcatgaacaataacaagcgagtcccaagagtacttccgtacgaccgtattctcgtcggctccaagtctcggccacctcacgcccaccgtcggacccacgtaccaccgggacctccgaacggtaacggtcgggggaacggacgggtacccgtaattttaacgttaccgtacggaacgggtaaaacctggttacggggtaacttacccgaacgtcccgttaggtacggtttgggttacggtacggttaaggggggtttcgggttaccgggggaacggggtaacggggtaacccgaagggtcccggttacgggtaaccccggttaccggtacgggtacccgtaacgggacccccgtaaacggggtccccgttacccggggtacccccgtttacccggggttacccgtaacccgttcccgtttacccccgggttaacccccccttaccccccggtttcccctttaccccgtttacccgttccccggtccccgtttaaccccggg

SEQ ID NO: 77514 - DNA, 603 bp, Homo sapiens
  misc_feature: GYAE6OF01B3HHB.49.81.H04.1.454.CMB.1.raw
  modified_base (306)..(306): a, c, t, g, unknown or other
  misc_feature (306)..(306): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggcccaggacagaaagtcaccatctcctgctctggaagcagctccaacattgggaaataattatgtatcgtggtaccagcagttcccaggaaccgccccagactcctcattcatgaacaataacaagcgagtcccagacgattccngaaccgtattcctcgtggctccaagtctggcacctcacgcccacccgtggccatcaccgactccagacgtaggggacaggccgtattactacgtggacggaaactagtgggacttaccgagtccgtaggagtcgggtgtacgaggggttgttcgggcggaagggtaccgaagtccgtacggacccgttcgtaggtccaacggtcccgaaggtcccgtcgggtccccccttagggtaccctacttccgttacccggttcccccgtaccccttccgtaccctccttccgtccgtacccg

SEQ ID NO: 77515 - DNA, 762 bp, Homo sapiens
  misc_feature: GYAE6OF01BCYFI.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagcctccaaacagttgggaaagaatttatgtatcggtggtaccagcacgttcccaggaccgccccagacctcctcattcatgaacaataacaagcgacgtcccagagtacttccctaggaccgtatttcctcgtcgggacccttaccgaaacgttcgtacgggaccctaacccgtccaccgtacccctaaccccgtcgggacccctaacgtacccgaaccccgggtaccctacccgaacggtaacccggtaggggggaaccggacggggtacccgttaagtttaacgttaaccgtacgggtaaccgggtaaacgtaggtacggggtaacctttccggaacgtccgttacggtaaggttcggtacgttccggtaagggggtttcggttaccgggggacgggtaacgggaaccgtaaggtccggttacggtacccgttacgtacgggtccaaccggtacccgtaacgggtcccgtaccgggtcccccgttcggacccgttacgttcccgttaccgttccccccctacccgttccccttaccttcccgttccgttccggtacccg

SEQ ID NO: 77516 - DNA, 586 bp, Homo sapiens
  misc_feature: GYAE6OF01AK8ER.49.81.H04.1.454.CMB.1.raw
  modified_base (189)..(189): a, c, t, g, unknown or other
  misc_feature (189)..(189): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatccctccctgtctgcatctgtagganacagaatcaccatcacttgccaggcactcaggacattagcaacttatttaaattggtatcagacaagaaaccagggaacgcccctaacctcctagatctacgatgcatacctaagtttaggaaacgtacggggtaccctagtaccgtaaggttcgaggtggaagttggatcgtgggtacgttagttttacttcacctatctataccaacctgactacgcctaggagtatagtcgactaactattaacttactacgtactaactaattatagtaataactacctaacctacttaccttacgttccgggacggtacggtaccgacgggtaggacgtaacgtaaccgaaacgtacgtggtcgaccgtagacctaacctacttacctgttccttcgtaccc

SEQ ID NO: 77517 - DNA, 702 bp, Homo sapiens
  misc_feature: GYAE6OF01C27ZZ.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctgcggccccaggacagaaagtcaccatctcctgctctggaagcagctccaacattgggaagaattatgtatcgtggtaccagcacgttcccaggaacggcccccagacctcctcattcatgacaataacaagcgagtcccagagattcctgaccgtattctactggctccaagtctggcacctcacgcccaccctgccatccaccggactccaggacgtggggacgacggccgtaattacttacgtaggaccggaaactgtagggtaactttcccgacggtacccgtggtaacggttggggttcggttaccggaaggggggtttccgggtttacgggggaacccggggtaacggggggtaaaccccaaacgggtccgttacgggtaaccccggtttcccggtacgggtaccgtaaccgggacccccggtaaacggggcccgttacccggggccccccgttagggttacccctaaccggttccccgtttccggttcccccggtccccttccccgttcctttacccgtcccgttcccggtaccccg

SEQ ID NO: 77518 - DNA, 771 bp, Homo sapiens
  misc_feature: GYAE6OF01BQG8D.49.81.H04.1.454.CMB.1.raw
  modified_base (188)..(188): a, c, t, g, unknown or other
  misc_feature (188)..(188): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtagganacagaatcaccatcacttgccaggccgactcaggactagttacgactaacttaatttaaagttggtaatcaagacaaacgaaaaccgaaggggaaacctaccccctaaacctccgtagtacttaccgtacgactcgactaacgttaccgtaaagtttacgggaaaagttaccggggtaccctaagttacggtaacggttacgtaagggtagggtaaagtgggtacgttacggttagggggttaaaccttttaacgttttttaaccgtttaccaacccgttaacttacctaacgtttaacccgtaaccgttcggaacccgtaacggttcccgttaagggtaacgggttaactttaacggttacaaaccgtaaaactttaagtttaaccgtttaacgttaccgtaaactaaactaagtttaatagtaaacttaccttaacctaacccttacgttaccgttacggtttacccgggaagggtaaccgggtacccggtacgggtaaggaacgtaacgtaaaccgaaacgtaacgttcgggtcgtactacgaccctacgttacttacgttccttaccgttactaccccg

SEQ ID NO: 77519 - DNA, 590 bp, Homo sapiens
  misc_feature: GYAE6OF01C9DKS.49.81.H04.1.454.CMB.1.raw
  modified_base (274)..(274): a, c, t, g, unknown or other
  misc_feature (274)..(274): n is a, c, g, or t
  modified_base (401)..(401): a, c, t, g, unknown or other
  misc_feature (401)..(401): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagactaaacttatttaaattggtatcagacaagaaaccaagggaaacnccccctaacctcctagactactacgatgacattacctaagttttagggaaagtacggggtacccaagtacgtaaggttcaggtaggaagtggatcgtgggtacttattttacttcacatcatcactncacgctagagattatagacaactatattactgtaacaaataatatacgaattaactacctaacctactctacgtttcgggacgggtacgggacccgtaagggtggaacgtaactaaccgaaaaccggtagtggtaccggacttacggaccctaacccgtattcccgttacggttcctttccgtaacccg

SEQ ID NO: 77520 - DNA, 534 bp, Homo sapiens
  misc_feature: GYAE6OF01C86GX.49.81.H04.1.454.CMB.1.raw
  modified_base (390)..(390): a, c, t, g, unknown or other
  misc_feature (390)..(390): n is a, c, g, or t
  modified_base (433)..(433): a, c, t, g, unknown or other
  misc_feature (433)..(433): n is a, c, g, or t
  modified_base (484)..(484): a, c, t, g, unknown or other
  misc_feature (484)..(484): n is a, c, g, or t
  modified_base (518)..(518): a, c, t, g, unknown or other
  misc_feature (518)..(518): n is a, c, g, or t
tcagagtcgagagacacgaccggtgctcgatttagtagtgtagattcgcgggggagtcccaaccaggacacagcatggacatgagggtccctgctcagctcctgggggctcctgctgctctggctctcaggtgccagatgtgacatccggatgacccagtctccatcctccctgtctgcatctgtaggagacagaatcacatcacttgccaggcactcaggacattagacaaactatttaaattggtaatcagcaagaaaccagggaaacgcccctaacctcctagatctacgaatgcataccaatttaggaaataggggtcccaatcaagttcagtaggaagtaggatcgtagggtacgtagttttacttcactatactatacacctancagcctagagatatagacactatattactgacaactaatatanataatctaacctactctactttcggacggagggaccacgggtaggacgtanacgaaaacgtaatggtcggacgtgacacctattntcgttcttcgtaaccg

SEQ ID NO: 77521 - DNA, 685 bp, Homo sapiens
  misc_feature: GYAE6OF01EVZUI.49.81.H04.1.454.CMB.1.raw
  modified_base (219)..(219): a, c, t, g, unknown or other
  misc_feature (219)..(219): n is a, c, g, or t
tcagagtcgagagacacgaccggtgctcgatttagtagtgtagattcgcgggggggacaatcttcatcatgacctgctcccctctcctcctcacccttctcattcactgcacaggtcctgggcccagtctgtgttgacgcagccgccctcagtgtctgcggccccaggacagaaagtcaccatctcctgctctggaagcagcctccaacagttgggaanaattatgtatcgtggtaccagcagttcccaggaaccggcccccagacctcctcattcatgaacaaataacaagcgagtcccagagtacttccgtcggaaccgtatttcctcgtgggcctaccgtaaagtccgttaggcctaaccctcgacgccccacccgtggacccatcccgaacccggacctacccgacggaccgtacggggaccgacgggcccgtaatttacgtacgtgacggaacaggtcgggtacttacccgagtccgtaggagttgggtacgtacggtaggggttcggttcgggcgggtaacgggaccctaagggtccgtacggtacccgttccgtaacgggttccgaacggacccgtaaacgggtccgtacccgggtacccccgttggtacccgtaccgttcccgtaccggttacccccctacccgttccccttaccttccccttccgtaccgtacccg

SEQ ID NO: 77522 - DNA, 733 bp, Homo sapiens
  misc_feature: GYAE6OF01C2BPB.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctaggaagcagctccaacagttagggaagaattatgtatcggttggtaccagcacgttccccgagggaaaccggcccccaagacctcctcattcatgaacaaataaacaagcgacgtacccaagacgtacttccctagaccgtattcctacgttggaccctccaacggttctcgggaccaccctacgaaccgcccctaccccgtcggacccctacgtcccaacccgggacccttcccgaacggaaccggttggggggaacccggacggggtaacccgtaacgtttacgttaaccgtcggaaccggtaaacgtaggttacggggtaacttcccgaacggtcccgtagggaggttcggtcggttacggtagggggtttcgggtttcggggaccggggtaacggggaaccgtaagggtccgtacggacccgttaccggtaggtaccgacgtacccgacgggtcctacggcccccgttaggtcccttaccgtccgtttacccgtccccctaccccttccttacccttccgtccgttccgtacccg

SEQ ID NO: 77523 - DNA, 654 bp, Homo sapiens
  misc_feature: GYAE6OF01BHWKK.49.81.H04.1.454.CMB.1.raw
  modified_base (449)..(449): a, c, t, g, unknown or other
  misc_feature (449)..(449): n is a, c, g, or t
tcagagtcgagagacacgaccggtgctcgatttagtagtgtagattcgcgggggggacaatcttcatcatgacctgctcccctctcctcctcacccttctcattcactgcacaggtcctgggcccagtctgtgttgacgcagccgccctcagtgtctgcggccccaggacagaaagtcacatctcctgctctggaagcagcctaccaactagttgggaaagaatttatgtatcggtaggtaccagctagttcccgaaggaacccgcccccagcctcctcattcatagaacaataacaagcgacgtacccagacgtacttccgtacgaccgtattcctcgtcggtcctccaacgtcgtcggccacctcgacgcccacccgtgccacgtccgaccggactccgacgaccggcggggacgacggccgtaatttacgtacgtcgacgtaacgngtacgggtacttccgagtccctggtaggtcggtcgtcgtaggggttcggttaccggggcggaagggaccgagggtcctggtaacccgtccggtacggtaccgaacggtcccgaacgggtccgtccccgggtcccgttacgggtcctacccgttccgtaccccgttcccccgtcccttcccgttcccttcctccgttcccgtaacg

SEQ ID NO: 77524 - DNA, 866 bp, Homo sapiens
  misc_feature: GYAE6OF01APCY5.49.81.H04.1.454.CMB.1.raw
  modified_base (171)..(171): a, c, t, g, unknown or other
  misc_feature (171)..(171): n is a, c, g, or t
  modified_base (227)..(227): a, c, t, g, unknown or other
  misc_feature (227)..(227): n is a, c, g, or t
  modified_base (852)..(852): a, c, t, g, unknown or other
  misc_feature (852)..(852): n is a, c, g, or t
tcagagtcgagagacacgaccggtgctcgatttagtagtgtagattcgcgggggggactaaggtctttcactcgatcgacctgctcccctctccttcccgtcacccttgtcattcacttgacactagggtccctgggcccccagttctgtgttgacgcagtcccgtccgtnagtgtcctcgaccggcccaggtcacggaacgtcacactctccgttggccttttcgnggaagtcagcctaccgaatcgttagggaaactaatttaccgtagttactcgggtagttacccctaggtcctacgttaccccgaggtaaccggacccccaggtaccgtccctccattccagtcgacaacgtaacaaggtcggtacgtcccgaagacgtactttcccgtacgtaccgtactttacccgtctccgggtacctacccgtaaacggttccgtaccgggtacccacccgtaccgtaaccgggtacccctaaccccgttcgggaccccctaacgtttacccggtaacccccgggtacctaccccgtaaacggtaccggtttaccgggggtaaccgtttaaccggggtacccctttaagtttacggtttaaccggtaccggtacggggtaaacctaacggttcggggtaaccgtttaccgaacggtaacccggttaagggtaaccggtttggggtaccgttaccgggttacggggttaccgggttacccgggtacggggttaaccgggtaacccggtacgttcccggtacgttacccggttacccgtacggtacctaccggtacgtaccgtccgtacgtccccgttaggtccacgttcccgtcgttccccgtacctccgtacnccttacgcggttcc

SEQ ID NO: 77525 - DNA, 840 bp, Homo sapiens
  misc_feature: GYAE6OF01EV109.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctggccggcccaggacaagaaagtcaccatcctcctgcctcgtggaacgcagcctaccaaactagttagggaaataatttatggttatcggtacggtaccagctacgttcccgaacggaacccggcccccagtaccttccctactacttcaagtacgaaactaaacgtaaacaacggccggaacgttacccaaggtacgtacctttccgtacggaacccttactttccttacgtcggtaccttaccgtaacgttccgttacggacctaacccgtaccgaaccgcccccgtaccccgtggtcccctaacgttaccccgaacccggggtaccctacccggaaaccggggtacggttaccggggggaaccgtaaccggggttacccgttaattttaaaccggtaccgtacgggtaaccggtaaacgttacggtacgggttaacctttacccgacggttcccgtaggttaacggttcgggtttacgtacggggttacggggttacgggttaccgggggacggggtaaccgggtacgtaacgggtccgttaccgggttaacccgttcggtaaccggtacgacccggaccggtacggtcccggtaccccggtaccccgttggaccgttccgtccccggttcccgttccccccgtcccgtttacccttcggttcccctttcgccgttaccg

SEQ ID NO: 77526 - DNA, 903 bp, Homo sapiens
  misc_feature: GYAE6OF01D3GTE.49.81.H04.1.454.CMB.1.raw
  modified_base (157)..(157): a, c, t, g, unknown or other
  misc_feature (157)..(157): n is a, c, g, or t
  modified_base (203)..(203): a, c, t, g, unknown or other
  misc_feature (203)..(203): n is a, c, g, or t
tcagagtcgagagacacgaccggtgctcgatttagtagtgtagattcgcgggggggacaatcttcatcatgacctgctcccctctcctcctcacccttctcagttccactcgcacgacgggtcctgggcccagtctgtgttgacgcacgcccgcctnagtgtctgcgcccaggacagaatcaccatcctcctgtctctggacncacgcctaccaagtagttaggggaaactaagtttatacgttactacggttacggtacccacggtacccgtacgttaccccggaacgggaaacccggccccctaaagtacccttacccttacttaactttaccgaagttacgaaacctaaaacgtaaaccgaaacggaacccggtaaaccggttaaccccggaaaggtaaccggttaactttacccgtacgggtaaacccttacttttaccgttccgtaaggttaccccttaaccgtaaacggtttacccgttaaccgggtaacccgtaacccgttaccggaacccgtacccccgtaaaccccggttacgggtaacccctaacggttacccggaaaccccgggtaccgtacccggtaaaccggtaacggggttaccgggggtaaaccggttaccggggtttaacccgtaacgttttaaaccgttaccggtacggtaaaccgggtaaacccgttagggtaccgggtaaccttacccggacgttaccgtaggtaacgtttggttaccgtacgggtacgggttacgggtacgggacggttaacggaaccgtacgtcgtaccgtaccgtaccgttacggtacctaccggtaccgtaccgggtacccgtccgggtacccggttacggtactccgttacgtacccgttaccctaccgtccttctacgtcctccgtac

SEQ ID NO: 77527 - DNA, 532 bp, Homo sapiens
  misc_feature: GYAE6OF01B7B6J.49.81.H04.1.454.CMB.1.raw
  modified_base (334)..(334): a, c, t, g, unknown or other
  misc_feature (334)..(334): n is a, c, g, or t
  modified_base (505)..(505): a, c, t, g, unknown or other
  misc_feature (505)..(505): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaaggaccgccccagactcctcattcatgacaataacaagcgagtccccagacgattcctgaccgattctctggctccaagtctggcncctcacgccaccctggccatccaccggactccgagtacgtggggacgacgggccgattacttacgtggacggaaacagtgggacttccagtctgaggtgtgtcgtagggtcgttcgggcggagggaccaagtcgtcgaccgtcaggtcacgcccgagcgtcggccctgtcnctcgtcctcccacctctcnctcncgtc

SEQ ID NO: 77528 - DNA, 771 bp, Homo sapiens
  misc_feature: GYAE6OF01D6UFY.49.81.H04.1.454.CMB.1.raw
tcagagtcgagagacacgaccggtgctcgatttagtagtgtagattcgcggggagtcccaaccaggacacagcatggacatgagggtccctgctcagctccgtggggctcctgctgctctggctctcaggtcgccagatgtgacagtccggatcgacccagtcctcccacttccctccctgtcctgctattcgtggtaggaagacaagtaactaccaaccatccgtacgtcgccgaggaccgtacgtacgggactagttacgaacttaaactttagttttaaagttggtaactacgaacgtaacgaaacggaaaaccgacgggaaaccctaccccgtaactcgtaacgactacgtacggtactacgacttaaccgtaacgttaaacggttaacgggtaaacggttacccgggtaacctaagttaaccggttaacgggtaagtaagggtacggaaggttgtacgttacggtaggttacgttttactttacgtactacagttaccacgtacacgttcgacgtgtacgtagtattagtacgtacgaactaacttagttaacgtacgttaacaaactaacgtaatttacgtaattaactaaccgttctaacccttacgtaccggttacgggtacccgggaagggttaaccggaccggtaacggttaggaaccttaaaccggtaaaacgtaacccgggtaaggttggaacccggttcgtaccaacgttaccgttaccgttctttaccgttaccgttaacttccccgttaacccccg

SEQ ID NO: 77529 - DNA, 719 bp, Homo sapiens
  misc_feature: GYAE6OF01COFH6.49.81.H04.1.454.CMB.1.raw
  modified_base (697)..(697): a, c, t, g, unknown or other
  misc_feature (697)..(697): n is a, c, g, or t
tcagagtcgagagacacgaccggtgctcgatttagtagtgtagattcgcgggggggacaatcttcatcatgacctgctcccctctcctcctccacccttctcattcactgcacagggtcctgggcccagtctgtgttgacgcacgccgccctcagtgtctgccggcccaggacagaacgtcaccatctcctgctcgtaggaagcgacgcctaccaaatagttaggggaaataatttatagttatcggtacgtaaccagcgtacgttacccgaaggaaccccggaccccctaagtacccttcctactactttaccgaattacgaaaactaaactaaaccggaacggaccgtaaccgtacccgaggtaaccgtactttacccggacgtaaccgttcttcgtcgtcggtacctacgtaacgtccgtggaccctactaccgaccgccctacccgtcgacctacgtacccgaccgtacctacgacgtacgggacgggacgtacggaccgttattacgttacgacggacggtaaacgtggtacggtaccttcggagtccggtaggtagttcggtaacggtcgggtaagggtttcgggcccggggagaaccgggtacgaacggttccgaccggttaccgtcgtacggacctaccgaccgtaggtcccgaccggtcccgttcgaccttcctccggtcccttcccncccttactcgcctcgtctaccg

SEQ ID NO: 77530 - DNA, 778 bp, Homo sapiens
  misc_feature: GYAE6OF01D9LR5.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctgccggccccaggacagaaagtcaccatctcctgctctggagcagctccaactattgggaagtaattatgtatcggtgtaccagctacgttcccaggaaccgccccagacctcctctattcatagaacaaataaacaagccgacgtacccagactacttccgtagaccgtatttctcgtcggtcctaccgtaagttctcggaccacctcgaaccgccccacccgtcggaccctactcccgacccgtaccctccgaaggacggtacggggacgacgggtcctaatttacgtaccgtggaccggtaaacaggtcgggtaccttccgaacggtccgtaggtagtttcgggtgtaccgggttaggggttcggttaaccggggggaccggggaacgggtaaccccgtaagggtacccggtttacgggaacccccgtttaccggggtaaccgggttcccgtaaccggacccccgggttaaacgggtccccgggttacccccgggttccccccgggttacccgggtttaccgacccgttttccccgggtttacccccggtttacccccccccgtccccgtttccccctttaccgtttcccccgttcccgtttcccgggtaaaccccg

SEQ ID NO: 77531 - DNA, 684 bp, Homo sapiens
  misc_feature: GYAE6OF01AD0T8.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggcccaggacagaaagtcaccatctcctgctctggaagcagcctccaactagttgggaagaattatgtatcgtggtaccagcagttcccgaggaaccgcccccagacctcctcattcatgacaataacaagcgagtcccagagtacttcctgaccgtattctcgtggcctaccaagtcgtcggccacctcacgcccacccgtcggccacgtccgacccggtacctaccgacggaccggtcgggggacgacgggtaccgtaagtttacgttacgtggaccggaaactaggtcgggtactttacccgagtccgtaggacggtggtacgttcggtaggggttcgggttccggggacggggtaaccgggtaccgaacgggtcgttaccgggtacccgtccggtacggtaccgaccggacccgtaaccgggtccgtcccgggtcccccgttccgggacctcccgtttcccgttccccgttacccccgtacccccgtttcccttaccttcccttccgttcccggtacccg

SEQ ID NO: 77532 - DNA, 534 bp, Homo sapiens
  misc_feature: GYAE6OF01ATG9U.49.81.H04.1.454.CMB.1.raw
  modified_base (399)..(399): a, c, t, g, unknown or other
  misc_feature (399)..(399): n is a, c, g, or t
  modified_base (445)..(445): a, c, t, g, unknown or other
  misc_feature (445)..(445): n is a, c, g, or t
  modified_base (487)..(487): a, c, t, g, unknown or other
  misc_feature (487)..(487): n is a, c, g, or t
  modified_base (509)..(509): a, c, t, g, unknown or other
  misc_feature (509)..(509): n is a, c, g, or t
  modified_base (528)..(528): a, c, t, g, unknown or other
  misc_feature (528)..(528): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcgaggacattagcaacttatttaaatggtatcagcaagaaaccagggaaacgcccctaactcctagactctacgatgcactacctaatttgggaaatacggggtccccaattacgaaggtttcgaggtaggaagtggattcgtagggtacgttattttactttcactaatcactcaaccggnagtcctagagtatattgacaatatattactagtaccaataatatanataatcctaacacttactacgttcggacggagggaccagggngacgagtacaaacgatgcggcngaccactctctgtcttctnttcccg

SEQ ID NO: 77533 - DNA, 707 bp, Homo sapiens
  misc_feature: GYAE6OF01B7Z5C.49.81.H04.1.454.CMB.1.raw
  modified_base (197)..(197): a, c, t, g, unknown or other
  misc_feature (197)..(197): n is a, c, g, or t
tcagagtcgagagacacgaccggtgctcgatttagtagtgtagattcgcggggggacaatcttcatcatgacctgctccctctcctcctcacccttctcattcactgcacaggtcctgggcccagtctgtgttgacgcagccgccctcagtgtctgccggcccaggacagaaagtcaccatctcctgctcgtggaancagctaccaacgagtttaggggaataattagtgtatcggtggtaccagctagttcccaaggaccgccccagactcctcattcatacgacaataacaagccgagtccagtagacttcacgaccgtattcgtactggaccttcaacgtcttcggacctaaccgtcgacgccctaacccggtcggaccccaagttccgaaacccggtaccttaccgaacggacggtacgggggaacccgacggtacccggtaatttacgttaccgtacggaccgggtaaactacggtacggaactttaccgaccgtaccgtggtaaggtcggtaggtaccgtaggggtttaccggttacgggacgggtaacgggtaaccgaacgtccgtacggtacccgtacgtaggtacccgtaacggcccgtaaacggtccgtaccggtcccccgttggtaccctacgttccgttaccccgtttacccctaccccgttacccttccgttacccgttccgttcgtaccccgg

SEQ ID NO: 77534 - DNA, 624 bp, Homo sapiens
  misc_feature: GYAE6OF01AY7KR.49.81.H04.1.454.CMB.1.raw
  modified_base (454)..(454): a, c, t, g, unknown or other
  misc_feature (454)..(454): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgtggccccaggacagaaagtcaccatctcctgctctggaagcagctaccaacattgggaagaattatgtatcgtggtaccagcagttcccaggaccggcccccagacctcctcattcatagaacaataacaagcgaacgtcccagagtacttcctcgaccgtactttcctcgtcggtcctacccgaagttccgtacgggccaccctcaccgcccaccccgtcggcccacgtccaacccggacctaccgaggacggtggggaacggacggaccgtattacttacgtcgacggtaaanagtgggtacttccgacgtccgtgtacgttgggtcgtcggtaggggttcggtcgggacgggaacgggaccgaacgtcgtacgaccgttacgtacggtcgaccgccgagccgtccggccccgtcggtctccgtccgttccgtcccctaccttccctactcctcgtccgtacg

SEQ ID NO: 77535 - DNA, 840 bp, Homo sapiens
  misc_feature: GYAE6OF01D8NI4.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggcccaggacagaaagtcaccatctcctgctctggaagcagctccaacagttgggaaataattatgtatcggtggtaccagcacgttcccgaggaaccgccccagacctcctcattcatgaacaataacaagcgacgtcccaagagtacttccgagaccgtatttcctcgttacggccttaccgtaaaggttccgttcgggaccctaaccctccgaaccgcccctaaccccgttcggaccctacgtacccgaacccgggtacctacccgaacggaccggttaggggggaaccgtaccgggaccggttaacttttaacgttaaccggtcggaacccgggtaaaacgtaggttacgggggtaaactttacccggacggtacccggtttagggtaacggtttcggggttacgggttcggttaacggggggtttccgggttttaccggggggaaccggggtaacgggggtaaccccgtaaaggggttcccgttaaccgggtaaccccgggtttcccggtaacgggttcccggaaaccggacccccggtaaaggggtccccggttacccgggtccccccggtttaccgggttccccgtaaccccgtttcccggttccccggtttaacccccccctccccgtttacccccgttccgtttccccgtttcccgtcccgttaaccccgg

SEQ ID NO: 77536 - DNA, 672 bp, Homo sapiens
  misc_feature: GYAE6OF01BJOBO.49.81.H04.1.454.CMB.1.raw
tcagagtcgagagacacgaccggtgctcgatttagtagtgtagattcgcgggggggacaatcttcatcatgacctgctcccctctcctcctcacccttctcaggttcactgcacagggtcctgggcccagtctgtgttgacgcagcccgccctcagtgtctgccggcccaggacagaaagtcaccatcctcctgctcgtggaagcagcctacaaactagttagggaaataattatggtaatcggtagtaccagtctagtcccgaagggacccgccccagtacctcctactattcatacgaaacaaataaccgaagccgaacgtacccaagacgtactttccgaggtacctattcctcgtggacctaccgtaagtccgtacggacctacccgtacgaccgccctaacccgtggacctacgtacccgaacccggtactacccgaaggtacccggaggggaaccgacgggtacccgttaattacgtacgtagggaaccgaataacggtagggaccttacgacgccgtaggtacggtggtcgtaggtagggtcgtacgggacggaggtacgaacgtcgtacgaccgttcgaggtccgaagtccgaggtcgtcccgggcccgttgaacctccgtccttccgtaccccctaccgtccttactccgtcccgtagtaccg

SEQ ID NO: 77537 - DNA, 840 bp, Homo sapiens
  misc_feature: GYAE6OF01CYWTE.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtcgccagatgtgacatccggatgacccagtctccatcatccctgtctgcatctggtaggagacagaatcaccatcacttgccaggcactcgaggactagttagactaacttaatttaagtggtactacaagaccaaggaaaaccgagggaacctaccccctaactcctcgaacttactacggatacggactaacttacccgtaaagttttacggggaaaacgttacggggtaccccaagttaccgtaaacggggtttcgaagggttaagggtaaaggttagggtacgtttaccgttaacgggggttaacgtttttaacgtttttacctttttaaccgaaccccttaattaccgtaacgtttaccctaaaaccgttcgggtaaccctaacggtacccggttaagggaaacgggtttaactttaacggttacggtaacctaaaccgttaaagtttaacctttaaccgttaacggttaaccctaaaacgttaacgttaaagttacgttaaaacttaaaccctttaaccgttaacccttaaaccgttcccggttaaaccggttttacccgggggaccgggtaaaccgggggttaaccccgtaacgggggtagggaacgttaaccgaaacccggtaaaacgtaacccggtttgggttacccggactttacggaccccttaactacgttttcccgttacggtttaccctttaacccg

SEQ ID NO: 77538 - DNA, 640 bp, Homo sapiens
  misc_feature: GYAE6OF01DHYD7.49.81.H04.1.454.CMB.1.raw
  modified_base (193)..(193): a, c, t, g, unknown or other
  misc_feature (193)..(193): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatcgacccagtcctccactccctccctgtctgctatctgtagganacagaactcaccatctactgccgaggcactcgagactatagactaacttatttaagttgtatcagacaagaaaccgaacggaaacctacccctaacctctacgtactactacgatcgactacttacctaagttaggaacgtacgggtaccctagtacgtaagtcgaggtaggaagtagtacgtcggtacggttacgtttactttacttcctaacctattacctaactacctaccgtgtaccgacgtaccgtagtaagtaattagttacgaactaacgttacttacgttaacttacgtaacaacgttaattaacgtagtaacttaacttacctaacctaccgtaccgttacggttacgggacggtacggacgtacggtacggtaacgacgtaacgtaacgtacgtacggtcgtacgtacgacctactacttctcgttcttactacccg

SEQ ID NO: 77539 - DNA, 589 bp, Homo sapiens
  misc_feature: GYAE6OF01DX3W3.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaacttatttaaatgtatcagcaagaaaccagggaaacgcccctaacctcctagatctacgatgcataccaatttaggaaatacgggtaccatacgtaaggttcagtggaagtggatcgtaggtacgttatttacttcactatcatcaactgacagcctagagtattatagacaactattattaacgttagtaccaaacgtattaatagtaattaacgttaccttaacctaaccttacttacccggttttaccgggacggtaccggggaaccgtaccgggtaggaacgtaactaccggaaaaccgtagtagggtcgaccgttagacccgtaacctacttacctttcgttccttcgtacccg

SEQ ID NO: 77540 - DNA, 707 bp, Homo sapiens
  misc_feature: GYAE6OF01BL20M.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctaccaacattagggaagaattatgtatcgtgtaccagcagttccaggaccggccccagacctcctacattcatgaacaataacaagcgacgtcccaagacgtacttccgtgaccgtattacctcgttcggactaccgaacgtctcggacctacctcaccgcccaccccgtcggaccctactccgaacccggtacctacccgaacggaccggtacggggaccgacgggtacccgtaagtttaacgttacgtcggtaaccggtaaactaaggttcggggtaacttcccgagtcccgtaggtacggttacgggtggtccggtagggggttcggttaccggggacgggtaacggggaccgtaacgggtccgtaccggtacccgttaccgttacggccgaaccggcccgaaagggtcccgtaccgggtcccccgttacgggtccgtaaccgttcccgttccccgttacccctaccccgtttcctccctttcccgttccgtccgttaccg

SEQ ID NO: 77541 - DNA, 836 bp, Homo sapiens
  misc_feature: GYAE6OF01BPLJ8.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgcctcagtgtctgcggcccaggacagaaagtcacatctctgctcgtggaagcagcctaccaactagttaggggaaataatttatggtaattccggtacggtaccagcctacggttcccgaagggaacccgccccagtaccttcccgtactaagtttccaattacggaaacctaaacgtaaaccaacggccggtacgtacccgaaggtacgtactttcccgtacgaaccgtactttccgtcgtacggtacccttaaccgaacggttccgtacgggacctacccgttacgaaccgaccccgtaaccccgtacggtacccctaaacgttccccgaacccgggtaaccctaccggaacggtaccggttacgggggaaccgtaacgggacccttaagtttaaccgttaccggtcggaaccggtaaactacgggttacggggtaaccttcccggaggtacccgttagggtacgggtttgggtacggttaccgggtagggggtttaccggttccggggacggggaacgggtaacccgtaggtacccgttacgggtaccccgttacgtaacgggtccgaaccggtacccgtaagggtcccggtcccgggtaccccgttacggacccgttacccttcccggtttccccggttaccccctacccctttccgtacccttcccgttccgtacccggttacccg

SEQ ID NO: 77542 - DNA, 759 bp, Homo sapiens
  misc_feature: GYAE6OF01AT0C3.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcacatctcctgctctggaagcagctccaacattgggaataattatgtatcgtggtaccagctagttcccaggaaccgccccagactcctcattcatgacaataaacaagcgagtcccagacgtacttcctgacccgtattcctcgtggcctccaagtctggaccaccgtcacgcccacccgtcggacctatcccgaacccggtacctccgaacggtaccgtacgggggaccgtacgggaccgtaacgtttaacgttaccgtacggtaccggaaacgtacgtacggggtacttaccgacggtccgttaggcggttaaaagggtcggttacggtaggggttcgggtttaccggggaccggggtaaccgggggaacccggtaaacgggtacccggttaccgggtaaccccgggtttacccggttacggggttacccgtaaccgggaccccggtaaccgggtacccggttacccgggtcccccggttacccgggttacccgtacccgtttcccggttaccccggtttccccccgtccccctttccccgttacccgtttcccgttccccggttcccgttaccccgg

SEQ ID NO: 77543 - DNA, 642 bp, Homo sapiens
  misc_feature: GYAE6OF01B5KXJ.49.81.H04.1.454.CMB.1.raw
  modified_base (190)..(190): a, c, t, g, unknown or other
  misc_feature (190)..(190): n is a, c, g, or t
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
tcagagtcgagagacacgaccggtgctcgatttagtagtgtagattcgcggggagtcccaaccaggacacagcatggacatgagggtccctgctcagctcctgggggctcctgctgctctggctctcaggtgccagatgtgacatccggatgacccagtctccatcctccctgtctgcatctggtagganacagaatcacatcacttgccaggcgactcaggacattagactaacttaatttaaattggtatcagcaacgaaaccaagggaaccncccctaacctcctagtactctaacgntacgactataccgtaagtttaggaaacgttacggggtacccagtacgtaaggttaccaggtacgggtaaagtggtactacgtaggggtaactttattttaccttacgaacctataccgtaacttaccgtaacctcgaccgtacgtacccgtaggtaacggtataagttacgaactaaactaattaacttactagtaacaataatatagtaattaactacctaacctacttacctacgtttccgggacggtacggtaccgtacggtaggtaactaacgtaacgtaaacggtacgtaggtacgaccgtacgacgtaacctacttcgtacgttcttcgtacccg

SEQ ID NO: 77544 - DNA, 662 bp, Homo sapiens
  misc_feature: GYAE6OF01AN4UC.49.81.H04.1.454.CMB.1.raw
  modified_base (418)..(418): a, c, t, g, unknown or other
  misc_feature (418)..(418): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagcctccaacagttagggaagaattatgtatcgtggtaccagcagttcccaggaccggccccagactcctcattcatcgaacaataacaagcgacgtcccagagacttcctgaccgattctctggctaccaagtctcggccacctcgacgcccacccgtggcctactccgaccggtacctccgagaccgtcggggacgacggaccgtattacttacgnggaccggaactaggtcgggtaacttccgacgtccgttggtacggttgggtcgtacggtaggggttcgggttccggggacgggtaacgggaccgaaggtccgtaccggtaccgtacgtacggtaccgaacggccccgtaaagggtcccgtccgggcccccgttagggtccctacccgtttcccgtccccggtttaccccccggcccctttcccgttacccttccgtttcccgtcccggttacccg

SEQ ID NO: 77545 - DNA, 577 bp, Homo sapiens
  misc_feature: GYAE6OF01B73BS.49.81.H04.1.454.CMB.1.raw
  modified_base (191)..(191): a, c, t, g, unknown or other
  misc_feature (191)..(191): n is a, c, g, or t
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
  modified_base (547)..(547): a, c, t, g, unknown or other
  misc_feature (547)..(547): n is a, c, g, or t
  modified_base (572)..(572): a, c, t, g, unknown or other
  misc_feature (572)..(572): n is a, c, g, or t
tcagagtcgagagacacgaccggtgctcgatttagtagtgtagattcgcggggagtcccaaccaggacacagcatggacatgagggtccctgctcagctccgtggggctcctgctgctctggctctcaggtgccagatgtgacagtccggatcgacccagtctccatcctcctgtctgcatctagtagganacagaactcacctatcacttgacgaggcgactcgagactatacgactaacttaatttaagttgtactcagacaacgaaccgaggtaaccncccctaactcagactacacgagtacgnacgtactaagttagaacgtcggtaccagtacgtaggtcaggtcgaagtggacgtagtaggtacttacgtttactacacgtatacacgtaccaacgtgactacgtcgtagagtagtactacgactaagtactaacgttactacgtaactaagtaacttagtaataactactaccgtactacgtacctacggttacgggacgtacggtacgtacggtacgagtaactaacgacgtagtcgngtcgagtacacgttcacgttctctntcccg

SEQ ID NO: 77546 - DNA, 211 bp, Homo sapiens
  misc_feature: GYAE6OF01APGKK.49.81.H04.1.454.CMB.1.raw
  modified_base (151)..(151): a, c, t, g, unknown or other
  misc_feature (151)..(151): n is a, c, g, or t
  modified_base (196)..(196): a, c, t, g, unknown or other
  misc_feature (196)..(196): n is a, c, g, or t
  modified_base (202)..(211): a, c, t, g, unknown or other
  misc_feature (202)..(211): n is a, c, g, or t
tcagagtcgagagacacgaccggtgctcgatttagtagtgtagattcgcgggcacgaccggtgctcgatttagtagtgtagattccgcgggcacgaccggtgctcgatttagcacgcgagaaagggaaggggctggccctgacgtgtttcngttcccgccctctctactctcgactctgagcgggctggcaaggcncatagnnnnnnnnnn

SEQ ID NO: 77547 - DNA, 771 bp, Homo sapiens
  misc_feature: GYAE6OF01CKIXM.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaagcagcctaccaaactagttaggggaaagtaatttatgtaactcggttaggtaccagcctagttcccgaaggaacccggccccagacctcctcattcatgaacaaataacaagcgagtacccagacgtacttccgcgaccgtattctcgtggctaccaagtctaggccacctcacgcccacccgtcggccctataccgacccggtacctaccgacggtaccggttacgggggaaccgacggggtacccgttaacgtttaacgtttaaccgtacgggtaacccgggtaaacgttacggtaaccgggggttactttaccccggaacggtcccggttaagggacgggtttacggggttcggttacccgggtaaggggggtttcggttaccgggggacgggggtaaccgggaaccgtaaacgggtccgtacgggttaaccccggtaccggtacgggtacccggaaccggtaccccggaaggtcccgtcccggggtcccccgtcggttaccctaccgtttccgttcccggttccccccgtccccttcccgttcccgttcccttccgtacccgttcccg

SEQ ID NO: 77548 - DNA, 819 bp, Homo sapiens
  misc_feature: GYAE6OF01CTCHR.49.81.H04.1.454.CMB.1.raw
  modified_base (192)..(192): a, c, t, g, unknown or other
  misc_feature (192)..(192): n is a, c, g, or t
tcagagtcgagagacacgaccggtgctcgatttagtagtgtagattcgcgggggagtcccaaccaggacacagcatggacatgagggtccctgctcagctcctggggctcctgctgctctggctctcagggtgccagatgtgacatccggatcgacccagtcctccatccctcctgtctgcatctgtagganacagatcaccatcactgccaggcgactagaggacattagactaaacttatttaaattgtatcagacaaacgaaacgaagggaaaccgtacccctaactccgtagactacctacgtactgactaactacctaaagttacggtaaacgttacggggtaccctaagttaccgtaaggttaccgtaaggttaaggtaaaggttcgggtaaagttccggtttaacggggttaaacctttttaacgttttttaacccgtttaaccgtaaccttaacttacttaacttacccgtaaccgtcgtaacgtaccgttacgttacgggaaagttacgtttaacgttaacgtaacctaaaaacggtttaaccttttaacgtttaaaccgttaaccggtttaaaacctaaaccgttaaaaagttttacgttaaaggtttaaaacctttaaaccggttaacccttttaaacccctaaccggtttaaaccccggtttaacgggtttacccggggggtaacccgggttaaacggggaccccgggttaaaagggtttacccgggaaaggtaacccgttaaacggaaaaccgggtagtacggtactaccgtacgactaccgtattccgttactcgttacctaccg

SEQ ID NO: 77549 - DNA, 816 bp, Homo sapiens
  misc_feature: GYAE6OF01A746N.49.81.H04.1.454.CMB.1.raw
  modified_base (189)..(189): a, c, t, g, unknown or other
  misc_feature (189)..(189): n is a, c, g, or t
tcagagtcgagagacacgaccggtgctcgatttagtagtgtagattcgcggggagtcccaaccaggacacagcatggacatgagggtccctgctcagctccgtggggctcctgctgctctggctctcaggtgccagatgtgacatccggatgacccagtctccatcctcctgtctgcatctggtagganacagaatcaccatcacgttgaccgaggctaactagaggactagttacgactaaacgttaagtttaaacgttggtaacttacgaacgtaccaaacggaaaacccgaaggggaaaccctaccccccttaaaccttacccgtagtaacttaccgtaacggactcgacctaactaccgtaaagttttagggaaaacgttacggggtaccctaagttaccgtaaacgggtttccgaaaggttagggtaaaggttcgggtaactttaccggggtttaggggtttaaccgttttaacgttttttaaccgtttaccgaaaccgtttaactaccgtaaactttaacccgtaaccgttaggaccttaaccgggtaccgttaagggtaacgggtatttaacggttacgtaaaccgtaaacttagtttaaccgtttaacgtaacggtaaacctaaacgtaaagtttactaagtaaactttaacgttacccctaacgttaaccctacgtttaaccggttaccggggaacggtaccgggtaacccggtaggggtaaccgtacgtaaaccggttaacccgtaaacggtaggtcggtcggaccgtacgacccgtactacgttacttcgttacttccgtacccg

SEQ ID NO: 77550 - DNA, 837 bp, Homo sapiens
  misc_feature: GYAE6OF01EVNSI.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaagtcaccatctcctgctctggaagcagctaccaactattagggaagtaattatgtagttcggtggtaccagctacgttacccgacggaaccggccccagacctccctctacgttcatagaacaaactaaacgaacgaccgtacgtacccgaggacgtacttacccgtacggaacccgtatttcctcgtcgggtccttaccgtaacgttccgtacggtacccaacccgttaccgaccggacccctaaccccgttccgggacccctaacgttacccgaacccgggtaaccctacccggtaacgggtaccgggttacgggggggaaccggtaaccggggtaacccgtttaacgttttaaccgtttaaccggttacgggaaccgggtaaacccgtagggtacggggttaccttacccgacggttaccgttacggtagggtttcgggttacggttcgggtaacgggggtttcgggtacgggggaccggggtaacgggtaacccgtaacgggtccgttaccggggtaacccggttccggtaacgggttaccgacgggaccccgtaaacgggtcccggttcccgggtccccgttacgggtacctccgttacccgttcccggttaaccccctccccttaccgttaccctttcccgtccgtcccggtacccg

SEQ ID NO: 77551 - DNA, 770 bp, Homo sapiens
  misc_feature: GYAE6OF01C8ELA.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatccctcctgtctgcatctgtaggagacagaactcaccatctacttgccaggtcgactcgaggactattacgactaaacttatttaaaagtttggtaatcgaagacaaacgaaaccgaacgggaaaccgaccccctaacctccgtagtaacttactacgtatcgactactaaccgtaatttaagggtaaagtacggggtaccctaagtactaacggttacaggtagggtaagtcggaagttcggtagggttaacgttatttttacgttaccctaactatactaactacctaaccgtgacctaccggtaccgtaggaagggtaactttacgtacggaaaccttaacctaattttaaccgttaacgtacgtttaaaccccgaaaactttaattaacgggttaacttaaactttaaacctttacccctaaacccttaacccggtttaccgttaaccgggttttaccgggaacggggtacccgggtaacccgttacggggtaaagggtactaaacgtaaacccggtaaaagtaaccggttggtacggtacccgtacggtacccctaacccgtaacgtttccgttaccgtttacccgttcctttaaccccggg

SEQ ID NO: 77552 - DNA, 713 bp, Homo sapiens
  misc_feature: GYAE6OF01DTZ1I.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatccctccctgtctgctatcgtgtaggagacagaactcaccatctactgccagccgactcaggactattagactaacttattaaagttggtactacgacgacaacggtaaaaccgaacggggtaaaccaccccccttaaccgttcctacggtaacttacgtaaccggtattcgacctaactacctaaggttttaacggaaacgttacgggtcccaagtcgtaaggttcaaggttagggaaggtaggacttacggtaacgggttaactttactttttaccgtacgtacctacttactaacgtacctaaccgtacgtacgtacgtaccgttaggtaacggttaacttaacgttacgtaactaaccgttaactttaacgtttacggttaactaccttaaacctaaagttaacaacgtttaacttaaacttaccttaacctaccttacgtaccgtttacgggacggtacggtacggtacggtagggaacaacgtaacggtaaacgtactcgggtagaccgtgacctacgttacgtcttcgttccttcgtaccccg

SEQ ID NO: 77553 - DNA, 694 bp, Homo sapiens
  misc_feature: GYAE6OF01BYBI4.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcacatcacttgaccgaggccgactcgaggactagttagactaaacttaattttaaaagttggtaactcgagaccaacgaaaacccgaagggaaaccgtccccctaaaccttcccgtagacttaccgtaacgatcgactactaccgtaaagtttaggaaaacgttacggggtacccagtacggtaaggttcgaaggtaggtaaggtggacgtcggtagggttaactttattttaccttacacctatccgtaactaccaaccgtgaccacgtccgtaggaacggttattagttacggaacctaactaattactttactgtaaccaaactaattactagtaattaactacctaaccgtacttactaccggtttcgggacgggtaaccgggtaccgtaaggggtaggaaccgtaacggttaacgaaaacccgggttagtacgggttacggaccgttcggaacccgtaacttacgttaccgttgtttaccccttcgttaacccg

SEQ ID NO: 77554 - DNA, 709 bp, Homo sapiens
  misc_feature: GYAE6OF01C00IU.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatcgacccagtctccatccctcctgtctgctatctgtaggagacagaactccaccactctacttcgaccgaggccgactacgaggactagttacgactaaactttaagttttaaagttcggtaataccgtaagaccgaaaacgaaaacccggaaacgggaaaacccgtaccccccttaacccgtccgtacgtacttaacctacggtatacgtacctacgttaaccttaagtttaaggtaaaccggttacgggtacctaagtacgtaaggttacgtaggttaggaacgttggtacgttacggttagggttaaccgtttaacttttaccgttactaactacttacctactacctactcgacctcggtacgtaggagtattacgtcaacgtacttaagttactttacctacgtaacaaactaaagttctaagtaacttaactacctacctacgtaccttcggttaccggggaggacggtaaccgtggtagaccgtagtaaaccgaacgttacgttggtaccggtactcgacccttaactcgttacctcgttacttcgttacccg

SEQ ID NO: 77555 - DNA, 768 bp, Homo sapiens
  misc_feature: GYAE6OF01EJDSM.49.81.H04.1.454.CMB.1.raw
  modified_base (223)..(223): a, c, t, g, unknown or other
  misc_feature (223)..(223): n is a, c, g, or t
  modified_base (280)..(280): a, c, t, g, unknown or other
  misc_feature (280)..(280): n is a, c, g, or t
  modified_base (343)..(343): a, c, t, g, unknown or other
  misc_feature (343)..(343): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctgccggccccaggacagaaagtcacatctcctgctctggaagcagcctaccaacattagggaaanaatttatgtatcggtggtaccagcacgttccacggaacccggccccaagacctcctnacttcatcgaaaaacataaacaaggcgacgtacccagacgtacttccgtagacccgtatttcncgtcggacctacctaaggttctcggacctacctcgaaccgccctacccgtcggtcccacgtccgaaccgggtacctaccgaacggtaccgtcgggggacgacgggacccgtaatttaccgttacgtggaaccgggaaactaggtacgggtacttacccgaggtacccttagggacggttgggtacggtttacgggacggggggttttcggttaccgggggtaccgggaaccgggggtaaccaacggggttccgtacccggggtacccgttacccggttaagggttcccggaacccgggttacccggtaacgggtccccggttacccgggttccccccgttagggttacccttacccggttccgttcccccgggtttacccccccgtccctttaccccgttcttcccgttcccgttaccgtacccg

SEQ ID NO: 77556 - DNA, 787 bp, Homo sapiens
  misc_feature: GYAE6OF01BVZ3C.49.81.H04.1.454.CMB.1.raw
  modified_base (205)..(205): a, c, t, g, unknown or other
  misc_feature (205)..(205): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctcgccggccccaggacagaaacgtcaccatcctcctgctctaggaacncagcctaccaactagttagggaaataatttatgtactcggtacggtaccagcgtacgttacccgacgggaacccggcccccaagtacctcccttactaactttcaattacgaaactaaataaacgaacggccgtaacggtacccaaggtaacgtaccttcccgtacgtaccgtactttaccgtcgtacggtccttaccgtaacggttcgtacggacctacccgtacgaccgtaccccgacccgttcggaccctacgtacccgtaacccggtacctaccgacggtaccgggtacgggggaccgtaacggtaccgtttaagtttaaccgttaccggtacgggtaaccgtaacgtacggtacgggttaaccttaccggacgtaccgtagggtcggttcggtacgttcggtaggggttcgtacgggacgggacggtaccgaagtcgtaacggtacccgtacgtacggtaccgaccggtaccgtacggtcccgtcccgggtaccccgttaccgggtacttaccccgtttccgtaccccgtttaccccccacccgttttccctaccgttccctcccgtcggtacccgg

SEQ ID NO: 77557 - DNA, 740 bp, Homo sapiens
  misc_feature: GYAE6OF01CT735.49.81.H04.1.454.CMB.1.raw
  modified_base (216)..(216): a, c, t, g, unknown or other
  misc_feature (216)..(216): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgcctcagtgtctgcggcccaggacagaaagtcaccatctcctgctctggaagcagctccaacattgggaanaattatgtatcgtggtaccagcagttcccaggaaccggccccagactctcattcatgacaataacaagcgacgtccagacgtcttccagtaccgtattcctacttggcctacgtaagtccgtggtacctacctcgaaccgtccccaacccgtggacccaactacccgaacccgggtactccgaacggtacgtacgggggacgacgggcccgtaagtttacgtaccggtacggaccggtaaactaggttacgggtaaccttacccggagttcccgtagggtacggtttcgggtacggttacggaacgggggtttcgtttacggggaaccgggtaacggggtaacccgtaaaggtcccgttacggtaaccccggttaccggtacgggtacccgtaaccgggaccccgtaaacgggtcccgttccggggacccccctttggggacccctaacccgtttcccgttacccggtttacccccctaccccgtttacccctcccgtttaccgttccccgtaccggttacccg

SEQ ID NO: 77558 - DNA, 824 bp, Homo sapiens
  misc_feature: GYAE6OF01EG2L7.49.81.H04.1.454.CMB.1.raw
tcagagtcgagagacacgaccggtgctcgatttagtagtgtagattcgcgggggggacaatcttcatcatgacctgctcccctctcctccgtcacccttctcattcactgcacagggtcctgggcccagtctggtgttgacgcagccgccctcagtgtctcgcggcccaggacagaaagtcaccatctcctgctctggaagcagcctccaactagttgggaaagtaattatgtatcggtaggtaccagctagttcccaggaaccgccccagacctcctcattcatacgactaataacgaagcgacgtcccaagagtacttccgtgaccgtacttctcgtcggtacctacctaaacggttcgtacggaccctaaccgtccgaacgtcccctaccccgtgggcccctaacgtacccgaacccgggtacctacccgtaacggtaaccggtacgggggaacccggtacgggtacccgtaagtttaacgttaaccggtcgggaaccgggtaaactaggttacggggtactttcccgaacggtcccgttaggtacggttgggtacggtacggtaagggggtttcgggttacggggaccggggaacggggtaacccgtaaagggtcccgttaccgggtaaccccggtttaccggtaaccggggttcccgaaccgggtacccccggtaaacggggtccccggtttaacccggggtcccccccgggtttacgggttaccccgtaccggttttccccgggttaccccggtttcccccccggtaccccctttccccgtttccccgttcccgttccccgttacccggttaccccgg

SEQ ID NO: 77559 - DNA, 846 bp, Homo sapiens
  misc_feature: GYAE6OF01AGTQ2.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggcccaggacagaaagtcaccatctcctgctctggaacgcagctaccaactagttaggggaataattatgttatcggtacggtaccaggctacgttcccgaagggaacccggcccccagacctcccgtctacttcatacgaaccaataacaagccgaacgtcccgagacgtactttcctcggtacccgtatttccgtcgttcgggccttaccgaacggttcctagggtaccctaccgtcgaccgaccccgtaccccgttcggaccctacgtcccgacccgggtacctacccgaacggtaccggtcgggggaaccggtaacgggtcccgtaagttttacgttaaccggtcgggaaccgggtaaaacgtacgggtttacgggtaacctttacccggacggttcccgttaacgggtagggttttacgggttacgggtttccgggttaaggggggttttcgggtttttacgggggaaccgggggtaacgggggtaacccgtaagggtaccccggttaccgggtaaccccggtttaccgggttaaccgggtaccgggtacccggaccccgtaaaccgggtccggttaaccccgggtcccccgttccgggttaccctacccggttccccgttaccggttcccccccggtcccctttcccgttccctttcccgttcccggtcccttacccggg

SEQ ID NO: 77560 - DNA, 693 bp, Homo sapiens
  misc_feature: GYAE6OF01A2LWV.49.81.H04.1.454.CMB.1.raw
tcagagtcgagagacacgaccggtgctcgatttagtagtgtagattcgcgggggagacaatcttcatcatgacctgctcccctctcctcctcacccttctcattcactgcacagggtcctgggcccagtctgtgttgacgcagccgccctcagtgtctgcggcccaggacagaaagtcaccatctcctgctctggaagcagctccaaacagttgggaaagtaatttatgttaatcggtaggtaccagcagttcccgagggaacccggccccagacctcctctacttcatcgaactaataaacagcgacgtcccaagagtacttcctagaccgtattcctctggcctaccaagtcctcggccaccgtcacgccccacccgtcggaccctagtcccgaacccggacctaccgaggtaccgtacgggggaccagggtcccgtaatttacgttacgtcgggtaaccggaaacgtaggtacgggtacttcccgaacggtccgttaggacgggttgggtcggtacgtacgggggttcggttccggggaggggtaacgggaacccgtaagggtccgttaccggacccgttaccggtaacggtccgacggtacccgaagggtcccgtccgggtccccgttacgggtcctacccgttccgtcccgttacccccacccgtttccctccgttccgtcgtacccg

SEQ ID NO: 77561 - DNA, 752 bp, Homo sapiens
  misc_feature: GYAE6OF01DQT9C.49.81.H04.1.454.CMB.1.raw
  modified_base (282)..(282): a, c, t, g, unknown or other
  misc_feature (282)..(282): n is a, c, g, or t
tcagagtcgagagacacgaccggtgctcgatttagtagtgtagattcgcgggggagtcccaaccaggacacagcatggacatgagggtccctgctcagctcctgggggctcctgctgctctggctctcaggtgccagatgtgacatccggatgacccagtcctccatcctccctgtctgcatctgtaggagacagaactcaccatctacttgccaggcgacgtcgggactattacgactaacttaattttaatggtatcagacaagaaacgacgggaaaccncccctaacctcctagactctagactgactactaccgttaagtttacgggaaacgttcggggtacccagttaccgtaaggtttcgaaggttagggtaaggttagggtacgttcggttacggggtttaacgttttaactttttacctttaccgacctatacctacttaccgaaccgttcgaccgtaaggtcccgttaggaagttaacttacgtttacgaaccttaaacttactttaacgtttaacctacgttaaacaaacgtttaacttaagttactaaactttaaccttacccgttaacccttaaccgttaccgtttaaccggtttaccgggggaccggggtaaccggggtacccgtaagggggttaacggtaacgtaccgttaaaccggtaaaacccggttacgttggggtacgtaccgtcggtaaccctaactacgttacgtttacgttccttccgttccgttaccccg

SEQ ID NO: 77562 - DNA, 703 bp, Homo sapiens
  misc_feature: GYAE6OF01ET381.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggcctctcaggtgccagatgtgacagtccggatcgaccctagtcctccactccctccctgtctgctatcgtgtaggagacagaactcaccatccacttcgccaggccactacgaggactattagactaacttaatttaagtgtatcagacaacgaaaccgacgggaaacctcccccttaactctagacttcgaacgtctgacctaactaccgtaaagtttagggaaaagttaccgggtcctaagtacgtaacgttagacggttaaggacggttaggtacgtacggttacgggttaacttttacttttacgtttacccaacgttacttacgtaaccttacgtaaccgtacgaccgtaccgtaccgtagggtaacggttaactttagttaaccgtaactaaactttagtttaaacttacgttaacgtaactaaacgttaactttaagtataactaacttaacctaccctaccttacgtaccggtttaccggacggtaccgggaaccggtagggtacgaacgtaacgtaacgtaaacgtacggtgtacgcgtacgaccctacgtcgttagtcctaccttcgtacccg

SEQ ID NO: 77563 - DNA, 656 bp, Homo sapiens
  misc_feature: GYAE6OF01A4QC4.49.81.H04.1.454.CMB.1.raw
  modified_base (222)..(222): a, c, t, g, unknown or other
  misc_feature (222)..(222): n is a, c, g, or t
  modified_base (403)..(403): a, c, t, g, unknown or other
  misc_feature (403)..(403): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaagcagctaccaacagttagggaanaatttatgtactcggtaggtaccagctacgttcccgaggaaccggcccccagacctcctcattcatagaacaataacaagcgagtaccccagtagtacttccagacccgtattctcgtggcctacaacgttctggccacctcacgcccaccgtcgccatccaccggacctccgagtacggngggaccgaggccgttaattattacgtcgacggtaacagtacggactttccagcccgtaggtacggttgggtcggttcgtaggggttcggttaccggggcgggtaacgggaccgaaggtcgtacggtacccggtcgtacgggtaccaccggtacccgaagggtccgtccgggtcccccgttgggtccctacccgttcgttaccccgttcccccttacccccttcccttaccttccccttccgtccgttaccccg

SEQ ID NO: 77564 - DNA, 789 bp, Homo sapiens
  misc_feature: GYAE6OF01ACY56.49.81.H04.1.454.CMB.1.raw
  modified_base (218)..(218): a, c, t, g, unknown or other
  misc_feature (218)..(218): n is a, c, g, or t
  modified_base (266)..(266): a, c, t, g, unknown or other
  misc_feature (266)..(266): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtgtacagcagttcccaggaccggccccagacctccncattcatgaacaataacaagcgacgtacccagacgtacttccgagaccgtattcgtacgtcggtacctaccgtaagttcgtcggacctacctcgacgcccacccgtcggaccctactccgaacccggtacctacccgaacggtacggtacgggggaccgaacggggtcccgtaactttacgttaccgtacgggtaaccggtaacgtacgggttcgggtaacctttacccggaccgttacccgtaggtacgggttacgggttacggtacgggtaacggggtttccgggtttacggggaccggggtaacggggtaaccgaacggttacccggtacgggtaaccccgttaccgggtaaccgggtacccgtaacccgggtaccccggtaaacgggtcccgttacccggggtaccccccggttaccgggttacccgtaaccccgtttcccggttaccccgttttaccccccctaccccgttttccccttaaccccgtttcccgttaccccgttacccggttaccccgg

SEQ ID NO: 77565 - DNA, 719 bp, Homo sapiens
  misc_feature: GYAE6OF01B7L5G.49.81.H04.1.454.CMB.1.raw
  modified_base (335)..(335): a, c, t, g, unknown or other
  misc_feature (335)..(335): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctgccggccccaggacagaaagtcaccatctcctgctctggaagcagcctaccaactagttaggggaaataattatgtaatcggtaggtaccagcacgttcccgaagggaaccggcccccagtacctccctacacttcatcgaacaagtaacaagcgaagtcccagacgtacttccgngaccgtattctcgtggcctaccgaagtcgtcggccacctcgacgacccgaccccgtcgacccaacttaccgacccgggtacctacccgaggaccgtacgggggaccgacggcccgtaatttagttacgagacggaacgagttacgggtacgttaccacgtccgtaggtagtcggtgttacggtaggggttcggttacggggacgggtaacggggacctaacgggccgttacggacccgttaccggtacggtcccgaaccggacccgtaaaccgggcccgtaccccgggtcccccgttcccggtacccgtcccgttaccccgtttcccggttaccccccttaccccgttaccccttcccgtcccctttaccgtcccgttaccccg

SEQ ID NO: 77566 - DNA, 561 bp, Homo sapiens
  misc_feature: GYAE6OF01BZMWQ.49.81.H04.1.454.CMB.1.raw
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanattangtancgtggtaccagcagttcccagacgccccagactcctcattcatgacaataacaagcgagtcccagacgacttccgtgaccgtattctctggcctccaagttcctggccacctcacgcccaccctggccatccacggctccagactggggacgacggccgattactactgacggaaacagtgggacttccaagccgtgagtggtgtcgagggtgttcggcgggaggaccgagcgtgaccctcgtacggccaggtcccaagggcctacgggccccgttgggtctacccgttcttacggttcccccgtcccttacccttcctcctccgttcccgtacc

SEQ ID NO: 77567 - DNA, 808 bp, Homo sapiens
  misc_feature: GYAE6OF01BDGYD.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctcgtggctctcgaggtcgcagatgtgacgatccggatcgacccagtctccactcctccctgtctgcatcgtgaggagacagtactcacctatcctcttcgaccgagcgactcgaggtacagttacgacctaacttaattttaaagttaggtactacgtacacgtaaacggaaaccgaacgggtaaaccctaccccctaaccgttcctaggtactaccgtagactcgtaactaccttacgttaaagtttacgggaaacggtacgggtaccctaagtacggtaacggttcgaaaggttacggaaggttacgggtattaccgggttaagggttaccttttaacgtttttaaccctacctaaaccttatacctaactacccgtaaccggttcgtaacccgtacgtaccgttagggtaaacgttaacgttaacgttacgaacgttaaacttaacgttttaacttaccgttaaacggaaacttaaaccttaaggttaataaactacgtttaaaccttaccttaacccctaacgttaccccttaagggtttacccggggaacccgggttaacggaacccgggtagtaacgggtaaccgtaacccggttaaacgttaaaaccgtagggttacggtacggtccgtaaccgggaccctaaccgttactttggttaacccttaccgtttccgttaaccccccg

SEQ ID NO: 77568 - DNA, 649 bp, Homo sapiens
  misc_feature: GYAE6OF01EQJJA.49.81.H04.1.454.CMB.1.raw
  modified_base (182)..(182): a, c, t, g, unknown or other
  misc_feature (182)..(182): n is a, c, g, or t
  modified_base (192)..(192): a, c, t, g, unknown or other
  misc_feature (192)..(192): n is a, c, g, or t
  modified_base (286)..(286): a, c, t, g, unknown or other
  misc_feature (286)..(286): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatcgacccagtcctccattccctccctgtctgcntctgtagganacagaactcacatcacttgaccaggccactcaggacattacgactaacttaatttaagttggtatcgaagacaaacgaaaccgaaggtaaaccncccccttaacctcaggtactactacgatcgactataccgtaagtttagggaaacgttacgggtaccctagtacgtaaaggttcaggtaggtaacgtggtatcggttaggtaccttttattttacttacactatacctatacctacgtgactacgtccgtaggtagtatactacgactaaacgttatttaacgttactacgtaactaaactattaattacgaattaactaccttaccgtaacttaccgttaccgggttacggaacgggtaccggtaccgacggggttagacgtaactaacggtaaaccgtgttacgggcgtacgtacgacctaccgttacgttccttacgttcctacgtacccg

SEQ ID NO: 77569 - DNA, 776 bp, Homo sapiens
  misc_feature: GYAE6OF01DRVYI.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctcctgtctgcatctgtaggagacagaatcaccatcacttcgccaggcgactacgaggacatacgactaaacttatttaaattggtatcgacgacaagaaaaccaagggaaaccaccccgtaaccctctgtactactacgatcgacactacgtaagtttaggaaactacggggtacccaagtacgtaacggttacaggtaggaagtggtaattacggtagggttaactttacttttacgttcacctacgttactactaccgtaaccttcgactacggtaccgtagggtaacgtaacgtttaagttacgtaaacctaaacgtttaaactttaacgttttaaacccgttaacgttaaacctaaaactttaaacgttaacttttaacggttaaaacttaaacctttaacccttaaaccctttaaccgtttacccggtttaaacccggtttttaccgggggaaccgggggtacccggggtaaacccgggttaaaccggggtaacgggggtaaactaaacgttaacccggaaaaaccggtttaaccgggttacgggttaccggaccggttacgaacccgtacgttaacttcgtttaccgtttactttcttaacccg

SEQ ID NO: 77570 - DNA, 540 bp, Homo sapiens
  misc_feature: GYAE6OF01ED597.49.81.H04.1.454.CMB.1.raw
  modified_base (388)..(388): a, c, t, g, unknown or other
  misc_feature (388)..(388): n is a, c, g, or t
  modified_base (416)..(416): a, c, t, g, unknown or other
  misc_feature (416)..(416): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctcctgtctgcatctgtaggagacagaatcaccatcacttgccaggcactcaggacatagcaacttatttaaattggtatcagcaagaaaccaggaaacgccccctaactcctgatctacgatgacatccaatttggaaatgggtccatcagtcagtgaagtgatcgtaggtacttatttacgttcactatcatcaactgcagcctgagtatatcgactaacnttaatttactagtacaaacgtattatanaataactacctaccacttacgtacgtttcggaacggtacggaccgtaggtcgaacgtaacgtaacgtaaaacggacgttaggtcggacgtcgaacctactacttcgttacttcgttctaacccg

SEQ ID NO: 77571 - DNA, 786 bp, Homo sapiens
  misc_feature: GYAE6OF01DODKA.49.81.H04.1.454.CMB.1.raw
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcacgcccgccctcagtgtctgccggccccaggacagaaagtcaccatctcctgctctaggaacgcacgcctaccaacgtagttagggaaagtaattagttgttagttcggttacggtacccaggtccgtaccgttaccccgaacgggaaaccccggccccccgaagtaccctaccctctacttacagtacgaacaaataacgaagccgtaacgtacccaagtacgtactttcccgtacggacccgttattccgttcgtacgtacctaccgtaaggtcccgttacgggccctacctaccaccgtaccccgacccgtcggccctaactacccggaccccgggtcctacccgaaggtacccggttacgggggaacggtaccgggtaccgtttaacttaacggtttaccgtacggaccggtaaactcggtacgggtaacctttccgaacgtcgtacggtggtcggtacggtacgggtacgggtcggttccggggaacgggacggaaacccagggcgttaccgggaccgttccggtacggaccgtacggacccgtaacggtcccgttaccggtacccccgtgggttcctaacccctccgtttccccgtacccccgtcccttacccttcccgttaccgtccgtccctacccgg

SEQ ID NO: 77572 - DNA, 976 bp, Homo sapiens
  misc_feature: GYAE6OF01EJYOB.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaagcacgcctaccaactagttaggggaaagtaatttaagtgttaacgttccggttacgggtaacccaggtaccgtaaccggtttaccccgaacggggaaacccggccccccgaaggtacccttccctactaactttaccaattacgaaactaaaacttaaaccgaacggaccggtaaccgtaccccgaaggtaacggtacctttcccgtacggtaacccgtactttccgttacgtcgggtcctacccgtaaaggttccgtacgggaccctaacccgtacgacccggtacccctaaccccgtcgggacccctaacgtacccgaaccccgggtacctacccgaacggtaccgggtacggggggaaccggtaacgggtacccgttaagtttaacgtttaccggtacggtaccgggaaacgtagggtaccggggtaacctttacccggacggtccgttagggtacgggtttcgggtcggtacgggttacgggggttccgggttacgggggtaaccgggggaaccggggtaacccgtaacgggttcccggttaccgggtaaccccggtttacccggtaacggggttaccccggaaacccgggtaccccccgggtaaacggggtccccggtttaccccggggtacccccccggttttacggggtacccccttaacccggttttcccccggtttacccccggttttaccccccccccgttaaccccccgtttcccccgtttaccccgttttaccccgtttcccccggttacccgggttacccccgg

SEQ ID NO: 77573 - DNA, 804 bp, Homo sapiens
  misc_feature: GYAE6OF01DQZVU.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctggccggccccaggacagaaagtcaccatctcctgctctggaagcagcctaccaactagttagggaataattatgtatcggtaggtaccagcacgttcccgaacggaacccgcccccagtacctcctctattacatagaacaaataaacagacgacgtacccgagtacgtacttccgagtacctattcctctcggacctaccgtaagtcgtacggacctacccgtcgaccgtacccctacccgtcggaccctaacgtacccgaacccggtaccctaccgaacggtaccgggtacggggaacgtacggtaccgttaatttaacgttaccgtaggaaccggtaacgtacggttacgggtaaccttcccgaacgtccgtaggtacggttcgggtacggttacgggtagggggtttccggttacggggaaccgggggtaaccggtaacccggtaacgggttccgtaccgggttaacccggttaccggttacgggacccgtaacccgggtaccccgtaccgggtcccgtaccccgggttcccccggttaccggtaccgttaccccgtttcccgttacccccccgggtttccccccttacccccggtttccccttaccccgtttcccggttccccgttccggttaaccccgg

SEQ ID NO: 77574 - DNA, 783 bp, Homo sapiens
  misc_feature: GYAE6OF01EQRXV.49.81.H04.1.454.CMB.1.raw
tcagagtcgagagacacgaccggtgctcgatttagtagtgtagattcgcggggagtcccaaccaggacacagcatggacatgagggtccctgctcagctccgtggggctcctgctgctctggctctcaggtgccagatgtgacatccggatcgacccagtcctccactccctcctgtctgctatcgtgtaggagacagactcacatcactcgcgagcgactcgaggactagtacgactaaacgttaatttaaagtggtactacgagaacgaaacggaaaaccgaagggtaaaaccctcccccttaaaccgttccgtaaggaacttaccgtaaacgtacgttcacctaaaccttaccgtaaaaggttttaacgggaaaaccgggtttaccggggtaacccttaaggtaaccggttaaacggggtttaccgaaaggggtttagggtaaaggttacgggtacggtttaccgggtttagggttaaacgttttaccttttttaacgtttacccaaacctttataccttaaacctacccttaaccgttcggaaccgtacggtaccgtaagggaacggtttaatttacgtaacgtaactaaacttacttttaacgtacgttaacgtaactaaagtaaacttagtacgtaaacttacctaactaaccgttaccgttaccgtacgggtttacggaaccgggtagtaacccggaggttaacgaacgtaacgtaaacgtaaacgtgtaggtccgacgtacgacctacgtacttacgttcttactccgttacccg

SEQ ID NO: 77575 - DNA, 746 bp, Homo sapiens
  misc_feature: GYAE6OF01BZ4QI.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccactcctccctgtctgcatctggtaggagacagaatcacatcacttgccaggcgactcaggactattagactaacttaatttaaagttggtatacagacaacgaaaccgaagggaacctacccctaacctcctagtactaccgtacgatacgactacttacctaagtttagggtaaacgttaccggggtacctaacgttacgtaaacggttcgtaaggtagggtaaggttacgggtacgttcgttaacggggttaacgttttaactttttaccctttaccgtaacctaagttacctaacttacccgtaaccttcggacctacgtaccgtaggaaacggttattacgttacgaacctaaacttaacgtttaacttaaccgtagtaaaccctaaagtaaactttaagtaacgttaaacttaaccttacccttaaccctaaccgtttaccgtaaccggtttacggggaaccgggtaaccgggtaaccgtacgggtaacggacgtaaaccgtaaccgtaaaacggtcgttaacggtccgtacgtaccgacctaaccgttacttaccgttccgttccgttcccttacccg

SEQ ID NO: 77576 - DNA, 691 bp, Homo sapiens
  misc_feature: GYAE6OF01A4B8T.49.81.H04.1.454.CMB.1.raw
  modified_base (219)..(219): a, c, t, g, unknown or other
  misc_feature (219)..(219): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctggcggccccaggacagaaagtcaccatctcctgctctggaagcagctccaacattgggaanaattatgtatcgtgtaccagcagttccaggacgcccagactctcattcatgacaataacaagcgacgtccagagacttcctagaccgtatttctcgtcggctaccaagtctaggaccacctcacgcccaccgtcggacctatccgaaccggtactccgaaggacgtcgggggacgacggaccgtaatttaacttacgtcggacggtaaactagtcggggtaactttcccggaacgtccgttagggaacgtttcggggttacgtacggtagggggtttccgttacgggggacgggtaacggggaacccgaagggtccgttacgggtaaccccgtcgttaacgggtcccaacggaccccgaacgggtcccggttaccggggtcccccttcgggttacctaacccggttcccgtttacggttccccttccgggttaccccccttaccgtttcccttaccccgttcgtaaccccgg

SEQ ID NO: 77577 - DNA, 718 bp, Homo sapiens
  misc_feature: GYAE6OF01A999O.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctgccggcccaggacagaaagtcaccatctcctgctctggaagcagcctaccaactagttaggggaaataatttatgtatcggtaggtaccagcacgttccgaaggaccggccccagtacctcctcattcatagaacaataacagcgtaacgtccagtagtacttctacgaccgtattcctcgtcggcctaccaagtcgacggtccacctcacgcccaaccgtcggaccctacgtccgacccggtactaccgaacggacggtcgggaccggtacggtacctacgtttagtaccgtacggaccggtaagtacgtcgggtaaccttacgaacggtccgttaggaaggtttcgggtacgtacgggttacggggttcgggtacggggtaccggggaacggtacccgtaacggtccgtaaccggtaccggttaccggtacggtccgaaccggacccggacgggtaccgtcccgggtcccccgttagggtaccctcgttacccggttccccggttccccgttacccccgttcccgtacccgtttcccgttacccgtccggttacccg

SEQ ID NO: 77578 - DNA, 749 bp, Homo sapiens
  misc_feature: GYAE6OF01CEDBR.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagatcaccatcacttgccaggcgactcgagacattagactaacttaatttaagttggtatcgagacaagaaaccgagggaaaccgacccctaacctcctagactactacgatcgactatcctaaagtttaggaaacgttacgggtaccctaagttaccgtaaggttaccgaaggtaagggtaaaggttcggtaacgttacggttacggggtaacgttttaactttttaaccttaccgtaaccctaattacctaacgttaccctaaccgtcggtactaaccgtccgtaagtaggtaactttaacgttacgaacctaaacgttactttaatttaacccgttagtaacaaaccttaaagttaacttaaacgtaactttaaacgttaccctaacccgttaaccgtttacccgttaaccgggttttacccggggaacgggtaaccgggtacccggtaacggggtaacggtacgtaaacgtaaccgtaaaaccgggtacgttacgggttaccggaccgttacgacccgtacgtacgtttacttccgttaccttaccgttaccccg

SEQ ID NO: 77579 - DNA, 729 bp, Homo sapiens
  misc_feature: GYAE6OF01EOVTK.49.81.H04.1.454.CMB.1.raw
  modified_base (338)..(338): a, c, t, g, unknown or other
  misc_feature (338)..(338): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagcctccaacagttgggaaagtaattatgtatcgtgtaccagcacgttccaggaaccgccccagacctcctcattcatgaactaaataacaacgcgtaacgtacccgaagacgtacttccgtacgaccgtattccgtntcgggtacctaccctaaacgtcgtacggacctaacccgtcaccgtcccaacccgtcgggtacccctaacttacccgaaccgggtaccctacccgaacggtacccgtacggggggtaacccgaacgggtcccggtaagtttaacgtttaaccgtgggtaacccggaaacgtacggttacgggttaacctttacccgaacgggtccgtagggtaacggtcgggttacggttcggtaaggggttcggttcgggacggggtaacgggaccgtaaggtcggtacggtacccggttacgtacggtcgacgtacccggagtaccgtccggtacccgtcggtcctacgtcccggttcgtcccccgtacccgttcgtcccttacctccgtccggttaccg

SEQ ID NO: 77580 - DNA, 635 bp, Homo sapiens
  misc_feature: GYAE6OF01AEW2U.49.81.H04.1.454.CMB.1.raw
  modified_base (373)..(373): a, c, t, g, unknown or other
  misc_feature (373)..(373): n is a, c, g, or t
tcagagtcgagagacacgaccggtgctcgatttagtagtgtagattcgcgggggggacaatcttcatcatgacctgctcccctctcctcctcacccttctcattcactgcacagggtcctggcccagtctgtgtgacgcagccgccctcagtgtctgcggccccaggacagaaagtcaccatctcctgctctggaagcagctaccaactagttagggaaagaatttatgtatcgtaggtaccagctacgttacccgacggaaccggcccccagacctcctcaacttcattagaacaataacaagacgacgtacccgagagacttccgtcgaccgtattctacgtcggcttaccaagttctggcctacctcacncccacctcggaccactccgaccggacctacccgaaggaccttagggggacgacgggacctaagttattaccgtagcgggaaactggttaggacttacgacgcgtggagtggtcggtaggagggttcgttcggggaggagggtaccgaagtcgtacggtccgtcgtagtcgaacgcccgacggtccgtacgggcccccgtggtacccgccttctacccggtttccccccgtacctccccttcctccgttccgtggttaccccg

SEQ ID NO: 77581 - DNA, 907 bp, Homo sapiens
  misc_feature: GYAE6OF01BW1V5.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgcctcagtgtctgcggcccaggacagaaagtcaccatctcctgctctggaagcacgcctaccaaacagtttaggggaaagtaatttacttgtaattcggttacgggttaaccaggtacctaacggtttaccccgaacggggtaaaccccggcccccccgaacggtaacccttacccctacctaacttttacccgaatttacggaaaccctaaaacgttaaaaccgaaaacggtacccggtaacggttacccccgaaagggtaacggtaaccgttttccccgtacggtaacccggttacgttttaccgttaccggttacgggtacccgttaccccgtaaaacggttccggttaccgggaccccgtaacccttacccgaaccggtcccccgtaaccccgttaccggaccccgtaactaccccggaaccccgggtaccttacccggaacggtaaccgggttacggggggaacccgggtaacggggtaccccgttaaagttttaacggttaacccggtagggtaacccggggtaaaactaagggttacgggggtaaacttttaccccgacggttcccggtagggtacggttcgggttaacgttgggtaacggggtttcggttccgggaagggtacgggaacctagggtccgtacggtacccgtacgtacggcaccggaccgtaggcccgtacccggccccggttagtcccgtccgttaccgtcccggttccccgtccccttcctaccgttccttccgtccgtaccg

SEQ ID NO: 77582 - DNA, 670 bp, Homo sapiens
  misc_feature: GYAE6OF01ELJI6.49.81.H04.1.454.CMB.1.raw
  modified_base (482)..(482): a, c, t, g, unknown or other
  misc_feature (482)..(482): n is a, c, g, or t
  modified_base (630)..(630): a, c, t, g, unknown or other
  misc_feature (630)..(630): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctcctgtctgcatctagtaggagacagaatcaaccatcacttgaccgaggtccgactcgaaggactagttagactaacttaatttaaagttggtatcagtacaaacgaaaccgaacgggaaaccgtaccccctaaccgtcctagaactacgtacggacttcgtacctaacttaccgtaaagtttacggaaacgttacggggtaccctaagtaccgtaaggttcgtaggtaggtaacggtaggtacgttcggtaggggttaactttaacgtttttaccgtttacaaccgttactactaacgtacctaaccgtcgaacncgtaccgtaggagttattagttacgacctaataacttaatttacgtagtaaacctaataacgtataagtaacttaactaccttaacctacttaccgtacgtttacggacgggtaaccggtacgacgggtagacgaactacgaaacgtntcggtcgatcggactaacgtcttacgcgtttctccgttac

SEQ ID NO: 77583 - DNA, 1012 bp, Homo sapiens
  misc_feature: GYAE6OF01BIGUF.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctggccggcccaggacagaaacgtcaccatcctcctgctcgtaggaacgcacgcctaccaactagttacggggaaataatttagtgtacttccggttacggtaaccagtacgtaccggttacccgaacgggaacccggccccagtaccttcctactacgtttcaagtacgaaactaaacgtaaccgaaggaccgtacgtaccgaaggtacgtaccttccgacgtaccgttactttcgtactcggaccttaccgtaacgtcctacggtaccctaccgtcgacccgtacccccggtacccgtccgggacccctaacgttaccccggaacccccgggtatacccccgaaaggggtacccggggtaacgggggaaccgtaaccgggtaccctttaaacgttttaaccggttaaccggtacgggtaacccgggtaaacttaagggtaccggggttaaccctacccggtaccgggtaaccggttcggggttaacgggtttcgggttaccgggttaacgggggtttacggggtttaccgggggttacccggggggaaacccgggggtaaaccggggttaaaccccggtaaccggggttacccggtttaccccgggggtaaaccccgggtttttaccccggggaaaccggggttaccccggttaaacccggggacccccgggtttaaaccgggtccccccggggtttaaccccggggtttaccccccgttacccgggggtttaaacccgttcccccggtttttacccccgggtttcccccgggttaccccccccgtttcccccgttaaccccgtttccccggttttaaaccccggttcccccggtttaaccgggttcccccgg

SEQ ID NO: 77584 - DNA, 823 bp, Homo sapiens
  misc_feature: GYAE6OF01BUMOB.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttagacgcagcccgccctcagtgtctgccggccccaggacaagaaagtcaccatctcctgctcgtaggaagcagcctaccaacgtagttaggggaaagtaatttatcggttaacgtccggttacgggtaacccagaccgtaaccggttaccccgaaacggggaaccccggccccccgaagtacccttccctactaacttacaattacgaaactaaaactaaccgaacggaccgtaccgtacccgaaggtaaccgtaactttcccgacgtaaccgttacttttccgttccgtacgggtaccttaccggaaacggttccgtacgggtaccctaccgtccgaaccgaccccctacccggtacggaccctaccgttaccgaaccccggtaccgtacccgaacgggtaccgggtacgggggaacgaccgggacccgttaatttaaccgttacggcggaaccggtagtacgggttacgggtacttaccgaacggtccgttagggtacgggttgggttcgtacgggttacggggttacggtacggggacgggtaaaccgggacccgtaaggtccggtaaccggttacccggtacgttacgggaccgtaccggacccggtaggcccggttacccggtcccgtacggtcctaccgtcccgttacctcccccctactccgtacctcgtcctccgtaccg

SEQ ID NO: 77585 - DNA, 742 bp, Homo sapiens
  misc_feature: GYAE6OF01AI0DK.49.81.H04.1.454.CMB.1.raw
  modified_base (661)..(661): a, c, t, g, unknown or other
  misc_feature (661)..(661): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagtatgtagacacgtccggatcgacccagtccacctactcccgtcctggtctcgctacttctaggtacggacgaaccaagaacttccaaacctactacctacgttacggcccgacgggaccgtacttaccgagggtaaccttaacgttaaacgaaccttaaacgtttaatttaaacggttcggtaactacgagaccaaacggaaaccgaacgggaacctacccccgtaactcgaataccgtactacgacgtacgactactacgttaaacggttacgaaagtaccgggtacagtacgtaacgttacgaggtaagggtaatcggaagttcggtacggttaacttttaacttaacccttacgactactactacgaactaaccgtgactacgtcgtaaggtaatgtacgtaacacgtaaactagtttaacctactagtaacaaactagtttaagaactttaacacgttaaccctaacgttaccgtaaccgttaccggtaacgggaccgggtaacctacggtaacgggtaaanaccgtaattaaccggaaaggtcgttacggacggtaccttagacccctaagttccgttacttccgttactcccgtttaaccg

SEQ ID NO: 77586 - DNA, 974 bp, Homo sapiens
  misc_feature: GYAE6OF01BN7N0.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctggccggacccaggacagaaagtcaccatctcctgctctggaagcacgcctaccaaactagttagggaaagtaatttagtgttaattccggtacggtacccaggtcctacggttaccccgaacgggaaccccggccccccaaggacccttaccctactaactttccaatttacggaaacctaaaacgttaaaccgaaacggaccgaacggttacccccgaagtaacgtacgtttcccgtacgtaacccggtactttccgtaccgtcgggtacccttaccgtaaacgtcggttaccggacctaccctccgaccggcccctaaccccggtcgggtacccctaacgtccccgaaccccgggtacccttacccgaaacgggtaccggggttaccggggggaaccggtaccggggtacccggtttaaacgttttaaccggtttaaccggaaccggggttaaccggggtaaaacctacggggttacgggggtttaaaccttccccgggtaacggtttccccggttaaggtaacgggttttcggggtacggtttcccgggtaagggggtttccgggttaccgggggaaccgggggtaaccgggtaacccgggtaagggtaccccggggtttaaggtaacccccggggtttacccggttaggggttaaaccccgaacccggggtacccgggtaaacggggtacccgtccccggggttaccccccttcggggttaccccgtttaccgttccccgttccccgggtttacccccctacccccggtttcccttcccgtttaaccccttccggttaaccccgttccccgg

SEQ ID NO: 77587 - DNA, 903 bp, Homo sapiens
  misc_feature: GYAE6OF01DAIJV.49.81.H04.1.454.CMB.1.raw
  modified_base (153)..(153): a, c, t, g, unknown or other
  misc_feature (153)..(153): n is a, c, g, or t
  modified_base (186)..(186): a, c, t, g, unknown or other
  misc_feature (186)..(186): n is a, c, g, or t
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcacgcccgccctnagtgtctgccggcccaggacagaaatcacatcnctgctngancngctacanagtaggaatattangtagtcgtcggtacagctacgtaccgaggaaccggccccagcctactactattacatacgaactaaactaacgagtacggtacgtcccgaagtacgtacttccgtacggtaccgttactttccgtacgttacggtacctacctaaacggttcgtacggtaccctaacccgtcgtaacccgtacccgtaacccccgttcgggacccttaaccgtacccggtaaacccccgggttaccctaccgtaaccggggtaacggggttaccgggggaacccggttacgggggtaacccgtttaacggttttaaccgtttaaccggtaccggggtaaacccgggtaaaacccgttaacgggttaacgggggttaaaccctttacccggtaacgtcccggtttaaggggtaaccgggttgggtttaccgggttacgggttaacgggggtttccgggggttccggggaacggggtaaccggggtaaaccggtaaccggttccggtaccgggtaacccccgtttaacccgggttacggtacccggaaacccggtaaccgggtaacccgggttcccgggtttaccccggacccccgggtttacggtaccccgttaacccgtttccccggttacccggtttacccccccgttccccttacccttttacgttccccgtttaccccggtaccttcccggg

SEQ ID NO: 77588 - DNA, 713 bp, Homo sapiens
  misc_feature: GYAE6OF01CLQF8.49.81.H04.1.454.CMB.1.raw
  modified_base (208)..(208): a, c, t, g, unknown or other
  misc_feature (208)..(208): n is a, c, g, or t
  modified_base (552)..(552): a, c, t, g, unknown or other
  misc_feature (552)..(552): n is a, c, g, or t
  modified_base (669)..(669): a, c, t, g, unknown or other
  misc_feature (669)..(669): n is a, c, g, or t
tcagagtcgagagacacgaccggtgctcgatttagtagtgtagattcgcgggggagtcccaaccaggacacagcatggacatgagggtccctgctcagctcctggggctcctgctgctctggctctcgagggtcgaccagatggtacgacacgtccgggatcgacccagtcctccacttccctccctgtctgctattcgtaggagganacagactccacatcctacgttcgaccgaggcctacgtacgaggactagttacgaacttaaacgtttaagttttaacgtcggttaactacgaacgaaccgaaaacggtaaaccggaaacgggtaaacccctaccccttaaccgtccgttaaggtacctaacgtacgaatcgactaacgtttacctaaggtttaacggaacggttaccgggtacctagtacggtaacggttacgaggtacggtacgtaggcgttacggtacggtttaactttagtttactaccactatacttactaccgtactcggtactacggtcgtaggaagttacttaggtacaacttaactnttaacgttactagtaaactaattaatacgtaactaataaccgttaccttacgtaaccgttcggttacggtacggtacggacggtaaccgtagggacgtacagttaaacggcgttacnggtacctcgaccgtactcttaccgtgttacccttctcgtacccg

SEQ ID NO: 77589 - DNA, 695 bp, Homo sapiens
  misc_feature: GYAE6OF01BENQ0.49.81.H04.1.454.CMB.1.raw
  modified_base (438)..(438): a, c, t, g, unknown or other
  misc_feature (438)..(438): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatcgacccagtctccattcctccctgtctgcatctgtaggagacagaactcacctatcacttgaccgaggcctactcgaggactagttacgactaacttaatttaaagttggtatcgacgtacaaacgaaaccgaacgggaaacctacccctaacctcgtacgacgttactaacgtatacgactacttaccgtaagtttacggaaacgttacgggtacctagtacgtaaggttacgaggtaggagtaggtacgtggtacggttaacgtttaacttttacttaccaacgtntaccgattaccgtactcgacgtacgtacgtacggtaagttgtaacgtaatacgaaacttaactacttaacgtaacgtaactaaactacgttataacgtaactaacttacccgtaactacgttaccgttacggttaccgggacgggtacggtaccggtagggtacgtaacgacgttaaaccgaaacggtaccgttagggtaaccggcttaacggacccttaacgtacttacgtttacgtttcccgttagttacccccg

SEQ ID NO: 77590 - DNA, 705 bp, Homo sapiens
  misc_feature: GYAE6OF01EOMWL.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctggccggccccaggacagaaagtcaccatctcctgctcgtggaacgcacgcctaccaaactagttagggaaagtaatttatgtactcggtaggtaccagtctacgttcccgaacggaacccggccccagtaccttcctctacttcagtgaacaaataacaacgtacgtacgtacccgaggacgttacttccgacgaccgtactttcctcgtcggtacctacgtaacgtcgtaccggccacccgtacaaccgcccctacccgtcggaccctacgtacccgaacccggtacctccgacggtaccggtcgggggaacctacgggtaccgtaatttacgtacgtacggaaccgtaacggtacgtacgggtacttacccgacgtaccgtggtacggttggtcggtcggtaggggttcggtccgggagggaccgggacaggtaccgtacggtcccgtccggtagtccgacgtacccgaggtccgtccggcccgttcggtactcctccgttccccgtacccccgtccgttacccttccgtccttccgaccgttcg

SEQ ID NO: 77591 - DNA, 759 bp, Homo sapiens
  misc_feature: GYAE6OF01ERWF4.49.81.H04.1.454.CMB.1.raw
  modified_base (154)..(154): a, c, t, g, unknown or other
  misc_feature (154)..(154): n is a, c, g, or t
  modified_base (557)..(557): a, c, t, g, unknown or other
  misc_feature (557)..(557): n is a, c, g, or t
tcagagtcgagagacacgaccggtgctcgatttagtagtgtagattcgcgggggggacaatcttcatcatgacctgctcccctctcctcctccacccttctcattcactgcacagggtcctcgggcccagtctgtgttgacgcagcccgccctnagtgtctgccggcccaggaacagaaagtcaccatcctcctgctcgtggaagcagcctaccaaacgtagttaggggaaataatttagtgtactcggtaggtaccagtcctacggtcccgaaacggacccggccccaacgacctcctcattccactagaactaaacaaccgaaagcgacgtccgaagtacgtactacccgtgacccgtacttacctcgtcgggaccttaccgacgtccgtacggcctaactaccacgtcccgacccgttacgggacccctaacgtccgaaacccggctacccgaggtaccgggtaacgggggaccgctaacgggttacccgtaagttacgtaaccggtaacgacggttaaacgggacttcggaacgttcccctagggtcccgttntggggtaacgttccggtaggggtaccggttacggggttccggtacggggacccgtaaacgggaccgtaagggtaccctacggtaccgggtaccgtaacggcccggtaaacgggtccccgacgggtccccttcgggtacccgtccgttcccgtaccgtttccccgacccctttccccgccccgtcccttccgttccgtacccg

SEQ ID NO: 77592 - DNA, 816 bp, Homo sapiens
  misc_feature: GYAE6OF01BFR55.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctgccggccccaggacagaaagtcaccatctcctgctctggaagcagcctaccaactagttagggaagtaattatggtacgtcggtaggtaccagtcctacggttacccgaggaacccggcccccaagtaccttcctactactttacattacgaaacctaaactaaaccgaaggtccggtaacgtaccccgaaggtaacgtactttcccgtacgtaaccgtactttaccgtacgtcggtacctaccgtaagttccgtcggtaccctacccgttacgaccgtacccctacccgtcggacccctaacgttaccccgacccggtacctacccgaagggtacccggtacgggggtaaccggtccgggtaacccgttaacgttttaacgttaccgtacgggaacccgggtaaatacgggttacgggtaaccttacccggaacggttcccggttagggtacggtttacggggttacggtaccgggttagggttaccgttacgggaacggggtacccggggaacgggtaaccgtaacgggttcgtaacccggtaccggttcccggtaaggcccgtacggacccgacgggtcccgtcccggtccccgtcggtccttaccgtccgttaccccgttccccgtcccttaccgttccctccgtccgtaccg

SEQ ID NO: 77593 - DNA, 697 bp, Homo sapiens
  misc_feature: GYAE6OF01A83MU.49.81.H04.1.454.CMB.1.raw
tcagagtcgagagacacgaccggtgctcgatttagtagtgtagattcgcgggggagtcccaaccaggacacagcatggacatgagggtccctgctcagctcctggggctcctgctgctctggctctcaggtgccagatgtgacagtccggatcgacccagtcctccatcctccctgtctgcatcgtggtaggagacaagaactcaaccatcctactcgaccgaggcactcgaggtactagtagacttaacttaatttaaagttggtactcgtaagaccaaacggaaaccgaagggaaaccctaccccctaaaccctccgtaagtactacgtaacgatcgactacttacgtaaggtttaggaaacgtacgggtacctagtacgtaaggttacgaaggtaggtaagtaggtacgttacggtagggttaacgtttacttttaccgttaccaccgtactactacgtaacctaccgtcggactaaccggtaccggtaggtacggtaacttacgtacgtaacctaattattaacgttacgtacgtaacctaagtaagttataacgtaacttactacctacctaacgttacgtaccggttacgggacggtaacgggaccgagggtacgaaggtacctaacgtaaacggtgtacggtcgtacgaccgtaccttacgtacgttcgttacgttcctacgttaccccg

SEQ ID NO: 77594 - DNA, 698 bp, Homo sapiens
  misc_feature: GYAE6OF01DIHGX.49.81.H04.1.454.CMB.1.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
  modified_base (313)..(313): a, c, t, g, unknown or other
  misc_feature (313)..(313): n is a, c, g, or t
  modified_base (660)..(660): a, c, t, g, unknown or other
  misc_feature (660)..(660): n is a, c, g, or t
tcagagtcgagagacacgaccggtgctcgatttagtagtgtagattcgcggggagtcccaaccaggacacagcatggacatgagggtcctgctcagctcctgggctcctgctgctctggctctcagggtgccagatgtcgacatccggatcgacccagtctccatccctcctgtctgctagtctagaggagacagtaactcaaccntcacttgccagcncctagagaactnttacggactaaacttattaaagttggtactacgagtacgaagtaaaccgagggaacctaccctaactctagtactacacgtntagtactatactaaggttagaacggtacggtacctaagtacgtacggtactaggaggtagtacgacgtacggtacggttaacgttacttttacgtacgaaccttagtaccgtactaaccgtacgtacgtaccgtagtaccgtgggaaacttcgtttaacgaacggtaccaaactacgttttaacttaaaccggtgttaacccaacggtttaaatacggttataaaccttagtacccgtaaccttcgttaacccgtaacgggttacccggggtacgggtaaccggtaacggtacccggagggttaaaccacggtttaaacgaaaccgttggcggttacgaccggttanacccgttccgtaatccgtttacgtccttcgtaaccccg

SEQ ID NO: 77595 - DNA, 612 bp, Homo sapiens
  misc_feature: GYAE6OF01D5ON6.49.81.H04.1.454.CMB.1.raw
  modified_base (99)..(99): a, c, t, g, unknown or other
  misc_feature (99)..(99): n is a, c, g, or t
  modified_base (120)..(120): a, c, t, g, unknown or other
  misc_feature (120)..(120): n is a, c, g, or t
  modified_base (150)..(150): a, c, t, g, unknown or other
  misc_feature (150)..(150): n is a, c, g, or t
  modified_base (190)..(190): a, c, t, g, unknown or other
  misc_feature (190)..(190): n is a, c, g, or t
  modified_base (243)..(243): a, c, t, g, unknown or other
  misc_feature (243)..(243): n is a, c, g, or t
  modified_base (245)..(245): a, c, t, g, unknown or other
  misc_feature (245)..(245): n is a, c, g, or t
  modified_base (339)..(339): a, c, t, g, unknown or other
  misc_feature (339)..(339): n is a, c, g, or t
  modified_base (600)..(600): a, c, t, g, unknown or other
  misc_feature (600)..(600): n is a, c, g, or t
  modified_base (606)..(606): a, c, t, g, unknown or other
  misc_feature (606)..(606): n is a, c, g, or t
tcagagtcgagagacacgaccggtgctcgatttagtagtgtagattcgcgggggggacaatcttcatcatgacctgctcccctctcctcctcacccttntcattcactgcacagggtccngggcccagtctgtgttgacgcagccgcctnagtgtctgcggcccaggacaagaaagtcacatctctgctntagaacgctagcctacaaagagttgggaaagtaattatgtaatcgtggaaccngnacgtcccaaggaaacggtccccaagcctactcattcgaactgaacaaataaacaagtcgaacgtccgaagtagtacttcacgaccgtacttctntcggactactaacgtctgaccaccttcacgccaaccgtggctaactaccgaccgacgtccaggtaaccgtagggaccgagccgtaagttacgtacgtcggaaacggaacgtacgtaacggtacgttacccgtagtaccgtggacggtgttacggtcggtaagggttcggttacgggagggtacggaacccgaagtccgtgaaccgttcgagtaccgagaccgagcgtcgcctacgtctacggcctaccgtcccgccttctntccttncgtacg

SEQ ID NO: 77596 - DNA, 815 bp, Homo sapiens
  misc_feature: GYAE6OF01AJ2GB.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacgagggtcctgggcccagtctgtgttgacgcagcccgccctcagtgtctcggccggcccaggacagaaagtcaccatcctctgctcgtaggaacgcacgtcctaccaactaggttacggggaaataatttagtagttacgtcggttacggtaccacgtcctaccggttacccggaaccgggaaccccggcccccgtaagtacccttccctactacttacacgttacgaactaaactaaccgaacggccggtaaccgtacccgaagtacgttaccttaccggtaccgtaaccgttactttccgttcgttaccggtacccgtaccgtaacgggttcgtaccgggacctacccgtaccgacccgtacccgtaccccgtcggtaccctaccgtaacccggtaccccggtaccttacccggaacggtaccggggtacggggaaccgtaccgggtaccgttaatttaccggtacgacgggaaccgtaacgtagggtacgtactccggacgtcgtaagggtcggtcggtacgtcgggtgggtccgggttcgggacgggtaaccggacgtaacggtccggtaaccggtaccgtacggtacgaccgcccggacggtaccggcccgttcccgggccgttccggtaccttcccgttacccggtccccgtttccccgtacccttccgttaccccgttcctccgttacccgtccggg

SEQ ID NO: 77597 - DNA, 530 bp, Homo sapiens
  misc_feature: GYAE6OF01BDZ1D.49.81.H04.1.454.CMB.1.raw
  modified_base (352)..(352): a, c, t, g, unknown or other
  misc_feature (352)..(352): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaaagtcaccatctcctgctctggaagcagctccaaacattgggaaagaattatgtaatcgtggtaccagcagttcccaggaaccggccccagactcctcattcatgaacaataacaagcgagtcccaagagattccctgaccgattctctggctccaagtctggcacctcagccaccngccatcaccgactccagactgggacgaggccgattatactgacggaacagtagggacttccgagcctgagtgtgtcgagggtgttcgggcgagggacagctgacgtctaggcagaccaaggctcggcccctgggtcactccgtcgttccccacccgttccctctcctctcgtaacccg

SEQ ID NO: 77598 - DNA, 731 bp, Homo sapiens
  misc_feature: GYAE6OF01BIIJA.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtcgccagatgtgacagtccggatcgacccagtcctcctactcctccctgtctgccatcgtggtaggacgacagaactccaacctatctacgttcgaccgacggtaccactcgaacggtaactattacgaacttaaactttaagttttaaacgttggtactacgaacggtaaccgaaacggtaaaaccggaaacggtaaacccgtacccccgttaacctccgtaagaccttacgtacgactcgactactaccgtaagttaacggaacgtcggtactagtacgtacgtacgaggtacggaatcggtaagtcgtacgggttactttaacgtttctaaccgtacgtactaccgtactaccgtaacgtgtaccgtacgtacgtaaggtacgtacgttaacgtacgtaactaacttacttaacgttaacgtactataaacgtaacttataccgttaattaacctacctaaccttaccgttaccgtaacgggttcccgggaacggtaaccggtaccggaagggtaacgtacgtaaaccgttaaacgaacgtcggttacgggcgtaccttacgaccttacgtcttaacgttcgttaacccttcggttccc

SEQ ID NO: 77599 - DNA, 753 bp, Homo sapiens
  misc_feature: GYAE6OF01E5EAI.49.81.H04.1.454.CMB.1.raw
  modified_base (275)..(275): a, c, t, g, unknown or other
  misc_feature (275)..(275): n is a, c, g, or t
tcagagtcgagagacacgaccggtgctcgatttagtagtgtagattcgcggggagtcccaaccaggacacagcatggacatgagggtccctgctcagctcctggggctcctgctgctctggcctctcaggtgccagtatgtgacatccggatcgaccctagtctccatccctccctgtctgacatcgtaggtacggagacagaactccaaccattccgaccttggccgaggccgactcgagggactattagcctaaatattttaaagtcggttanacagactaacggaaaccgtagggaaacctcccctaaacccgtcctaggtactacctacgtactacgacacgtttaaccgtaaagttttacgggaaaaccggtttccgggggtaacccctaagtaccgttaaacggggtttccgaagggttacggggaaggttggtacgttacggggttaacggggttacttttaacgttttttacttcccgaaaccgtacttactaaaccgttaccctaaacccgttcggacccgtaccggtaccgtggtaacgggttaactttaacgttacgacttaaactacgttaacttactacgtacctaaatacttagtacgtaatacctaactacccaccgttacttacgggtaccgggtaccggagggaccggtaggtacggaacgtaacgttaaccggaaccgttaagttcggacggttccgaccgtactaactcgttacctcgtttaccttcgtacccg

SEQ ID NO: 77600 - DNA, 986 bp, Homo sapiens
  misc_feature: GYAE6OF01CKB17.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctggtgttgacgcagcccgccctcagtgtctcggccggccccaggacaaggaaacgtcaccatcctcctgctcgtggaagcagcctaccaaatagttaggggaaataatttagtagttagtccggtacggtaccagaccgtacgttacccggaacgggaccccggcccccaagtaccctcctactactttaccagtacgaaactaaactaacgaacggtccgaaccgtacccgaagtacgttaccgttaccgtaccggtaaccgttacgtttccgtaccgggtccgtacccgttaacccgtaacggtttcccggtaccggtaaccccttaccgacccgtaccccggtacccccgtaaccccggtacgtaacccctaaccggtaccccggaaaccccgggttacccctaccgggaaaccgggttaccggggaaccggggggtaacccggtaaccggtacggttttaaaacgtttaccggttaaccggtacgggaaaacccggggtaacttaacggggttaccgggtaaccttacccgggaccggttcgggttaggtacggggtttacgggttaccggggttacggggttacgggggtttacccggggttaccggggagggggttaaaccccggtaccggtaaacgggttccccgggttacgggttaaccccgtaaccgggttacccggaaccgtaccccgggtaaacccgggtacggggtcccccgtttaaccccggggtcccccggtttacgggttaccccttcccccggtttaccgggtttccccccgttacccccccggtttcccgttccccccttaacggttttccccgtacccggttacccgggttaccccgg

SEQ ID NO: 77601 - DNA, 730 bp, Homo sapiens
  misc_feature: GYAE6OF01BCC7B.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagcctaccaacagttagggaagtaattatgtatcgtggtaccagcagttccgaggaccggccccagacctcctctattcatgaacaataacaagcgacgtcccagagtacttccgtagaccgtactttctcgtcggtcctaccgtaagttcgtcggccaccctcgacgcccacccgtcggacccactccgacccggtacctccgaaggtaccggtacggggaccggtacgggtaccgtaagttttaacgttaccgtacggaccgggtaaactagggttccggggtaacttcccggaaggtcccgttagggtaacggttcgggtcggttacgggttacgggggttacgggttccggggaaccggggtaacggggaacccgaacgggtccgttaccggacccgttaccggtaggtaccaccgggacccgaagggtcccgttacccgggtcccccttacgggtccctaccgttcccgttccccggttccccccgtccccttacccgtttccctccgttcccgtccgttacccg

SEQ ID NO: 77602 - DNA, 634 bp, Homo sapiens
  misc_feature: GYAE6OF01C649W.49.81.H04.1.454.CMB.1.raw
  modified_base (137)..(137): a, c, t, g, unknown or other
  misc_feature (137)..(137): n is a, c, g, or t
  modified_base (194)..(194): a, c, t, g, unknown or other
  misc_feature (194)..(194): n is a, c, g, or t
  modified_base (443)..(443): a, c, t, g, unknown or other
  misc_feature (443)..(443): n is a, c, g, or t
  modified_base (459)..(459): a, c, t, g, unknown or other
  misc_feature (459)..(459): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtcgccagntgtgacagtccggatcgacccagtctccatccctcctgtctgcatcgtaggtagganacagaactccaaccgtatcacgttcgccgaggcctactcgaaggactagttacgactaaacttattttaaagttggtactacgaagaccgaaagaaaacccgaagggaaaccctaccccgtaacctcgtacgtactacgtacgtatcgacacgttacctaagttacggtaaacgtcgggtaccctagtacgtagtacgaggtagagtgatgtaggtacttatttacgtcaactgtacagtacctacgtncctagccgtagacgtntactcaacgtaatagttacttacgtataacgtaataacgttagtataattacctaaccgtactacgtacctacgggttccggacggttacggacccgtaggtacgaacgttacgaaaccgtaacgacgttggtcggtacctccggactaccgtacttacgtcctctccgttcccg

SEQ ID NO: 77603 - DNA, 908 bp, Homo sapiens
  misc_feature: GYAE6OF01C0DYG.49.81.H04.1.454.CMB.1.raw
tcagagtcgagagacacgaccggtgctcgatttagtagtgtagattcgcgggggggacaatcttcatcatgacctgctcccctctcctcctccacccttctcattcactgcacagggtcctgggcccagtctgtgtgacgcacgcccgccctcagtgtctcgccggaccccaggacaagaaacgtccacctatcctcctgcctcgtaggaacgcacgtcctaccaaacgtaggttaagggaaagttaaatttagttagtacgttcggtacggtaaccaggaccgtaccggttaccccggaacgggaaccccggcccccgaacgtaccctcctactacgttacaatacgaactaaactaacgacggaccgtaaccgtaccccgaagtaaccgttaccgttaccgtaccggtaacctacgtttccgtccgttacggacctaccgtaacgttccgtcgtacctaccgtaccgacccgtaccccgaccgtcggaccctaccgtacccgaacccgtaccgttaccgaacgggtacggtacggggaccggtacggtacccgttaatttaccggtacgtacggaaccggtaacgtacgggttacggtaccgtaaccgtacgggttccggtagggttacggtagggttccggttacggggtacggggtttcgggtaccggggaacgggtaaccgggtaaccggtaacggtcccggttaccggtaaccggtttaccggtaccggtaacccggtaaccggtaaccccggaccggggtttacccgtcccccggggttacccccgttaccgggttacccgtccccggtttaccccgggttttaccccccggtccccccgtttaacccccgttttcccgttaccccgtttaccccgttcccggtttcccgttaaccccggg

SEQ ID NO: 77604 - DNA, 681 bp, Homo sapiens
  misc_feature: GYAE6OF01A1ANH.49.81.H04.1.454.CMB.1.raw
tcagagtcgagagacacgaccggtgctcgatttagtagtgtagattcgcgggggggacaatcttcatcatgacctgctcccctctcctcctccacccttctcattcactgcacagggtcctgggcccagtctgtgttgacgcagcccgccctcagtgtctgccggcccaggacagaaatcaccatctcctgctcgtggaacgcacgcctaccaactagttagggaaagtaattagtgtagtcggtggtaccagcctacgttcccgacggaacccggccccagacctcctcacttcatacgaacaactaaacgaacgacgaccgtacccgaagacgtacttaccgtcggaacccgtattccgtcgtcggacctaccgtaacgttccgtcggtcccacccgtaccgaccgccccgtacccgtcggcccctacgtaccgaacccggtacctaccgaacggaccgggtaggggaaccggacggtaccgtaatttacgttacgacggtacggaactaggtcgtacctccgagtccgtagggagttcggtgtcggtacgggtcgttacggggcgggaacggacgacgtacgtacggaccgttacgtacggaccgacgaccgacggtccgtacccggcccgtacgtcctcgtccgtcccgtccccgtcctcctcctctccgtcgtacg

SEQ ID NO: 77605 - DNA, 756 bp, Homo sapiens
  misc_feature: GYAE6OF01ALHLA.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacgagggtcctgggcccagtctgtgttgacgcagcccgccctcagtgtctgccggccccaggacagaaacgtcaccatctcctgctcgtggaagcagcctccaacagttgggaagtaattatgtagtcgtcggtaccagcacgttacccgacggaacccgcccccagtacctcctctacttacagtagaacaaataaccgaacgcgaacgtcccgaagtacgtacttccgtacggaaccgtactttcctcgttcggtccttacccgtaagttccgtcggccctacccgtcaacccgtcccctaaccccgtcggaccctacgtaccgtaaccccggtaaccctaccggaaccgtaaccgggttacgggggaacccgggtacgggtacccgttaaacggttttactttaccgggtcggaaccgggtaaacgtggttaccgggtactacggcgtaccgtacggtggttagggtcgtacgggtaggttccgggtaccggggaggacggtaccgaagtccggtaccgtacccgttgtaccgtacggaccgtacccgagggtcccgtccggcccccgttgggtacccttaccgttcccgtttacccgacccccgtttacccctccttcccgtcccttcccgttccgtaccgg

SEQ ID NO: 77606 - DNA, 780 bp, Homo sapiens
  misc_feature: GYAE6OF01BDB6N.49.81.H04.1.454.CMB.1.raw
  modified_base (84)..(84): a, c, t, g, unknown or other
  misc_feature (84)..(84): n is a, c, g, or t
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
tcagagtcgagagacacgaccggtgctcgatttagtagtgtagattcgcgggggggacaatcttcatcatgacctgctcccctntcctcctcacccttctcattcactgcacagggtcctgggcccagtctgtgtgacgcagccgcctcagtcgtctgccggccccaggacagaacgtcaccatctcctgctcgtggaancagcctaccaatgttgggaatattatgtactcggtggaccngtctacgtcccgaggaccgccccagacctcctcattacatacgaacaactacaacgcgacgtccaggactacttccgagaccgtattccgtacgttcggaccttaccgaacggttccggtacggtaccctaacccgttacgaacccggtcccccgtaaccccggtcgggaacccttaccgtacccggtaaccccggggttaacccttacccggaacgggttaacccgggttaccggggggaaacccgtaaccggggtaccccggtttaaattttaaccgttaaccgggtacggggtaaacccggtaaaacccggtcggtttaacggggtaaacctttcccgaacggttaccgtacggggttacgttcgggtacgttacgggtaggggttttcggtacccggggacgggaacggtaacccgtaggtccggttaccggacccgttccgtaggtaccgacgggtacccgagtcccgtcgggccccttggacctacgtccgttccccgttcccgacccttcctccgtcccttcgttcccgacg

SEQ ID NO: 77607 - DNA, 806 bp, Homo sapiens
  misc_feature: GYAE6OF01CVNND.49.81.H04.1.454.CMB.1.raw
  modified_base (195)..(195): a, c, t, g, unknown or other
  misc_feature (195)..(195): n is a, c, g, or t
tcagagtcgagagacacgaccggtgctcgatttagtagtgtagattcgcggggagtcccaaccaggacacagcatggacatgagggtccctgctcagctccgtggggctcctgctgctctggctctcaggtgccagatgtgacatccggatcgacccagtcctccactccctcctgtctgctatcgtagtagganacagaactccaaccatctacgtcgcgaggccgactacgagactagttacgaactaaacgtttaatttaaagttggatacgaacgaacgaaaacgtaaaccggaaaccgggtaaaccctacccccgtaaccgtccgtaagtaacttaccgtacggtactacgaacctaacgttaaccgtaaggtttaaacgggaaaaccggttcgggtaccctaagttaccgtaaggttacgaggtacggaggtacggtcgtacgtaggtaacgggaactaaggttactaccgtaccttccgaaccaacgtctaacgtacgtaccgtaacgtcgtaacgtacctaaccggtaaagttaacggtttaaacggtttaacggtaaacgttacgtttaacgtacgttaccgtaaaaggtaacggttaaaccgggttaagttaaaccggtttcgttaacccgttacggtttacgggtttacgggtaaccggggaacgggttacggtaaaggggtaaacggtaacggtaaacgtaacgtaaaagggtccggttaaggtaccggtacgtaccgaacccgttaacgttacgttaaccgttagtttaacccctcgttcccgttaaccccgg

SEQ ID NO: 77608 - DNA, 810 bp, Homo sapiens
  misc_feature: GYAE6OF01BTO1I.49.81.H04.1.454.CMB.1.raw
  modified_base (187)..(187): a, c, t, g, unknown or other
  misc_feature (187)..(187): n is a, c, g, or t
  modified_base (192)..(192): a, c, t, g, unknown or other
  misc_feature (192)..(192): n is a, c, g, or t
  modified_base (760)..(760): a, c, t, g, unknown or other
  misc_feature (760)..(760): n is a, c, g, or t
  modified_base (771)..(771): a, c, t, g, unknown or other
  misc_feature (771)..(771): n is a, c, g, or t
  modified_base (786)..(786): a, c, t, g, unknown or other
  misc_feature (786)..(786): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctcctgtctgcatctgtagganacganaatcacatcactgactgacgactcgaggactagttacgactaaacgttaatttaaagttacggtactacgaacgtacgaaaacggaaacccgaaacggggtaaaacccgtcccccttaaaccgttaccggtaacgtaacgttacccgtttaacggaactttacggaacccttaagtttaaacccgtaaagttttaagggaaaaaccggtttaaccggggtaccccttaaagttaccgggtaaaggttacccggtaaggttaaccggggtaaaggttacgggaaacgtttcggttacgggggttaaaccttttacgttttaaaccgtttacgaaaccctatttaaccaaacgttacctaaaccgtttggaacctacgggtactacgggtaaaggttaaccttaagtacgaaacctaaatacgtttaattaccgaacgtttaacaaaccgtaaattacggtaattaaacgtaacttaccctaaccgtcttaaccgtaccggtttaacgggacccgggtaaggacccggttagggtaacgtaacgtaaacggtaaccgaaacgggttacgngttaacccggntaccgacaaaccctntaccggtttctacgttctaacccg

SEQ ID NO: 77609 - DNA, 759 bp, Homo sapiens
  misc_feature: GYAE6OF01DGWRJ.49.81.H04.1.454.CMB.1.raw
  modified_base (198)..(198): a, c, t, g, unknown or other
  misc_feature (198)..(198): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggcccaggacagaaagtcacatctcctgctctggaancagcctaccaaacgtagttaggggaaataaattatgtaatcgtggtaaccagcacgttcccgaaggaaccggccccaagacctcctacattcatagaacaaataaacaagcgtaacgtacccaaggtacgtacttccgtagaccgtattctcgtcggacctaccaagtctggaccactcgaacgcccacccgtgaccctataccgaccggactaccgaggtaacgtcgggggaacacggtacccgtaatttacgttaaccgtggaaccggtaaacgagttacgggtaaacttcccgaaggtccttagggtaatttcgggtagttacggtaacggggttcggtttacggggaaccgggtacggggaaacccgtaaagggtcctaccggggtaacccgttaccggtacgggtccgaaccggtaaccccggaaagggttcccgtacccgggtaccccccgttaggggtttaccccaaccggttttacccgttaccccgtttaaccccccgtaacccccgtttccctttaccgtttaaccccttccccgtttccggtaaaccccg

SEQ ID NO: 77610 - DNA, 613 bp, Homo sapiens
  misc_feature: GYAE6OF01D2RVH.49.81.H04.1.454.CMB.1.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacagtccggatcgacccagtcctccatcctcctgtctgcatcgtgaggacanagaatccacatctactgaccgaggcacncgagactattacgactaacttatttaaagttggtatacacgacgaacgaaaccgaacggaaaccgtaccccctaaccttccgtagacttactacggtatcgactattacctaagtttaggaaacgtcgggtaccagttcgaagtacgaggtagtagtgattcggtacgggttaacttacttttactacctaactacgttactactaaccgtactacgacgtacgtaccgtagaacgtatactagaactaactagttacttactagtaacaactaatagtatactacgtacctacctacgtcgtacgttacggacggtacgacgtaggaggtacgacgtaacgaacggtagtaggtcggacgtacgaccactacgtacttcgtcctacctcccg

SEQ ID NO: 77611 - DNA, 688 bp, Homo sapiens
  misc_feature: GYAE6OF01BDV3R.49.81.H04.1.454.CMB.1.raw
  modified_base (200)..(200): a, c, t, g, unknown or other
  misc_feature (200)..(200): n is a, c, g, or t
  modified_base (528)..(528): a, c, t, g, unknown or other
  misc_feature (528)..(528): n is a, c, g, or t
tcagagtcgagagacacgaccggtgctcgatttagtagtgtagattcgcgggggggacaatcttcatcatgacctgctcccctctcctcctcacccttctcattcactgcacaggtcctgggcccagtctgtgttgacgcagcccgcctcagtgtctgccggccccaggacagaaagtcaccatctcctgctcgtggaancacgcctaccaatagttagggaaataattagtagtacgtggttcgaaccagtcacgttcccgaacggaacccggtcccccgagaccttcctacattacatgaacaaataaccaagcggactaccaagagtacttccgagaccgtcttacgtcgtgtcctaccgtagtacgtcgacctaacctccaaccgtcccaacccgtcggaccctacgtcccgaacccgcctacggaacgcggtacggggacgaccggtacccgttaattacgttacgtacggaaccgtaagtaagtacgggtactaccgacgtcccgtaggtagtgggttacgnggtaggggttccggtcggggacggtaacgggacagggtaccgtacgacccgttacccggtagacccgacgacccgggtacgcccggttaccggccccggttccgtacgtcccgtcctcccgttacccctcccgttactccgttccctaccgtcgtacccg

SEQ ID NO: 77612 - DNA, 1096 bp, Homo sapiens
  misc_feature: GYAE6OF01BYESJ.49.81.H04.1.454.CMB.1.raw
  modified_base (215)..(215): a, c, t, g, unknown or other
  misc_feature (215)..(215): n is a, c, g, or t
tcagagtcgagagacacgaccggtgctcgatttagtagtgtagattcgcgggggggacaatcttcatcatgacctgctcccctctcctcctcacccttctcattcactgcacgagggtcctgggcccagtctgtgttgacgcacgcccgccctcgagtgtctcggccggccccaggacaagaaacgtccaccattcctcctgctacgtaggaacncgacgtcctaccgaaacgtaggttaagggaaataactttacgtggttaacgtccggttacggtaacccagggtaccttaaccgggttacccccggaacgggaacccccgggtacccccgtaacggtaacccctttcccttaccttaacttaccgtaacgttaaccggaaacctaaaacgtaaaaccgaaacgggtacccggtaaccggtaacccgaacggtaacggttaccgtttaccccggtacggtaaacccggttacttttaccccggtccggttacggtcccctttaaccgtaacgggtttccgtacccgggtaccctacccggtaccgtacccgtacccccggtaacccgttcggtaaccctacccgtaacccggtacccggtaccgtacccggtaagggtacccggggtaacgggggtaaccggaccgggtaccgtttaacgtttacggttaccggtacggaaacccgttaacggtacgggttacgggttaacccttaccggtaccggtaccgggtacgggttacgggttcggggtttacccggggttcggggttaacgggggtttcccgggttaaccgggggtaccgggggtaaccggggtaacccgtaacccgggtccgggtttaaaccccgggttacccggttaccgggttaaccggtaccccggggtaacccgggtaacccccgggtaaccggggtttacccccgggtttaccccgggggtcccccgtttaaccccgggggttacccccgtttaacccgggtttcccccggttttacccccccgggtttacccccccgttccccgttttacccccccggttaaacccgttttcccccggttacccggttaaccccccggtttaacccgggg

SEQ ID NO: 77613 - DNA, 875 bp, Homo sapiens
  misc_feature: GYAE6OF01AOG5J.49.81.H04.1.454.CMB.1.raw
tcagagtcgagagacacgaccggtgctcgatttagtagtgtagattcgcggggagtcccaacaggacacagcagtggacatggagggtccctgctccagctccgtgggctccgtgctgctcgtcggctctcgaggtcaccaggatgtgacgtagtccggatcgaccacgtctaccactcccgtcctggtcctgtaccgcttacgtaggaaggaacgtaacgaacgtaactcctaaccgtataccttacgttacggaccggacgggacctaacggtacggaacggtaccttaagttaccggtaacttaaactttaaagtttaaggttacggtaccttacgacggaaaccaaaccgggaaacccgtaacggtaacccgtacccctaacctcggtaacgacgttacgtaacgtactacggaaccttacgttaacgttaacggttaaacgggtaaaccggttacccgggtaaccttaacggttaaccggttaacgggttaacggaacggggttacggtaaacggttccgggttaaacggttacggggtttaaccggtttaacttttacgttttaacccttacccgtaccgttaacgtacctaccgtaacccggtacgtacgtaccgtacggtaccgttaggtaagttacgtacgtaacgtaaccgttagtaacctttacggtacttaaccgaactaaaccgtttaagtactaaccgtaactttcccttaaaccgtaccttaacccgttaccggttaaccgggtaccgggaacccggttacgggtaaccgggtacggtaacgggtaactaaaccgtaaccggtaacgtaggtacgtacgacctaccgctacgttactaccgttacgtacctcgtaacccg

SEQ ID NO: 77614 - DNA, 884 bp, Homo sapiens
  misc_feature: GYAE6OF01BOCHX.49.81.H04.1.454.CMB.1.raw
  modified_base (203)..(203): a, c, t, g, unknown or other
  misc_feature (203)..(203): n is a, c, g, or t
  modified_base (868)..(868): a, c, t, g, unknown or other
  misc_feature (868)..(868): n is a, c, g, or t
tcagagtcgagagacacgaccggtgctcgatttagtagtgtagattcgcgggggggacaatcttcatcatgacctgctcccctctcctcctcacccttctcattcactgcacgagggtcctgggcccagtctgtgttgacgcagccgccctcagtgtctcgccggacccaggacagaaagtcaccatctctgctcgtaggaanctacgcctaccaagtagttagggaaataattagtacgtagttccggtacggtaccaggtctacggttacccgaagggaaccccgccccaagtcccttacctactaatttaccaagtacgaaaactaaaacgttaacgaacggtaccgaaccgtaccgaagtaacgttacctttacccgtacggaaccttgtttcccgtcgtacgggacccttaaccggtaacgtttccgtaccgggacccctaacccggttacgaacccgtaccccgtaccccggttaggaacccctaccgttacccggaacccgtaccctaaccgggaacggttaacggggtaccgggggtaaccgacgggtaaccgtttaagttttaaaccgtttcgggaaccggaaccgggttaaaacgtcggggttacgggttaaacctcccggtacggacccggtttaagggtacgggtttacggtacggggttacgggttaaccggggtttagggtacccggggaaacggggaacgtaacccgttaacggtccgggttaaccgttacccgggtacgttacggggaccgtaaacccggtacccgggtaggtccccggtcggtacccccggttgttacccggtcgttacccgtttacccgggcccccctttcggaccccttggttaacccncccggttacgtaccgg

SEQ ID NO: 77615 - DNA, 718 bp, Homo sapiens
  misc_feature: GYAE6OF01B3EAT.49.81.H04.1.454.CMB.1.raw
tcagagtcgagagacacgaccggtgctcgatttagtagtgtagattcgcgggggagtcccaaccaggacacagcatggacatgagggtccctgctcagctcctggggctcctgctgctctggctctcgaggtgccaggatgtgacatccggatcgacccagtcctccactccctccctgtctgcatctggtaggacgacaagaactccacactcctacgtcgaccgaggcgtactacgaggactattacgactaacttaatttaaagttggtatcacgtacaacggaaaccggaacgggaacctaccccctaaccgtcctacgtactaccgtacgatcgactacgtacctaaggttacgaacggttacgggtacccatacggtaggtacgtaggtaggtagtaggtacgttacgtacgggttaacgtttacttttactcctaacctactacctactacctaccgtgacctacggtcctaggtagtattacgtactaactaactattaccttatacgtaactaaagtacttaagtacgttaactaaccgttacctaaccgttaccttaccgttaccggttcgggaaccgggtaacgggtaaccgtacgggggttaagaaccgggttaaacgtaaacccgtaaacggtacgttaacgggtcggtaccgtacccggtaccgtaccgttactcggtttacctttccgttccgtttacccccg

SEQ ID NO: 77616 - DNA, 731 bp, Homo sapiens
  misc_feature: GYAE6OF01ACYZZ.49.81.H04.1.454.CMB.1.raw
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
tcagagtcgagagacacgaccggtgctcgatttagtagtgtagattcgcggggagtcccaaccaggacacagcatggacatgagggtcccctgctcagctcctggggctcctgctgctctggctctcgaggtgccagatgtgacatccggatcgacccagtctccactcctccctgtctgctatctgtagganacagacncacntcattgccaggcgactcgaggactattacgactaaacttaatttaaagttggtactacgtacgacaacgtaaaaccgaaggaaaccgtacccccttaacccgtacctacgtactacgtacgacgtacgactaataccgttaaagtttagggaaacgttaccggggtaccctaagtacgtaacgggttacgaaggtagggtaacggtacgggtaacgttcgggttagggttaacttttacgtttttaacctaccgtaacctaacgtacctacgttaccgaaccgtacgtaccgtaccgtacgtacggaaggttaattacgttacgtaaccgtaactaacttaactttacgtaactaactaacgtaacttaactagtaacttaacgtaccctaaccgtaccgttaccgtacgttaccgggaccgggtacggtaaccgtacgggtacgtacgtaactaacgtaaccggtaagttacggtcgtaccggtacgacccgtactacttaccgtttcgttaccttcgttaccccg

SEQ ID NO: 77617 - DNA, 774 bp, Homo sapiens
  misc_feature: GYAE6OF01DBV8G.49.81.H04.1.454.CMB.1.raw
  modified_base (390)..(390): a, c, t, g, unknown or other
  misc_feature (390)..(390): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctcgccggccccaggacagaaagtcacatcctcctgctctaggaagcagcctaccaactagttaggaagtaatttatgtactcgtggtacccagacacgttcccgaaggaacccggccccagacctcctactacttacatacgaacaaactaacaacgcggaaccgtcccaaggactacgttccgtacgaccgtacttccgtcgtcggctacccgtaaggtccgtcggtaccnccctacgaccgaccccgtaccccgtcggaccaccgtacccgaaccccggtccgttaacccgaacgggaccggttaaggggggaccctacggggtaacccttacgtttaccgtttaacgtacggtaaccggaacgttaggtacgggtacttaccgcgtaccgtggtacggtggttcggttacggtggggttacggttacggggaacgggaaccgggtaccgtaacgcggttaccggtaacccgtccgggttacggccgtaacggaccccggtacgggtaccgtccccggggtaccccttaccgggtccccttaccggttcccgttcccccggtttacccccgtcccccttcccgttaacccttcccgtacgttccccgtacccgg

SEQ ID NO: 77618 - DNA, 718 bp, Homo sapiens
  misc_feature: GYAE6OF01AZGZV.49.81.H04.1.454.CMB.1.raw
tcagagtcgagagacacgaccggtgctcgatttagtagtgtagattcgcggggagtcccaaccaggacacagcatggacatgagggtccctgctcagctccgtggggctcctgctgctctggctctcaggtgccagatgtgacagtccggatcgacccagtctccatcctcctgtctgcattctggtaggagacagtaactccacctagtccaacgttcgccgacggccgtactacgacggtaactattacgtacctaaactttaagttttaaattcggtatacgaacgtacaacggaaaacccgacggtaaaccgaccccctaaaccgtcccgttagacctacgtacgaagtcgacctacgttacccgttaagtttacgggtaaacgttaacgggtaccctaagttaaccggaagttaccggaggttacggaaagttcggtacgttcgtacgggtttacgtttaacttttacgtactaactctactacgtaccgtaccgtagacgtcgacgttagaacgttacttagtacctaacgtaaacttaactttacgtaccgtaacgtactaaactaagtaactataacttactaaccgtaacctccgttaaccgtacggttacccggacggtaccgggtacgaccgggttagacggtacaccgtaacgtacggtcgtcggaccgctaacgtaacctcgttacgtccttcttacgttacccg

SEQ ID NO: 77619 - DNA, 760 bp, Homo sapiens
  misc_feature: GYAE6OF01AMHO3.49.81.H04.1.454.CMB.1.raw
  modified_base (187)..(187): a, c, t, g, unknown or other
  misc_feature (187)..(187): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctcctgtctgcatctgtagganacagaatccacatcacttgccaggcactcgaggactattagctaacttattaagttggtatacagacaagaaaccgacggaaactcccctaactcctagactctacatcgactactacctaagtttacggaaacgttacgggtaccctaagttacgtaacggtttaccgaaggttagggtaaaggttcggggtaagttccgggtttaacggggtttaaaccgttttaacgttttttaaccctttacccggtaaacccttaaactttaccgtaaaccgtttacgtaaacccgtttcgacgttaacggtaccggttaggtaaacgggttattacgttaacgaaccttaaacgtactttaagttactacgtaacctaaacgtaagtaacttacgtaaataccctttaactaacccgtacttttaccggaaccgttttacggggaaccggtaaacgggtaccgaacggggttacgaaaccgttaaacgtaacccgtaaaacggtccggtttaacggtcggtaaccgtaccgtaacccggtacttaccgttcgttaaccgtttcctacggtttacccc

SEQ ID NO: 77620 - DNA, 832 bp, Homo sapiens
  misc_feature: GYAE6OF01BZYAD.49.81.H04.1.454.CMB.1.raw
  modified_base (139)..(139): a, c, t, g, unknown or other
  misc_feature (139)..(139): n is a, c, g, or t
  modified_base (253)..(253): a, c, t, g, unknown or other
  misc_feature (253)..(253): n is a, c, g, or t
  modified_base (808)..(808): a, c, t, g, unknown or other
  misc_feature (808)..(808): n is a, c, g, or t
  modified_base (820)..(820): a, c, t, g, unknown or other
  misc_feature (820)..(820): n is a, c, g, or t
tcagagtcgagagacacgaccggtgctcgatttagtagtgtagattcgcgggggggacaatcttcatcatgacctgctcccctctcctcctcacccttctcattcactgcacagggtcctggcccagtctgtgttgacncacgcccgcctcagtcgtctgccggccccaggtacaagaaacgtccaacctctccgtcctgccttcgtaggaacgccacgtacctaccgaaacgtggttagggaaattaaattntacggtttacgacgttacggtaacccagtacctacggttcccgaacgggtaacccgacccccgagtaacccttcctactacgtacctaataccgaaactaaacgtaacgaaacgtccgtaaccgtaccgaaggtactaccgttaccgtacgtaacccgttcgttctaccgttcgtacctacccgtaaggttcgaccggtacccacgttcccgaaaccgtccccgtcccgttcggaaacccctaccggtacccgttacccggaaccctaccggtaacggggtaccggacggggtaaccgtccggtaacttaaccgttacggttaccgacggacgtaaccggtaacggtcggtaactttcccggaacgtcgttggggtacttacgggtcggttaacgggtggggtttacggcggggtacgggtaaacccgtacgggaacttcccggtaacggtcccgtaccgttaaggcccgtacccggtaggtacccggttccgtaaccccgggtcccgtttagacccgttacgttccccttccgtaccccgtccctttcgtaccnccccgggttaanccgttaacccgg

SEQ ID NO: 77621 - DNA, 204 bp, Homo sapiens
  misc_feature: GYAE6OF02H8P7L.49.81.H04.1.454.CMB.1.raw
  modified_base (203)..(204): a, c, t, g, unknown or other
  misc_feature (203)..(204): n is a, c, g, or t
tcagagtcgagagacacgaccggtgctcgatttagtagtgtagattcgcgggcacgaccggtgctcgatttagtagtgtagattccgcgggcacgaccggtgctcgatttagtcacgcgagaaagggaaggggctggccctgacgtgtttctgttcccgccctcctctctctcgactctgagcgggctggcaaggcgcatagnn

SEQ ID NO: 77622 - DNA, 206 bp, Homo sapiens
  misc_feature: GYAE6OF02H937G.49.81.H04.1.454.CMB.1.raw
  modified_base (204)..(206): a, c, t, g, unknown or other
  misc_feature (204)..(206): n is a, c, g, or t
tcagagtcgagagacacgaccggtgctcgatttagtagtgtagattcgcgggcacgaccggtgctcgatttagtagtgtagattccgcgggcacgaccggtgctcgatttagtcacgcgagaaagggaaaggggctggccctgacgtgtttctgttcccgccctcctctctctcgactctgagcgggctggcaaggcgcatagnnn

SEQ ID NO: 77623 - DNA, 518 bp, Homo sapiens
  misc_feature: GYAE6OF02JGOHP.49.81.H04.1.454.CMB.1.raw
  modified_base (395)..(395): a, c, t, g, unknown or other
  misc_feature (395)..(395): n is a, c, g, or t
  modified_base (431)..(431): a, c, t, g, unknown or other
  misc_feature (431)..(431): n is a, c, g, or t
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactcctcattcatgacaataacaagcgagtccccagagattcctgaccgattctctggctccaagtctggcacctcagccacctggccatcaccggactccagactggggacgaggccgattatactgcggaacntgggattccagcctgagtggtgtcagggtgttcggnggagggaccaagctgaccgtcctaggtcagcccaggctcggcccctcggtcacctctcgttccccgccttcctctcctcctcgtacc

SEQ ID NO: 77624 - DNA, 749 bp, Homo sapiens
  misc_feature: GYAE6OF02JZ158.49.81.H04.1.454.CMB.1.raw
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaaccgccccagactcctcattcatgacaataacaagcgagtcccagagtacttccgtagaccgtattcctcgtcggcctaccgaaggtcctgggccaacctccgacgtccctaaccccgtcggaccctaacgtccgaacccggtaacctacccgaacggaccggtacgggggaaccgacggggtacccgtaaattttacgtacgtacgggaccggtaaactaggtcgggtacttcccgaacgggtccgttaagggtaggtttcgggttacggttacgggtaacgggggtttccgggtttaccgggggaaccgggtaaccggggtaacccgtaacgggtccgtaaccgggtacccgttaccgtacgggtaacccgacgggaccccgtaacgggtccgttaccccgggtccccggttaccggttccgtaacccgtttcccgtttacccgttacccccttaccccgttccctttcccgtacccgttccgtacccggttaccgg

SEQ ID NO: 77625 - DNA, 479 bp, Homo sapiens
  misc_feature: GYAE6OF02IIDHX.49.81.H04.1.454.CMB.1.raw
  modified_base (476)..(476): a, c, t, g, unknown or other
  misc_feature (476)..(476): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaaattggtatcagcagaaaccagggaaagcccctaacctcctgatctacgatgcatccaatttggaaatagggtccatcaagtcagtggaagtggatctgggacgtatttacttcacatcatcaactgcagcctgagatatgcaacatattactgtcaacaatatgataatctaccactcactttcggcgaggaccaggtggagatacaaacgaactggtagctgcaccatctgtctntac

SEQ ID NO: 77626 - DNA, 489 bp, Homo sapiens
  misc_feature: GYAE6OF02HVGH2.49.81.H04.1.454.CMB.1.raw
  modified_base (265)..(265): a, c, t, g, unknown or other
  misc_feature (265)..(265): n is a, c, g, or t
  modified_base (335)..(335): a, c, t, g, unknown or other
  misc_feature (335)..(335): n is a, c, g, or t
  modified_base (485)..(485): a, c, t, g, unknown or other
  misc_feature (485)..(485): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactattaaattggtatcagcagaaaccagggaaancccctaacctctgatctacgatgcatccaatttggaaatagggtccatcaaggttcagtggaagtggatntgggactattttacttcaccatcatcaacctgcagcctgaggtatattgctaaacatattactagtacaaacaatatgaataatctacactcactttcggcggaggaccaggtgagatacgaaacgaactgtggctgcacatctgtcttntacc

SEQ ID NO: 77627 - DNA, 521 bp, Homo sapiens
  misc_feature: GYAE6OF02HVAKB.49.81.H04.1.454.CMB.1.raw
  modified_base (399)..(399): a, c, t, g, unknown or other
  misc_feature (399)..(399): n is a, c, g, or t
  modified_base (515)..(515): a, c, t, g, unknown or other
  misc_feature (515)..(515): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgattctctggctccaagtctggcacctcagccacctggccatccaccggactccagacctggggacgaggcccgatttatactgcggaanagtgggattccgagcctgagtggtgtcgagggtgttcggcggagggaccaagctgacccgtccgtaggtcagcccaaggctggcccctggcactctcgtcccaccctcctctctcncgtacc

SEQ ID NO: 77628 - DNA, 828 bp, Homo sapiens
  misc_feature: GYAE6OF02GJQ50.49.81.H04.1.454.CMB.1.raw
tcagagtcgagagacacgaccggtgctcgatttagtagtgtagattcgcgggggagtcccaaccaggaccacagaccaatggacatcgagggtccctgctccagctcctggggccttcctgcctgcgtctgggcctcgtcgaggtcgcctagtagtggtgacatccggatgacccgagtcctccatcctccgtgtctgcatctgtagagacaggaatcaccgatcgaacttcgccgaggccgaacgtcaaggacctattacgcaaaccttaagtttaaaactttgggtaatcctaagcgtaagaaaacccgagggtaaaacgtcccccttaaaacctccctaggacgttccgtaaccggaattcggcccaagttacccaaagttttcggaaaagttagggggtccccaaagttccggaaaagggttttccgaaaggttacgggaaaaccgttagggaacttcggtaggggaacctttaagtttttaaccgtttccaacccgtagttaccaacttaccgtaaacccgtttcgaccgtaacggtccccgtttaggaaacgggtaattaacggtttaggaccgtaaaacgtaacgttaaacgtttaaccgtacggttaaccaaaaccgtaaacgttactacggaaatttaaacgtaccttaaacccgtacgttacctaaccgtttttacggggaccggtaacggggaaacccgtacggggttacgggtaaccgttaacgttaccgaaaaccggtaacggttcgggtaaccgggacccgttggacccggtaacccggtaacttccggttaccggttaccgttacgtaacccg

SEQ ID NO: 77629 - DNA, 545 bp, Homo sapiens
  misc_feature: GYAE6OF02HORBF.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaaacattgggaagaattatgtatcgtggtaccagcagttcccaggaacgcccccagacctcctcattcatgacaataacaagcgagtcccagagattcctgaccgtattctctggctccaagtctggcacctcacgcccaccctggccactccaccggactccagacgtaggggacgacggccgtaatttacgtaacgtgacggaaactagtcgggacttccgagtccgtggagtgggtgtcgtagggtgttcgggacggagggaccaagctcgaccgtcgtagcgacgccgaggctcggcccctggtcactcgtcgttcccgcctcctctctctcgtc

SEQ ID NO: 77630 - DNA, 515 bp, Homo sapiens
  misc_feature: GYAE6OF02H68T7.49.81.H04.1.454.CMB.1.raw
  modified_base (279)..(279): a, c, t, g, unknown or other
  misc_feature (279)..(279): n is a, c, g, or t
  modified_base (357)..(357): a, c, t, g, unknown or other
  misc_feature (357)..(357): n is a, c, g, or t
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaacgcccctaactccngatctacgatgcatccaatttaggaaatagggtccatcaaggttcagtggaatggatcgtggactattttacttcacntcatcaactgcngctgagntattgctaacatattactgtacaactaatatagtattaaatcctaaccacttcttacgtttcgggacggtagggtacccagggtgagactacgaaacggtacctggtcgactggcaccgtattctacggttctcgtacc

SEQ ID NO: 77631 - DNA, 600 bp, Homo sapiens
  misc_feature: GYAE6OF02JIRRH.49.81.H04.1.454.CMB.1.raw
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (547)..(547): a, c, t, g, unknown or other
  misc_feature (547)..(547): n is a, c, g, or t
  modified_base (581)..(581): a, c, t, g, unknown or other
  misc_feature (581)..(581): n is a, c, g, or t
tcagagtcgagagacacgaccggtgctcgatttagtagtgtagattcgcgggggacgaagtcttcatcatgacctgctccctctcctcctcacccttctcattcactgcacaggtcctgggcccagtctgtgttgacgcagccgccctcagtgtctgcggcccaggacagaagtcaccatctcctgctctggaagcagctccaacattgggaanaattatgtatcgtgtaccagcagttccagacgcccagctcnatcntgacanacaagcgagtccagagacttccacgaccgtattctcgtcggtcctaccgtaagtcgtcggccaccttcaacgtcccaccctcggaccactccgaaccgctacccagaccgtggggaacgacggccgtaagtttactacgtcggacggtaaacagttacggggactttacccgaggtcccgtaggtacggttagggtcggttcgtaacggggttcggttcgggaccgggtaacgggaaccgtacgccgttcggaaccgttccggtagccaggaccctagggcnccgggtcccctagtccacgttcgtacgttccccncctcctctctcgtcctacg

SEQ ID NO: 77632 - DNA, 585 bp, Homo sapiens
  misc_feature: GYAE6OF02G1P19.49.81.H04.1.454.CMB.1.raw
  modified_base (189)..(189): a, c, t, g, unknown or other
  misc_feature (189)..(189): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggganacagaatcaccatcacttcgccaggcgactcgaggactattagacaacttatttaaattggtatcagacagaaaccgagggaaacgccccctaacctcctagactctaacgatgcactacctaatttaggaaagtacggggtccatctaaggttcagtggaagtgatcgtaggtacgttattttacttctactatcatcaacctgacagcctaggaggtattagttcgacaactattaacttactgttaaccaaataacttatagtaacttaacttaccttaacctacttacctaaccgttttccggggacggtaacgggaacccgtacgggtggacgactaccgaaacggtacttggtacggtctagaccacctattctacgttcttactacccg

SEQ ID NO: 77633 - DNA, 521 bp, Homo sapiens
  misc_feature: GYAE6OF02I4HM1.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgattctctggctccaagtctggcacctcagccaccctggccatcaccggactccagactggggacgaggccgaattattactgcggaacagtgggattccagcctgagtgtgtcagggtgttcgggcggagggaccaaggctggaccgtcgtaggtcacgccaaggcctggcccctggtcactctcgttcccacctcctctcctctcgtacc

SEQ ID NO: 77634 - DNA, 528 bp, Homo sapiens
  misc_feature: GYAE6OF02HP5RM.49.81.H04.1.454.CMB.1.raw
  modified_base (420)..(420): a, c, t, g, unknown or other
  misc_feature (420)..(420): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactctcattcatgacaataacaagcgagtcccagagattcctgaccgattctctggctccaagtctggcacctcagccaccctggccatcaccggactccagctggggacgaggccgattatactgacggaacagtcgggattccgagcctgagtggtntcgagggtgttcggcggagggacaagcgtaggaccgttcgtaggtcagcccgaaggccgtcggcccctcggtcactcgtcgttcccaccctccttcctctcctcgtac

SEQ ID NO: 77635 - DNA, 535 bp, Homo sapiens
  misc_feature: GYAE6OF02GYVV0.49.81.H04.1.454.CMB.1.raw
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgattctctggctccaagtctggcacctcagccacctggccatcaccggactccagactggggacgnggccgattatactgcggaacngtgggattccgagcctgagtggtgtcgagggtgttcgggcggagggaccagcctgaccgtcgtaggtccagcccgaggcctcgggcccccttcggtccaccgttcgtcgttccccacccttcctcctctcctccgtacc

SEQ ID NO: 77636 - DNA, 514 bp, Homo sapiens
  misc_feature: GYAE6OF02H08B2.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttccaggaacgcccccagactcctcattcatgacaataacaagcgagtcccagagattcctgaccgattctctgctccaagtctggcacctcagccacctggccatcaccggactccagctggggacaggccattatactgacggaacagtgggattccagcctgagtggtgtcgagggtgttcgggcggagggaccaagctggaccgtcgtaggtccagcccaaggctcggcccctggtcactctcgttcccgccttcctctctctcgtcc

SEQ ID NO: 77637 - DNA, 508 bp, Homo sapiens
  misc_feature: GYAE6OF02GTKAW.49.81.H04.1.454.CMB.1.raw
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgattctctggctccaagtctggcacctcagccaccctggccatcaccggactccagactggggacgaggccgattatactgcggaacatgggattccagcctgagtggtgtcagggtgttcggcggagggaccaagctgaccgtctaggtcagcccaggctggccctggtcactctgttcccgccctcctctctctcgtc

SEQ ID NO: 77638 - DNA, 524 bp, Homo sapiens
  misc_feature: GYAE6OF02G2OX3.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactcctcattcatgacaataacaagcgagtcccagagattcctgaccgattctctggctccaagtctggccacctcacgcccaccctggcccatccaccggactccagactggggacgaggccgattattactgcggaacagtgggattccgagcctgagtggtgtcgagggtgttcgggcggagggaccaagctgaccgtctaggtcacgcccaggctcggccctcggtcacgtctcgttcccaccctcctcctctctcgtc

SEQ ID NO: 77639 - DNA, 526 bp, Homo sapiens
  misc_feature: GYAE6OF02GHBZU.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgattctctggctccaagtctggcacctcagccaccctggcccatcaccggactccagactggggacgaggccgattattactgacggaacagtgggattccagcctgagtggtgtcgagggtgttcggcggagggaccaagctggacccgtccgtaggtcacgcccaggctcggcccctcggtcactctcgttcccacccttcctctcctctccgtc

SEQ ID NO: 77640 - DNA, 549 bp, Homo sapiens
  misc_feature: GYAE6OF02FWXOK.49.81.H04.1.454.CMB.1.raw
  modified_base (218)..(218): a, c, t, g, unknown or other
  misc_feature (218)..(218): n is a, c, g, or t
  modified_base (304)..(304): a, c, t, g, unknown or other
  misc_feature (304)..(304): n is a, c, g, or t
  modified_base (544)..(544): a, c, t, g, unknown or other
  misc_feature (544)..(544): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtaccagcagttcccaggaacgccccagactcctcattcatgacaataacaagcgagtcccagacgattccngaccgattctctggcctccaaggttctggccacctcagcccaccctggcccatcaccggactccagacgtcggggacgaggccgaattacttactgacggaacagtggggacttccgagtcccttaggacgttggtcgtcgagggttcgttcgggcgggagggaccaaggctgaccgtcgtaggtcacgcccaggcctcggcccctggtccacttctcgttcccacccttcctctctccncgtcc

SEQ ID NO: 77641 - DNA, 605 bp, Homo sapiens
  misc_feature: GYAE6OF02H69W2.49.81.H04.1.454.CMB.1.raw
tcagagtcgagagacacgaccggtgctcgatttagtagtgtagattcgcgggggggacaatcttcatcatgacctgctccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttccaggacggccccagactcctcattcatgacaataacaagcgagtcccagagattcctgaccgattctctggctccaagtctggcacctcacgcccaccgtcggcccactccaccggactccgagacgtggggacgaggccgtatttacgttacgtggacggaaactagtcgggtacttccgagtccttaggagttggtcgttcgaggggttcggttcgggcgggaacggggacccaaggtccgtacggtaaccgtccgtaaggtccgacggcccgaagggccgttccgggccccgttccgggtccacccgttccgttcccggttccccgcccgttcccttccgttccttccgtccgtaccg

SEQ ID NO: 77642 - DNA, 514 bp, Homo sapiens
  misc_feature: GYAE6OF02FKB00.49.81.H04.1.454.CMB.1.raw
  modified_base (427)..(427): a, c, t, g, unknown or other
  misc_feature (427)..(427): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactcctcattcatgacaataacaagcgagtcccagagattcctgaccgattctctggctccaagtctggcacctcagccaccctggcccatcaccggactccagactggggacaggccgattattactgcggaacatgggattccagcctgagtggtgtcagggtnttcgggcggagggaccaagctgaccgtctaggtcagcccaggctggcccctggtcactctcgttcccgccctcctcgtctctcgtac

SEQ ID NO: 77643 - DNA, 523 bp, Homo sapiens
  misc_feature: GYAE6OF02GXYOT.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaaccggccccagactcctcattcatgacaataacaagcgagtcccagagattcctgaccgattctctggctccaagtctggcacctcagccacctggccatcaccggactccagactggggacgacggccgattatactgcggaacagtgggacttccgagcctgagtggtgtcgtagggtggttcggcggaggaccgagctcgaccgtccgtaggccagcccgagctacggcccctggtccacgtcctgtccccacctccttctctctcgtc

SEQ ID NO: 77644 - DNA, 504 bp, Homo sapiens
  misc_feature: GYAE6OF02G5Q5K.49.81.H04.1.454.CMB.1.raw
  modified_base (403)..(403): a, c, t, g, unknown or other
  misc_feature (403)..(403): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactattaaattggtatcagcagaaaccagggaaagcccctaacctcctgatctacgatgcatccaattggaaatagggtccatcaagttcagtgaagtggatctgggacttatttacttcactatcatcaacctgcagcctgaggtatattgacaacattattactgtacaanaatatgataatctaccactactacgtttcggcggtaacggaccacgggtggagtaataccgaaacgtactggtaggctagacacctatctcgttcttctac

SEQ ID NO: 77645 - DNA, 487 bp, Homo sapiens
  misc_feature: GYAE6OF02H6LE9.49.81.H04.1.454.CMB.1.raw
  modified_base (263)..(263): a, c, t, g, unknown or other
  misc_feature (263)..(263): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (377)..(377): a, c, t, g, unknown or other
  misc_feature (377)..(377): n is a, c, g, or t
  modified_base (422)..(422): a, c, t, g, unknown or other
  misc_feature (422)..(422): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctcctgtctgcatctgtaggagacagaatcacatcacttgccaggcgactcaggacattagcaactatttaaattggtatcagcagaaaccagggaancccctaactcctgatctacgatgcatccaatttggaaatgggtccatcaaggttcagtggaagtgatctgggactatttacttnacntcatcaactgcagctgagatatgcaanatattactgtcaactatatagataatctactactctacgtttcgnggacggaccagggtgagtactcgaaacgacgtgtggactgcaccgtatcgtgttccgttataccg

SEQ ID NO: 77646 - DNA, 537 bp, Homo sapiens
  misc_feature: GYAE6OF02G6XRF.49.81.H04.1.454.CMB.1.raw
  modified_base (384)..(384): a, c, t, g, unknown or other
  misc_feature (384)..(384): n is a, c, g, or t
  modified_base (485)..(485): a, c, t, g, unknown or other
  misc_feature (485)..(485): n is a, c, g, or t
tcagagtcgagagacacgaccggtgctcgatttagtagtgtagattcgcgggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatacagcagaaaccagggaaacgcccctaactcctgatctacgatgcatacctaagtttaggaaataggggtacccagtcgaaggttcagtaggaagtggatcgtgggacttattttacttacactatcatcaacctnactagcctagaggtatattagactaactattacttactagtacaactaatatataataactctaaccactctacgttcggacgacggaccgtaggtagganagtacgaaacgtactggtacgacgtcgacacctagtacctgtcttgtacccg

SEQ ID NO: 77647 - DNA, 557 bp, Homo sapiens
  misc_feature: GYAE6OF02JVBA7.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcaagaaaccagggaaacgcccctaacctcctgatctacgatgcatccaatttaggaaatagggtcccatactaaggttcagtggaagtggatgtggacttatttacttcacatcatcaactgcagctgagtatattgacaactattacttatacgtacaactaattatagtaattaactactaaccctacttactaccgtttacgggacggtaccgggtaacctacgggtacgacgtaagtaccggaaaacgtaacgttggtacggtacctcggacctaccgtattcctacggtttccttacctacg

SEQ ID NO: 77648 - DNA, 514 bp, Homo sapiens
  misc_feature: GYAE6OF02GEJQR.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgattctctggctccaagtctggcacctcagccaccctggccatcaccggactccagacgtggggacgaggccgattattactgcggaacatgggattccagcctgagtggtgtcagggtgttcggcggagggaccaagctgaccgtctaggtcagtccaggctggcccctggtcactctcgttcccaccttcctctctctcgtac

SEQ ID NO: 77649 - DNA, 543 bp, Homo sapiens
  misc_feature: GYAE6OF02I6J0E.49.81.H04.1.454.CMB.1.raw
  modified_base (219)..(219): a, c, t, g, unknown or other
  misc_feature (219)..(219): n is a, c, g, or t
  modified_base (305)..(305): a, c, t, g, unknown or other
  misc_feature (305)..(305): n is a, c, g, or t
  modified_base (520)..(520): a, c, t, g, unknown or other
  misc_feature (520)..(520): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaagcagctccaacattgggaanaattatgtatcgtggtaccagcagttcccaggaacggccccagactcctcattcatgacaataacaagcgagtcccagagattccngaccgattctctggctccaagtctggcacctcacgcccacctggccatcaccggactccagacgtgggacgacggcaattatactgacgaacagtcgggattccgagtcctgagttggtgtcgagggttggttcggcgggaggaccaagctcgaccgtctagggtccagcccgtaaggcctacgggcccctcggtctaccgtccttcggtccccncccttcctcgtcctcctcgtacc

SEQ ID NO: 77650 - DNA, 554 bp, Homo sapiens
  misc_feature: GYAE6OF02F8ROC.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaacgcccctaaacctcctagactctacgatgcatccaatttggaaatagggtccatcaaggttcagtggagtggatcgtgggacttatttacttcacctatcatcaactgacagcctagaggtattattgacaacattacttactgttacaaactaatatagaattaactacctacctacttacctacgtttcgggaccggtacgggacccgtaacgggtggacgtataaccgaaacggtaacttggtacggacgtcggaccacctactcgttcgttaccttcttaacccg

SEQ ID NO: 77651 - DNA, 554 bp, Homo sapiens
  misc_feature: GYAE6OF02JC3QM.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaacgcccctaacctcctagactctacgatgcatccaatttggaaatgggtccatcaaggttcagtggaagtggatcgtgggtacttattttacttcactatcatcaactgacagcctgagtatattgacaactattattactgtacaactaatatagtaattaactcctaacctacttcctacgtttccgggacgggtaacgggaccgtacgggtaggagtacgtaaccgaaacggtaacgttgggtacggactacgacctacctagttaccgttcgttaccttactaccg

SEQ ID NO: 77652 - DNA, 574 bp, Homo sapiens
  misc_feature: GYAE6OF02IBC2N.49.81.H04.1.454.CMB.1.raw
  modified_base (288)..(288): a, c, t, g, unknown or other
  misc_feature (288)..(288): n is a, c, g, or t
tcagagtcgagagacacgaccggtgctcgatttagtagtgtagattcgcgggggggacaatcttcatcatgacctgctccctctcctcctcacccttctcattcactgcacagggtcctgggcccagtctgtgttgacgcagccgccctcagtgtctgcggccccaggacagaaagtcaccatctcctgctctggaagcagctccaaacattgggaagaattatgtaatcgtggtaccagcagttccaggaacggcccccagactcctcattcatgacaataacaagngagtcccagagattcctgaccgattctctggctcaagtctggcactcagccaccctggcccatccaccggactccagactggggaccaggccgtatttaacttacgtggacggaaactagtggggtaacttcccgaagtccgttaggacgttgggttgtcgaggggttcgttcgggcggagggaccaagctcgaccgttccgtaggtccacgcccgtaggccgtcgggcccctcgggtccacgttccgtcgttccccacccttcccttactcgtccttcgtacccg

SEQ ID NO: 77653 - DNA, 536 bp, Homo sapiens
  misc_feature: GYAE6OF02I99W3.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactcctcattcatgacaataacaagcgagtcccagagattcctgaccgattctctggctccaagtctggcacctcacgccaccctggcccatcaccggctccgagacgtggggacgaggccgatttatactgacggaacagtgggtattccgagcctgagtgtgtcgagggtgttcggcgggagggaccgaagcgtgaccgttccgtaggtcacgcccaggcctacgggcccctggtcacgttctcgttccccgccttccctctcctcctcgtac

SEQ ID NO: 77654 - DNA, 575 bp, Homo sapiens
  misc_feature: GYAE6OF02I003H.49.81.H04.1.454.CMB.1.raw
  modified_base (304)..(304): a, c, t, g, unknown or other
  misc_feature (304)..(304): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaaacattgggaagaattatgtatcgtggtaccagcagttcccaggaacgccccagactcctcattcatgacaataacaagcgagtcccagagattccngaccgattctctggctccaagtctggcacctcacgccaccctggccatcaccggactccagacgtggggacgacggccgatttatactggacggaacagtgggacttccagtcctggacgttggtgtacgagggttcgttcgggcgggacgggaccaagccgtacgaaccgttccgtaaggtcaacgcccgaaggccgtacgggccccttacggtccaaccgttcgtaccggttccccgtcccttacccgtccgtccttccgtccgtaccg

SEQ ID NO: 77655 - DNA, 537 bp, Homo sapiens
  misc_feature: GYAE6OF02GHJ7U.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaaccggcccccagactcctcattcatgacaataacaagcgagtcccagagattcctgaccgattctctggctccaagtctggcacctcagcccaccctggcccatccaccggactccagacgtgggacgaggccgattatactgcggaacagtgggattccagcctgagtggtgtcgagggtgttcgggcgggagggaccaagcgtgaccgtcgtaggtccagcccgaaggcctcgggcccctggtccactccgtcgttccccacccttcctctcctcctcgtaccg

SEQ ID NO: 77656 - DNA, 482 bp, Homo sapiens
  misc_feature: GYAE6OF02FWRZ4.49.81.H04.1.454.CMB.1.raw
  modified_base (465)..(465): a, c, t, g, unknown or other
  misc_feature (465)..(465): n is a, c, g, or t
  modified_base (479)..(479): a, c, t, g, unknown or other
  misc_feature (479)..(479): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaatagggtccatcaaggttcagtggaagtggatctgggacgtatttactttcacatcatcaactgcagcctgaggatattgacaacatattactgtcaacaatatgataatctacactcactttcggcgaggaccacggtggagatcaaacgaactgtggcngacacatctgtctntac

SEQ ID NO: 77657 - DNA, 581 bp, Homo sapiens
  misc_feature: GYAE6OF02IEXKC.49.81.H04.1.454.CMB.1.raw
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactcctcattcatgaacaataacaagcgacgtcccagagtattcctgaccgtattctctggcctaccaagtctggcacctcacgcccaccgtgcccatccaccggactccagaccgtggggaccgaggaccgtatttaacttacgtggacggaaacagtgggacttccgagtccgtagagtggtgtcgagggtcggttcgggacgggagggaccaaggcgtacgacccgttccgtaggtccacgcccgaagggcctaccgggccccttggtccaccgttccgtccgttccccacccgttccctcctctccgtcgtaccg

SEQ ID NO: 77658 - DNA, 548 bp, Homo sapiens
  misc_feature: GYAE6OF02ILI3T.49.81.H04.1.454.CMB.1.raw
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgcggcccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgattctctggctccaagtctggcacctcagccaccctggccatcaccggactccagaccgtggggaccgagggcccgtatttaacttaactggacggaaacagtgggattcccgagccgtgagtggtgtcagggtgttcggcggagggccaagctgacccgtctaggtcagcccaggcctcggcccctcgggtccacgtcctcggttccccgcccttccgtcctcttccgtcgtacc

SEQ ID NO: 77659 - DNA, 565 bp, Homo sapiens
  misc_feature: GYAE6OF02INHAF.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctcctgtctgcatctgtaggagacagaatcaccatcacttgccaggcgactcaggacattagcaactatttaaattggtatcagcaagaaaccagggaaacgcccctaacctcctgatctacgatgcatcctaatttaggaaagtacgggtcccatacaaggttcagtggaagtggatctaggacgttattttacttcacatcatacaactgcagcctagaggtatattgacaactattaattactagtacaaactaagttatagtaacttaaactacctaacctaccttctacgtttacgggaccgggtaacggaaccgtacgggtagaggtaactaccgaaaacggtaaccgttggtacggacttagaccaacctattacgtcgttaccttctaaccg

SEQ ID NO: 77660 - DNA, 515 bp, Homo sapiens
  misc_feature: GYAE6OF02GYDIL.49.81.H04.1.454.CMB.1.raw
  modified_base (511)..(511): a, c, t, g, unknown or other
  misc_feature (511)..(511): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgcctcagtgtctgcggccccaggacagaaagtcaccatctcctgctctggaagcagctccaacatttgggaagaattatgtatcgtggtaccagcagttcccaggaacgccccagactcctcattcatgacaataacaagcgagtcccagagattcctgaccgattctctggctccaagtctggcacctcacgccacctggccatcaccggactccagactggggacaggccgattatacgtgacggaacagtgggattccagcctgagtggtgtcgagggtgttcgggcggagggccaagcgtgaccgtcgtaggtcagcccaggctcggccctcggtcactcgtcgttcccacctcctctctcnctac

SEQ ID NO: 77661 - DNA, 551 bp, Homo sapiens
  misc_feature: GYAE6OF02G46UD.49.81.H04.1.454.CMB.1.raw
  modified_base (188)..(188): a, c, t, g, unknown or other
  misc_feature (188)..(188): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtagganacagaatcaccatcacttgccaggcgactcaggacatagcaactatttaaattggtatcagcaagaaaccagggaaacgcccctaacctcctagactctacgatgcatacctaatttaggaaacgtacggggtccctaatacgtaaggttcaggtggaagtggatcgtagggtacgttattttacttcactatacatcaactgacacgcctagaggtattattgactaactagttattactagtacaacaatatagtataactctaccacttactacgtttcggacggtacggaccgacgggtagacgactaacgaaacgtaacttggacgtacgtgaccactagtctacgttcttactaccg

SEQ ID NO: 77662 - DNA, 620 bp, Homo sapiens
  misc_feature: GYAE6OF02HCAJD.49.81.H04.1.454.CMB.1.raw
  modified_base (267)..(267): a, c, t, g, unknown or other
  misc_feature (267)..(267): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttccaggaacggccccagactcctnattcatgacaataacaagcgagtcccagagacttcctgaccgattctctggctccaagtctggccacctcacgcccacccgtggcccatccgaacccggtactacccagacgtcgggggaacgacgggacccgtatttaacttaaccgtggaccgggaaactaggtcggggtaactttcccgacgtcccgttaggaggttgggtggtacgtagggggttcgttccggggcgggaacgggaccgaaggtccgtacggacccgtccgtaggtccacgcccgaagggccgtacggcccccgtaggtcccacgttccgttccgttcccctacccttccctctccgttcctcgtaccc

SEQ ID NO: 77663 - DNA, 576 bp, Homo sapiens
  misc_feature: GYAE6OF02FM2C3.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacatttgggaagaattatgtatcgtggtaccagcagttcccaggaaccggccccagactcctcattcatgacaaataacaagcgacgtcccagagattccctgaccgtattctctggcctccaagtctggcacctcacgccaccctggcccatcaccggctccagacgtggggacgaggcctattactactggacggaacagtgggattccagccttgagtggtcgtcgagggtgttcgggcgggtagggacccaaggtccgtagacccgttccgtaggtccaacggcccaagggccgtccgggcccccgtcggtccaccgttccgtcgttcccccacccgttcccttccgttccttccgtccgtaccg

SEQ ID NO: 77664 - DNA, 647 bp, Homo sapiens
  misc_feature: GYAE6OF02G2PJW.49.81.H04.1.454.CMB.1.raw
  modified_base (432)..(432): a, c, t, g, unknown or other
  misc_feature (432)..(432): n is a, c, g, or t
tcagagtcgagagacacgaccggtgctcgatttagtagtgtagattcgcggggggggacgaatcttcatcatgacctgctcccctctcctcctcacccttctccattcactgcacgaggtcctgggcccagtctgtgttgacgcagccgccctcagtgtctgcggccccaggacagaaagtcaccatctcctgctctggaagcagctccaacattagggaagaattatgtatcgtggtaccagcagttcccaggacgccccagacctcctcattcatgaacaataacaagccgagtcccaagagattccgtagaccgtattcctactcggctaccgaagtcgtagggccacccgttcacgcccaccctggcccatccgaccgactccgagacgtagggacgaggacccgtaatttagttactggacggaacngtagggacttccgagccgttggaggttggtgtcgtagggttgttacgggacgggaagggaccaaggtcctacggaacccgttccgtaacggtccgaaccggcccgaacgggtccgtccgggtacccccggtcgggttaccaaccggtttcccgtaccgggtttacccccccgcccgttttcccgtacccgttcccgttcccgtacccggtacccg

SEQ ID NO: 77665 - DNA, 596 bp, Homo sapiens
  misc_feature: GYAE6OF02F55MX.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcactcaggacattagcaactatttaaattggtatcagcagaaaccagggaaacgcccctaactcctgatctacgatgcatccaatttaggaaatagggtccatacaaggttcagtggaatggatcgtgggtacgttattttactttcaccattcactcaacctgactagcctagaggtattagttcgacaacattattactagttacaaactaatatagaattaactacttaaccctacctacttaccgttttacgggaccggtaacgggtacccgaacgggttacggaagtaacgtaccgtaaaaaccggtaacgttacgggttacggtaccgtacgaacctacccgtaagttaccgttacggtttacctttaccgtaacccg

SEQ ID NO: 77666 - DNA, 745 bp, Homo sapiens
  misc_feature: GYAE6OF02J05Q9.49.81.H04.1.454.CMB.1.raw
tcagagtcgagagacacgaccggtgctcgatttagtagtgtagattcgcgggggggacgaatcttcatcatgacctgctcccctctcctcctcacccttctcattcactgcacaggtcctgggcccagtctgtgttgacgcagccgccctcagtgtctgccggccccaggacagaaagtcaccatctcctgctctggaagcagctccaacattgggaagaattatgtatcgtggtaccagcagttccaggaacgccccagactcctcattcatgaacaataacaagacgagtcccgagagacttccgtgaaccgtattctcgtggcctaccgaagttcctcggtaccacccgtcaaccggccctaacccgtcggacccctacgttcccaacccgggaccttcccgaacggtacccggtacgggggaaccgtacgggacccggttaattaaccgtttaaccgttcgggaaccgggtaaacctacggttacggggtaaacctttcccggaaaggtccccgttaggggtaccggttacgggtttcggtacgggtaacggggtttcgggtttacggggaccggggaacgggtaacccgtaaaggtcccggtaaccggttacccggtacccgtaagggtacccgacggaccccgaaggtcccgtccgggtacccccggtcggttccgtaaccgttaccgttccggttccccctaaccccgtcccgttcctccccttcgttacccggtccc

SEQ ID NO: 77667 - DNA, 542 bp, Homo sapiens
  misc_feature: GYAE6OF02GK2WO.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcaagaaaccagggaaacgcccctaacctcctgactctacgatgcatccaatttaggaaatagggtcccatacaaggttcagtaggaagtggatcgtgggtacgttatttacttcactatcatacaactgacagcctgaggtatatgacaactattattactgtacaactaatatagaataatacctaccactctacgtttcgggacggtacggaccgacgggtagagtactaacgaaacgtaacgttggtacggtactaggaccaacctagttccttagttaccttctaccg

SEQ ID NO: 77668 - DNA, 554 bp, Homo sapiens
  misc_feature: GYAE6OF02GT8GA.49.81.H04.1.454.CMB.1.raw
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactcctcattcatgacaataacaagcgagtcccagagattcctgaccgattctctggctccaagtctggcacctcagccacctgccatcaccggactccagaccgtggggacgacgggccgaatttactactggacggaaacagtagggattccgagtcctgacgtgggtgtcgagggtgttcggcgggacgggaccaaggcgtacgacccgttccgtaaggtccacgcccgaaggcctcgggcccctcggtctacctcgtcgttccccacccttccgttctccttcctcgtcc

SEQ ID NO: 77669 - DNA, 525 bp, Homo sapiens
  misc_feature: GYAE6OF02GHHT4.49.81.H04.1.454.CMB.1.raw
  modified_base (267)..(267): a, c, t, g, unknown or other
  misc_feature (267)..(267): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaacncccctaacctcctgatctacgatgcatccaatttaggaaataggggtccatcaaggttcagtgaagtggatcgtgggacgttattttacttcacctatcatcaacctgacagcctagaggtatattgacaactatattactagtacaactaatatagtataatactaccacttactactttcggacggacggaccgtacgggtagagacgtacgaaacgaacgttgtcggactgacaccgtatctacgttccttctac

SEQ ID NO: 77670 - DNA, 526 bp, Homo sapiens
  misc_feature: GYAE6OF02HIUJT.49.81.H04.1.454.CMB.1.raw
  modified_base (337)..(337): a, c, t, g, unknown or other
  misc_feature (337)..(337): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgattctctggctccaagtctggcacctnagccaccctggccatccaccggactccagacgtggggacgaggccgattattactgacggaacagtgggattccagcctgagtggtgtcgagggtgttcggcggagggaccgaagctggacccgtccgtaggtcagcccgaggctcggcccctggtcactcgtcgttcccgccctcctctctctcgtcc

SEQ ID NO: 77671 - DNA, 514 bp, Homo sapiens
  misc_feature: GYAE6OF02GRJ7Y.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacgccccagactcctcattcatgacaataacaagcgagtcccagagattcctgaccgattctctggctccaagtctggcacctcagccacctggccatcaccggactccagactggggacgaggccgattattactgacggaacagtgggattccagtcctgagtggtgtcgagggtgttcggcggagggaccagctgaccgtctaggcagccaggctcggccctcgtccactctcgttcccaccctcctctctcctcgtacc

SEQ ID NO: 77672 - DNA, 717 bp, Homo sapiens
  misc_feature: GYAE6OF02INYS4.49.81.H04.1.454.CMB.1.raw
  modified_base (306)..(306): a, c, t, g, unknown or other
  misc_feature (306)..(306): n is a, c, g, or t
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttccaggaaccgccccagacctcctcattcatgaacaataacaagcgagtcccagagattccngaccgtattctctggctcaagtctgcacctcacgcccacccgtcggccctactccgacccggactacccgaggaccggtgggggaccgacgggaccgtaatttacgttaccgtcggaccggtaaagtacgtacggggtactttacccgacgtaccgtaggtaggttcgggttcggttacggtagggggttcggtttaccgggggaccggggaacggggtaacccgaacgggtaccgttacgggttaaccccgttccggttaaacgggttaccgaaccgggtaccccggaagggtcccggtttacccggggccccccggtttacgggtaccctacccggtttcccgttacccggtttaccccccgtaccccgtttcccgttcccgtttccccttcccgttacccggtacccg

SEQ ID NO: 77673 - DNA, 591 bp, Homo sapiens
  misc_feature: GYAE6OF02GN57A.49.81.H04.1.454.CMB.1.raw
  modified_base (220)..(220): a, c, t, g, unknown or other
  misc_feature (220)..(220): n is a, c, g, or t
tcagagtcgagagacacgaccggtgctcgatttagtagtgtagattcgcgggggggacaatcttcatcactgacctgctcccctctcctcctcacccttcgtcattcactgcacagggtcctgggcccagtctgtgttgacgcagccgccctcagtgtctgcggccccaggacagaaagtcaccatctcctgctctggaagcagctccaacattgggaanaattatgtatcgtggtaccagcagttcccaggaacggccccagactcctcattcatgacaataacaagcgagtcccagagattcctgaccgattctctggctccaagtctggcacctcagccaccctggccatcaccggactccagactggggacgaggccgattattactggacggaacagtgggacttccagtcctaggacgtgggtgtcgaggggttcggttcgggcgggtaacggggaccgaaaggccgtaggacccgttccgtaaggttccacggcccgaagggccttacggggcccccgttcgggtaccaccgttccgttacggtttcccccaccccttcccttcctcccgttcctccgtacccg

SEQ ID NO: 77674 - DNA, 565 bp, Homo sapiens
  misc_feature: GYAE6OF02G2OTV.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttccaggaacggccccagactcctcattcatgacaataacaagcgagtcccagagattcctgaccgattctctggctccaagtctggcacctcagcccacctggccatccaccggactccagacgtggggacgaggccgattattactggcggaacagtgggattccagcctggagtggtcgtcgaggggttcgttcgggcgggacgggaccgaaggtccgtacggacccgtccgtaggtcaccggacccagggccgtacgggcccccttcggtccaccgttcctccggttccccgcccttcccttcctccttcctccgtacc

SEQ ID NO: 77675 - DNA, 534 bp, Homo sapiens
  misc_feature: GYAE6OF02IOSLS.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactcctcattcatgacaataacaagcgagtcccagagattcctgaccgattctctggctccaagtctggcacctcagccacctgcatcaccggactccagactggggacaggccgattacttactgcggaacagtgggatccagcctgagttggtcgtcgtagggtggttcggcgggagggacgaagcgtgaccgtcgtacggtcacgccacggcgtcggcccgtggcccccctatccgtccgttcccacccttccctctcctcctcgtaccg

SEQ ID NO: 77676 - DNA, 552 bp, Homo sapiens
  misc_feature: GYAE6OF02JGT35.49.81.H04.1.454.CMB.1.raw
  modified_base (218)..(218): a, c, t, g, unknown or other
  misc_feature (218)..(218): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtaccagcagttcccaggaaccggccccagactcctcattcatgacaataacaagcgagtcccagagacttcctagaccgattctctggctccaagtctggccactcacgcccacccgtggcccatccgaccggactcccagaccgtggggacgacggaccgatttagtacgtcgacggaaacagtcgggacttccgagtcctggagtggtgtcgtagggtcgttcgggcgggaggaccgagcgtcgaccgtcgtaggtcacgcccgagccgtcggcccgtcggtcacctcgtcgttccccgcctcctctcctctcgtcc

SEQ ID NO: 77677 - DNA, 539 bp, Homo sapiens
  misc_feature: GYAE6OF02IKOFA.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggcccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgattctctggctccaagtctggcacctcagccaccctggcccatcaccggactccagacctggggacgaggccgattatactgcggaacatgggattccagcctgagtggtgtcagggtgtcggcggagggaccaagctgaccgtcctaggtccacgcccgaggcctgggcccccttcgggtccactccgttcgttccccgaacccttccctacctcctcctccgtacc

SEQ ID NO: 77678 - DNA, 539 bp, Homo sapiens
  misc_feature: GYAE6OF02FHOJO.49.81.H04.1.454.CMB.1.raw
  modified_base (397)..(397): a, c, t, g, unknown or other
  misc_feature (397)..(397): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggacggcccccagactcctcattcatgacaataacaagcgagtcccagagattcctgaccgattctctggctccaagtctggcaccctcacgcccaccctggcccatccacccggactccagaccgtggggacgaggccgattattacngcggaacagtgggattccagcctggagttggtgtcagggtgttcgggcgggagggaccaagcgtcgaccgtcctaggtcacgcccaaggcctcggcccctcggtccactctcgttccccgcccttccctctcctctcgtacc

SEQ ID NO: 77679 - DNA, 531 bp, Homo sapiens
  misc_feature: GYAE6OF02HHKYO.49.81.H04.1.454.CMB.1.raw
  modified_base (218)..(218): a, c, t, g, unknown or other
  misc_feature (218)..(218): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
  modified_base (388)..(388): a, c, t, g, unknown or other
  misc_feature (388)..(388): n is a, c, g, or t
tcagagtcgagagacacgaccggtgctcgatttagtagtgtagattcgcggtggggacaatcttcatcatgacctgctcccctctcctcctcacccttctcattcactgcacagggtcctgggcccagtctgtgttgacgcagccgccctcagtgtctgcggcccaggacagaaagtcaccatctcctgctctggaagcagctccaacattggggaanaattatgtatcgtggtaccagcagttcccaggaaccggccccagacctcctcattcatgacaataacaagcgagtcccagagattccngaccgattcnctggctcaagtctggcacctcacgccacctggccatccaccgctccagacgtggggacgagccgattatacngacgaactagtggacttccgagtcctgagtggtgtcgagggtgttcgggcggagggaccaagcgtacgaccgtcgtaggtcacgccaaggtcctacggcccctggtccacgttcgtccgttcccgcctccctctcctctaccg

SEQ ID NO: 77680 - DNA, 545 bp, Homo sapiens
  misc_feature: GYAE6OF02FR5BE.49.81.H04.1.454.CMB.1.raw
  modified_base (311)..(311): a, c, t, g, unknown or other
  misc_feature (311)..(311): n is a, c, g, or t
  modified_base (527)..(527): a, c, t, g, unknown or other
  misc_feature (527)..(527): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttccaggacgccccagactcctcattcatgacaataacaagcgagtcccagagattcctgaccgattcnctggctccaagtctggcacctcacgccaccctggcccatccaccggactccagaccgtggggacgacggccgattacgtacgtggacggaaacagtgggacttaccgagtcccttgacggttggtgtcgagggttgttcgggcggagggaccagcgtcgaccgtcgtaggtcacgcccgaggcctcgggcccctcggtccacgttctcgttccccncctcctctctcgtcgtac

SEQ ID NO: 77681 - DNA, 514 bp, Homo sapiens
  misc_feature: GYAE6OF02GWNQ3.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaacgacccctaacctcctagatctacgatgcatccaatttaggaaatagggtacccatcaaggttcagtggaagtggatcgtgggacgttattttacttcactatcatacaacctgcagcctagaggtatatgactaacattaattactgtacaataatatagaataatactacctactctacgtttcggacggacggaccgaggtggagactacgaaacgtaactggtagactgacacatctctctctac

SEQ ID NO: 77682 - DNA, 511 bp, Homo sapiens
  misc_feature: GYAE6OF02F7W3G.49.81.H04.1.454.CMB.1.raw
  modified_base (399)..(399): a, c, t, g, unknown or other
  misc_feature (399)..(399): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaactcctgatctacgatgcatccaatttggaaataggggtcccatcaaggttcagtggaagtggatctgggacttattttacttcactatcatcaactgcagcctgaggatattgacaacatattacngtacaacaatatgaatatactacactactactttcggacggacggtaccgacgggtgtagaatacgaaacgaacgtggtagtccgtagtcacctatccgtgttcttctaccg

SEQ ID NO: 77683 - DNA, 658 bp, Homo sapiens
  misc_feature: GYAE6OF02JMJ6H.49.81.H04.1.454.CMB.1.raw
  modified_base (201)..(201): a, c, t, g, unknown or other
  misc_feature (201)..(201): n is a, c, g, or t
  modified_base (245)..(245): a, c, t, g, unknown or other
  misc_feature (245)..(245): n is a, c, g, or t
  modified_base (474)..(474): a, c, t, g, unknown or other
  misc_feature (474)..(474): n is a, c, g, or t
tcagagtcgagagacacgaccggtgctcgatttagtagtgtagattcgcgggggggacgaagtcttcatcatgacctgctcccctctcctcctcacccttctcattcactgcacaggtcctgggcccagtctgtgttgacgcagccgccctcagtgtctgccggccccaggacagaaagtcaccatctcctgctctggaancagctaccaacagttgggaaataattatgtaatcgtaggtaccngcagttcccaggaaccgccccagacctcctctacttcatgaacaataacaagcgagtcccagagacttccagacctattcctcgtggcctacctaagtcctggcctaacctcaacgtcccacccgttggaccctacgtccgaaccggaccttcccgagaccggtcggggaacacgggccgaatttacgtactggacggaacagtggaacttccgagtctgagtggtcgngtacgggtgttcgggaggacggtacctaggccttaggacccgttccggtaggtaccacgggtacccgaagggtcccgtaccggggtcccccttacgggttacctaacccggttccgtttcccggttaccccccgtaccccgtttcccgttaccggtttccccttacggtttaccccggtaaccc

SEQ ID NO: 77684 - DNA, 569 bp, Homo sapiens
  misc_feature: GYAE6OF02GHZ0X.49.81.H04.1.454.CMB.1.raw
  modified_base (218)..(218): a, c, t, g, unknown or other
  misc_feature (218)..(218): n is a, c, g, or t
  modified_base (305)..(305): a, c, t, g, unknown or other
  misc_feature (305)..(305): n is a, c, g, or t
  modified_base (382)..(382): a, c, t, g, unknown or other
  misc_feature (382)..(382): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtaccagcagttcccaggaaccggccccagactcctcattcatgacaataacaagcgagtcccagagattccngaccgattctctggctccaagtctggccacctcagccaccctggcccatccaccggactccgagacgtcggggacgnggaccgtattatacgtgacggtaacagttcgggacttccgacgtccttaggaggttggtgtcgaggggttcgttcgggcgggacgggaccaagcgtacggaccgttcgtaggcacggcccagggcctccgggccctcggtccaccttcgtccgttccccacccgttcccgtctccttccgccgtacc

SEQ ID NO: 77685 - DNA, 543 bp, Homo sapiens
  misc_feature: GYAE6OF02FFFZ0.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacaggtcctgggcccagtctgtgttgacgcagccgccctcagtgtctgcggcccccaggacagaaagtcaccatctcctgctctggaagcagctccaacatttgggaagaattatgtatcgtggtaccagcagttcccaggaacggccccagactcctcattcatgacaataacaagcgagtcccagagattcctgaccgattctctggctccaagtctggcacctcagccacctggcccatcaccggactccagaccgtggggacgaggccgattattactggacggaacagtagggattccgagcctgagttggtgtcgagggtgttcggcggagggaccaagctcgaccgtcctaggtccagcccaggcctcgggccccctggtcctaccgttccgtcgttccccacccttccctctccttcctccgtac

SEQ ID NO: 77686 - DNA, 605 bp, Homo sapiens
  misc_feature: GYAE6OF02H29KI.49.81.H04.1.454.CMB.1.raw
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (301)..(301): a, c, t, g, unknown or other
  misc_feature (301)..(301): n is a, c, g, or t
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattangtatcgtggtacagcagtccaggacgccccagactcctcattcatgacaataacaagcgagtcccagacgattccngaccgattctctcggctccaagtctggccacctcacgcccacccgtggacccatccgacccgtactcccgaacgacgtcggggaacggacggaccgtaacgtttattaaccgtcggacggaactagtacgggtattccgagcctggtagtggtgtcgagggtcgttcgggcggacgggaccgaagcgtacggtaccgtcgtaggtccgacgaccgacgggcctccgggtccccgttccggtacgtaccgttccgttccggtttacccctaccccgttcccgtccgttcccgtcttcccggtacc

SEQ ID NO: 77687 - DNA, 696 bp, Homo sapiens
  misc_feature: GYAE6OF02H69U4.49.81.H04.1.454.CMB.1.raw
tcagagtcgagagacacgaccggtgctcgatttagtagtgtagattcgcgggggggacaatcttcatcatgacctgctccctctcctcctcacccttctcattcactgcacagggtcctgggcccagtctgtgttgacgcagccgccctcagtgtctgccggcccaggacagaagtcaccatctcctgctctggaagcagctaccaacagttgggaaagtaatttatgtaatcgtggtaccagcacgttccaggaaccgcccccagacctcctcattcatgaacaataacaagcgacgtacccagagtacttcctagaccgtattctctcggcctaccaagtcgtcggccacctcgaacgcccaccgtcggacccactaccgaccggtaacctcccgaacggaccggtacgggggaaccgaacggggtacccgtaagttttaacgtttaccgtacgggacccggtaaaacgtaggtacggggtacctttacccgaaggtcccgttaggtaaggttcgggtcgttacggtaggggttcggttcggggacggggaacgggtacccgaaggtccgtacggtacccggttccgtaagggtaccgacggacccggtaacggccgttccgggccccgtacggtcctacccgttccgtaccggttcccccgcccttcccgttccgtccttcccgtccgtaccg

SEQ ID NO: 77688 - DNA, 550 bp, Homo sapiens
  misc_feature: GYAE6OF02FVRTF.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacgccccagactcctcattcatgacaataacaagcgagtcccagagattcctgaccgattctctggctccaagtctggcacctcacgccacctggccatcaccggactccagactggggacacggccgaattacttactggacggaacagtgggacttccgagtccgtgacgttggtgtcgagggttcgtcgggcggagggaccaagcgtagaccgtcgtaggtcagcccaggccgtcgggcccctggtccaccttcgttaccgttcccctacccgtccttctccttccgtccgtaccg

SEQ ID NO: 77689 - DNA, 513 bp, Homo sapiens
  misc_feature: GYAE6OF02FTVDC.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaactcctgatctacgatgcatccaatttggaaatggggtccatcaaggttcagtggaagtggatcgtgggtacgttatttactttcacctatcactcaacctgcagctgaggatattgacaacattattactgttacaataatatagataactctaccacttcctacgtttcggcggtacggaccacgggtagagatacgaaacgaacttggtcgctagccaccattctcgtcttactaccg

SEQ ID NO: 77690 - DNA, 830 bp, Homo sapiens
  misc_feature: GYAE6OF02JKXG8.49.81.H04.1.454.CMB.1.raw
  modified_base (264)..(264): a, c, t, g, unknown or other
  misc_feature (264)..(264): n is a, c, g, or t
  modified_base (304)..(304): a, c, t, g, unknown or other
  misc_feature (304)..(304): n is a, c, g, or t
tcagagtcgagagacacgaccggtgctcgatttagtagtgtagattcgcgggggggacgaagtcttcatcatgacctgctccctctcctcctcacccttctcattcactgcacacggtcctgggcccagtctgtgttgacgcagccgcctcagtgtctgcggcccaggacagaaagtcacatctcctgctctggaagcagctccaacattgggaataattagtgtaatcgtggtaccaggcagttcccaggaacgccccagacncctcatcatgacaataacagacgagtcccagagacttccngacccgatttcctctggcctccgaagtcctggcctacctcaacgtcccacccgtcggacccacgtccaacccgggtacctacccgagaccgtcgggggaaacctcggggacccgtaaatttacgtaaaccgttcggaccggtaaactacgttacgggggactttacccgaagggtccccttaggtaacgggtttaccggggttgttaccgggttaaacggggggttttcggggtttaacccgggggaccggggggtaaacggggggtaaccccgtaaacggggttaccccggtttaacggggtaaccccgggttttaaccccggttaaggggtttaaccccggaaccgggtaccccccggtaaagggggtccccggtttaccgggggtaccccccccggttacggggtttaacccgtaacccggtttcccggttttaaccccggggtttccccccccgggttaaccccctttccccgggtttaccccgttttccccggtttacccgtttcccccgggttaacccgg

SEQ ID NO: 77691 - DNA, 599 bp, Homo sapiens
  misc_feature: GYAE6OF02I6H1V.49.81.H04.1.454.CMB.1.raw
  modified_base (303)..(303): a, c, t, g, unknown or other
  misc_feature (303)..(303): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggacggccccagactcctcattcatgacaataacaagcgagtcccagagattccngaccgattctctggctcaagtctggcactcagccaccctggccatcaccggactccagacgtcggggacgaggcccgaatttagttactggaccggaaacagtacggggtatttcccgaagtcccgttagaggttcgggtacgtcgagggttcggttccggggacgggtagggacccgaagccgtaggacccgttcgtacggtccacgggccccaagggccttccgggccccctcggttaccaaccttccgtcggtttcccccaccttccccgttcctcccttccgtacgtacccg

SEQ ID NO: 77692 - DNA, 550 bp, Homo sapiens
  misc_feature: GYAE6OF02G49GV.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactcctcattcatgacaataacaagcgagtcccagagattcctgaccgattctctggctccaagtctggcacctcacgcccacctcggccatccaccggactccagacgtggggacgacggccgtattagttacgtggacggaactagtgggacttccgagtcctggagtggtgtcgagggttggttcgggcgggaacgggaccgaagcgtcggtaccgttccgtaggtccacgcccgagcgtcggccctcggtcacgtcctcgtccctacctcctctctcctcgtccg

SEQ ID NO: 77693 - DNA, 535 bp, Homo sapiens
  misc_feature: GYAE6OF02JF5HW.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgcggtaccagcagttcccaggaacggccccagactcctcattcatgacaataacaagcgagtcccagagattcctgaccgattctctggctccaagtctggcacctcagccacctggccatcaccggactccagactggggacgaggccgattattactgacggaacagtgggattccagcctgagtggtgtcgagggtgttcggcggagggaccgaagcgtgaccgtccgtaggtcacgcccaggcctcggccccgtcggtccacctcgtcgttccccacccttccctctccttcctccgtaccg

SEQ ID NO: 77694 - DNA, 563 bp, Homo sapiens
  misc_feature: GYAE6OF02HJL5Z.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaaccggcccccagacctcctcattcatgacaataacaagcgagtcccagagattcctgaccgtattctctggctccaagtctggcacctcacgccaccctggccatccaccggacctccagacgtggggacgaggccgtattacgtacgtggacggaactagtacgggtacttccgagtcctgagtggtgtcgtagggtcgttcgggcggacgggaccagccgtcgacccgttctaggtcacgcccgagggtcctccgggcccctcggtcaccgttcgtccgttccccacccttcctcctccttcgtccgtac

SEQ ID NO: 77695 - DNA, 627 bp, Homo sapiens
  misc_feature: GYAE6OF02JAQLO.49.81.H04.1.454.CMB.1.raw
  modified_base (218)..(218): a, c, t, g, unknown or other
  misc_feature (218)..(218): n is a, c, g, or t
  modified_base (301)..(301): a, c, t, g, unknown or other
  misc_feature (301)..(301): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtgtaccagcagttcccaggacgccccagactcctcattcatgacaataacaagcgagtcccagagattccngaccgattctctggctccaagtctggcacctcagccaccctgacccatccaccggactccaagacgtggggacgacggccgaatttacttactcggacggaacagttcggggtacttacccgagtcccgtagaggttggtgtcgtaggggtcggttcgggcgggtacgggtaccgaaaggtccgtggacccgttccgtaacgggtccgaaccggtccccgaagggccgttacgggcccccccgttgggtaccctaacccgttcccgttaccggtttacccccgtaacccgttccccgttccttcccttaccgttcccgttaacccg

SEQ ID NO: 77696 - DNA, 527 bp, Homo sapiens
  misc_feature: GYAE6OF02GF9CH.49.81.H04.1.454.CMB.1.raw
  modified_base (407)..(407): a, c, t, g, unknown or other
  misc_feature (407)..(407): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactattaaattggtatcagcagaaaccagggaaacgcccctaacctcctagactctacgatgcatccaatttaggaaatagggtcccatacaaggttcagtggaagtggatcgtagggtacgttattttacttcacatcatcaactgcagcctgagatattgacaacattaattacngtacaataatatagaataatacctacacttactacgtttcggacggacggactacgggtggacgtagtaaccaaacggtactggtagccgttagacctactattcctgttccttctaccg

SEQ ID NO: 77697 - DNA, 551 bp, Homo sapiens
  misc_feature: GYAE6OF02IN531.49.81.H04.1.454.CMB.1.raw
  modified_base (536)..(536): a, c, t, g, unknown or other
  misc_feature (536)..(536): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacgccccagactcctcattcatgacaataacaagcgagtcccagagattcctgaccgattctctggctccaagtctggcacctcacgccaccccgtggcccatcgaccggactcccagacgtcggggacgaggcccgaatttactactggaccggaacagtggattcccgagtcctgagtggtgtcgagggttggtcggcggagggaccaagcgtgaccgtcctaggccacgaccgaggcgtcggccccgtcggtcctacgttccgtcgttccccgcccgttccnccgtctcctcgtacc

SEQ ID NO: 77698 - DNA, 683 bp, Homo sapiens
  misc_feature: GYAE6OF02JTTGV.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttccaggaaccgccccagactcctcattcatgacaataacaaggcaagtcccagagaacttccgtgaccgattctctcggctccaagtctagccacctgacgcccacctggacccataccgaccggacctccaaggacctcgggggaacgacgggaccgtatttaacgttacgtcggaccggaacacgtaggggtacctttacccggaagtcccgttaggtaaggttcgggttacggtccggtaggggttcgggttaccgggaccggggaacgggtacccgtaaacgggtccgtaccgggtacccggttcccgtaagggttacccgaacgggtaccccgaagggtccgtacccggggtcccccttacgggtaccgtaccgttccgtacccgtttccccccgacccttcccgttcccgttacctcccgttaccggtaacccg

SEQ ID NO: 77699 - DNA, 517 bp, Homo sapiens
  misc_feature: GYAE6OF02I0MYI.49.81.H04.1.454.CMB.1.raw
  modified_base (370)..(370): a, c, t, g, unknown or other
  misc_feature (370)..(370): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaagcagctccaacattgggaagaattatgtatcgtggtaccagcagttcccaggaacggccccagactcctcattcatgacaataacaagcgagtcccagagattcctgaccgattctctggctccaagtctggcactcagccacctgccatccacgctcagactggggacgnggccgatttatacgtgcgaacagtgggattccagcctgagtggtgtcgagggtgtcggcggtagggaccaagcgtagacccgttcgtaggtcagcccaggctcggcccctggcactctcgttccccaccttcctcctctcctcgtcc

SEQ ID NO: 77700 - DNA, 513 bp, Homo sapiens
  misc_feature: GYAE6OF02G2DZU.49.81.H04.1.454.CMB.1.raw
  modified_base (371)..(371): a, c, t, g, unknown or other
  misc_feature (371)..(371): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcaagaaaccagggaaacgcccctaacctcctgactctacgatgcatccaatttggaaatagggtccatcaagtcagtggaagtgatcgtggtacgttattttacttcactatcatcaactncagctgagatatgacaacatattactgtaacaactaatatagataactctaaccattcactttcggacggtaggaccgaggtagacgtactaccgaaacgtaactggtacggcttagacctacgacttcgtcttacttctac

SEQ ID NO: 77701 - DNA, 751 bp, Homo sapiens
  misc_feature: GYAE6OF02HXEDQ.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaagcagcctccaaactagttagggaaagtaatttatgtaatcgtggtaccagcacgttccaggaaccgccccagacctcctcatcatgacaataacaagcgacgtcccagacgacttccgtcgaccgtatttctcgtcggcctaccgaagtctcggcctacctcacgcccacccgtcggaccctacgtccgaacccggtacctacccgaaggtaccggtcgggggaccgtaacgggtacccgtaattttacgttaaccgtcgggaaccgggtaaactacggttacggggtaacctttccccgaacggtcccgttagggtacgggtttcgggttacggttaccggtaggggggtttcggttaccgggggaccgggtaacgggggaacccgtaaacggtccggtacggtaaccccggttccggtaaggtcccgtaacggaccccgtaacgggtcccgtacccggggtcccccgttaccgggtcctaacccgtttcccgttccccgtttacccccaccccgtttccccgttcccttcccgttcccgtaccgtacccg

SEQ ID NO: 77702 - DNA, 602 bp, Homo sapiens
  misc_feature: GYAE6OF02F19PW.49.81.H04.1.454.CMB.1.raw
  modified_base (218)..(218): a, c, t, g, unknown or other
  misc_feature (218)..(218): n is a, c, g, or t
tcagagtcgagagacacgaccggtgctcgatttagtagtgtagattcgcgggggggacaatcttcatcatgacctgctcccctctcctcctcacccttctcattcactgcacaggtcctgggcccagtctgtgttgacgcagccgccctcagtgtctgcggccccaggacagaaagtcaccatctcctgctctggaagcagctccaaacattgggaanaattatgtatcgtggtaccagcagttcccaggaaccgcccccagactcctcattcatgacaataacaagcgagtcccagagattcctgaccgattctctgctccaagtctggccacctcacgccaccctggcccatccaccggactccagacgtggggaacgaggccgaattactactggacggaaacagtgggacttccgagtccttggagttggtcgttcgagggttggtcgggcgggaacgggaccaaggtccgtacggacccgttccgtagggtccaacggccccgaaggtcctccgggtccccctacgggtaccctaccgttccgttccggttaccccctaccccgttcccgttacctcccgttaccgtccgtaacccg

SEQ ID NO: 77703 - DNA, 750 bp, Homo sapiens
  misc_feature: GYAE6OF02H3KQH.49.81.H04.1.454.CMB.1.raw
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
tcagagtcgagagacacgaccggtgctcgatttagtagtgtagattcgcgggggacgaagtcttcatcatgacctgctccctctcctcctcacccttctcattcactgcacaggtcctggcccagtctgtgttgacgcagccgcctcagtgtctgccggcccaggacagaagtcaccatctcctgctctggaagcagctccaacattgggaanaattangtatcgtggtaccagcacgttccaggaccgccccagacctccgtcattcatcgaacaactaacaagcgaacgtcccaagagacttcctagaccgattcctacgtcggacctaccgaacgttctacgggcctaaccgttccaaacgccccgtaaccctcgggaccctattacccgaacccggtaccttacccgaacggtaccgtacgggggaacgtacggaccgtaatttacgttaacgtcggaccggtaaactacggtacgggtaactttaccgaacgtaccgtaggttacgtagggtacgttacggtagggtacggttaccggggtaccgggtaacgggtaacccgaaacgggtccgtacgggtaaccccggttaccgttaacgggtcccgaaaccggtcccgtaaacggggccgttaaccgggtcccccggttaccggtaacccgttacccgtttacccgtcccgggtttaccccccgtaccccgtttcccgttaccccgtttacccgttccgttacccggttaccccg

SEQ ID NO: 77704 - DNA, 934 bp, Homo sapiens
  misc_feature: GYAE6OF02JQVMD.49.81.H04.1.454.CMB.1.raw
  modified_base (151)..(151): a, c, t, g, unknown or other
  misc_feature (151)..(151): n is a, c, g, or t
tcagagtcgagagacacgaccggtgctcgatttagtagtgtagattcgcggggggacgaagtcttcatcatgacctgctccctctcctcctcacccttctcattcactgcacaggtcctgggcccagtcctgtgttgacgcagccgccctnagtgtctgccggccccaggacagaaagtcaccatctcctgcctctggaagcagcctaccaactgttaggggaaataattatgtaagttcggtacggtaccaggtaccacggtttaccccgaagggaaccggacccccgaaggtacctccccgtactaactttccgaacttacggaacctaaacgttaaaaccaaaggacccggtaaacggttacccccaagggaaccgtaaaacgttttccccgtacgaaccccgggttaaatttccccgtttaaccgtcggggttaccttaccccggtaaacggtttacccttcggggtaccctaacccgtacccgtaaccggccccttaaacccccggtcgggtacccctacggttacccgaacccggggtaacccttacccgaacgggtaacccggtcggggggtaaacccgtaacgggggtacccgtaaacggttttaccgtttaaaccggtaccgggtaaccgggaaaccgtacggtaacgggggtacctttaccggaccggtaccgttacggttacggttacgggttacgttaccgggtacgggtcggtttaccgggggacgggtaaccggggtaacccggaggttccggtaaccgggttaccgggtaacccgttacgggtaaccgtaccggtacccggtaaggtccggtaccgggtacccccggttaggttaccccggtaccgtttacccggttacccgttcccccgggtcccttaccccgggttcccttacccggttcccgtttacccgtcccgg

SEQ ID NO: 77705 - DNA, 883 bp, Homo sapiens
  misc_feature: GYAE6OF02H2VOT.49.81.H04.1.454.CMB.1.raw
tcagagtcgagagacacgaccggtgctcgatttagtagtgtagattcgcgggggggacaatcttcatcatgacctgctccctctcctcctcacccttctcattcactgcacagggtcctgggcccagtctgtgttgacgcagcccgccctcagtgtctgccggccccaggacaagaaagtcaccatctcctgctctggaagcagcctaccaaactagttaggggaaataatttattggtaagttcggtacggtaaccagtctacgttcccgaagggaacccggcccccaagtacctcctactacttcaagtacgaactaaataaacgaacgcgtaacgtacccagtaacgtacttccgtcgtaaccgtatttcctcgtacggaccttaccgtaaggttccgtcggtaccctaacccgtaccgaaccggtacccctaaccccggtcggaccctaaacgtaccccggaaccccggtaaccttacccgaacgggtaacccgggtacggggggaacccgtaccggggtacccggttaaagttttaacgtttaacccggtacgggaacccgggtaaaacgtaacgggttccggggttaacccttaccggtaacgggtacccgttagggtaacgggttcggggtaccggttacgggtaagggggttccgggtttaccggggaaccgggtaacgggacccgtaacggtcggtacccggtaacccgttcccgtaagggtacccgaaccggacccggtaacgggtcccggttacccgggcccccggttaccgggttaccctaacccgtttttccccggttacccgggttcccccccggtaccccttttccccggttaccccgttcccgtttacccggttacccgtaccccgg

SEQ ID NO: 77706 - DNA, 559 bp, Homo sapiens
  misc_feature: GYAE6OF02HN10Q.49.81.H04.1.454.CMB.1.raw
  modified_base (408)..(408): a, c, t, g, unknown or other
  misc_feature (408)..(408): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaaacattgggaagaattatgtatcgtggtaccagcagttcccaggacggccccagactctcattcatgacaataacaagcgagtcccagagattcctgaccgattctctggctccaagtctggcacctcacgccaccctggcccatccacccggactccgacgacgtcggggaccgacggccgattacgttactgacggaangtagggattccgagcctgagtggtcgtcgagggtcgttcgggcgggacgggaccgaagcgtcgaccgtccgtaggccagcccgaggccgtcggcccgtcggtccaccgttccgtcgttccccacccttcccttccgtcctcctaccgtccg

SEQ ID NO: 77707 - DNA, 559 bp, Homo sapiens
  misc_feature: GYAE6OF02GK7JL.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagagtcaccatcatttgccgggcaagtcagagtattagcaactatttaaattggtatcagcagtaccccgggaagcccctaagttactgatctatgctgcagccaatttgacaaagtcgggtccatcaaggttcagtggcaggtgagtcgtaggacagtaattcactctacacatcagcagtctgacctaacgtgtaagttattttaggaaattacgtagtttacgcaaacgtagtaacgttaacgtaaactttcgacttacgttattttcggggaacggtaacgggaccgtaagggtggaagataacgaaaaggtactaggtcggtacctggaccaacctgtaccttggtaccttcgtacctttcccg

SEQ ID NO: 77708 - DNA, 776 bp, Homo sapiens
  misc_feature: GYAE6OF02F0V98.49.81.H04.1.454.CMB.1.raw
  modified_base (213)..(213): a, c, t, g, unknown or other
  misc_feature (213)..(213): n is a, c, g, or t
tcagagtcgagagacacgaccggtgctcgatttagtagtgtagattcgcggggggggacaatcttcatcatgacctgctcccctctcctcctcgacccttcctcattcactgcacagggttcctgggcccagtctgtgttgacgcagccgccctcagtgtctgccggccccaggacagaaagtcacatctcctgctctaggagcagctccaanattgggaagaattatgtatcggtggtaccagcagttcccgaggaaccgccccagactcctcattcatgacaataacaagcgacgtcccagacgtacttccgtgaccgattcctcgtcggccttaccgtaaggttctacgggccacccgttcacggccctaccccgtgggacccagtccgacccgggtactccgacgacgtacggggaacgacgggcccgtaatttacgttacgtcggacggaaacgtagtacggggtactttacccgaacggtcccgttaggacggttacgggtcggttaccggtaacgggggtttccgggtttaccggggaaccgggggtaacggggtaaccccgtaaacgggtacccggttacggggttaaccccgggttacccggttaaacgggttacccgaaaccgggtacccccggtaaaggggtcccgttaacccgggggccccccgttacccggggtaacccgtaaccccgtttccggttcccggtttaccccccgtccccgtttaccccgtttccgttccccgtttacccgttaccggttacccg

SEQ ID NO: 77709 - DNA, 572 bp, Homo sapiens
  misc_feature: GYAE6OF02HMB5D.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctggcccagtctgtgttgacgcagccgccctcagtgtctgcggccccaggacagaaagtcaccatctcctgctctggaagcagctccaacattgggaagaattatgtatcgtggtaccagcagttcccaggaaccgccccagacctcctcattcatgacaataacaagcgacgtcccagagattcctgaccgattctctggctccaagtctggcacctcacgcccaccctggcccatccaccggacctccagacgtggggacgacggccgaatttattacgtggacggaacagtgggtacttccgagccgtgagtggtgtcgtagggtgttcgggcgggaggaccgaaggcgtcggacccgtccgtaggtcacgacccgaggccgtccggcccctcggtcctaccgttccgtaccgttcccccgcccttccgtccctccgtccgttccgtaccg

SEQ ID NO: 77710 - DNA, 569 bp, Homo sapiens
  misc_feature: GYAE6OF02G4H54.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattacgcaactatttaaattggtatcagcagaaaccaggaaacgcccctaacctcctgatctacgatgcatccaatttggaaatagggtcccagtacaaggttcagtggaagtggatcgtggacgttagttttacttcacctatacactacaacctgacagccctggaaggtattagttagactaactagttattacgtagtactaaacaattatagaataactacctaccacttacctacgtttacgggacggtacggaaccgtacgggtagacgtacgtaaccgaaacggtaacttaggtcggtacgtagaccgtaccagttcctacggttccttacgtacccg

SEQ ID NO: 77711 - DNA, 522 bp, Homo sapiens
  misc_feature: GYAE6OF02FK29E.49.81.H04.1.454.CMB.1.raw
  modified_base (414)..(414): a, c, t, g, unknown or other
  misc_feature (414)..(414): n is a, c, g, or t
  modified_base (466)..(466): a, c, t, g, unknown or other
  misc_feature (466)..(466): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactattaaattggtatcagcagaaaccagggaaacgcccctaacctcctgatctacgatgcatccaatttggaaataggggtcccatcaaggttcagtggaagtgggatctgggacgttatttacgtttcacctatcatcaacctgcagcctgaggatagttgacaacattattactgtacaanaatatgtaataatctacactactacgttcggacggacggtacgagggtaganatacgaaacgtaacgtggtaggctacggactacctattcgtcgttacttcgtaccg

SEQ ID NO: 77712 - DNA, 537 bp, Homo sapiens
  misc_feature: GYAE6OF02JCPUY.49.81.H04.1.454.CMB.1.raw
  modified_base (218)..(218): a, c, t, g, unknown or other
  misc_feature (218)..(218): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtaccagcagttccaggacggccccagactcctcattcatgacaataacaagcgagtcccagagattcctgaccgattctctggctccaagtctggcacctcacgccacctggtcatcaccggctccagacgtggggacaggccgattacgtactgacgaacagtgggacttccagcctgagtgtgtcgagggtgttcggcgggaggaccaagcgtacgaccgttcctaggtccagcccaggtcctcgggccccttggtctaccgttccgtccgttccccacccgttcctctccttcgccgtacc

SEQ ID NO: 77713 - DNA, 821 bp, Homo sapiens
  misc_feature: GYAE6OF02I5LAN.49.81.H04.1.454.CMB.1.raw
  modified_base (128)..(128): a, c, t, g, unknown or other
  misc_feature (128)..(128): n is a, c, g, or t
tcagagtcgagagacacgaccggtgctcgatttagtagtgtagattcgcgggggggacaatcttcatcatgacctgctcccctctcctcctcacccttctcattcactgcacgacggtcgtcggaccngtctgtgtcgacgcgcgcccgtcctcgtagtcgtcgtcggcccggacccgaaggaacgaaggtaacgtaccaacctactccctccgtcgtctcgtaaggaacgcgacgtcctaaccaataggttaagggaaattaattagttagttacgtcggtacgtaccgacgtacgtaccgtaccgaacgggaccccgcccagtcctcctatacttcagtacgaaactaaaacgtacgacggtacgtaccgaccgaaggtacgttaccttaccggaacggaccttactttccgtcgtcggtacctaaccgtacggttcggacgacccctacgtccgaaccgtcccctaccggtcgaccttaacgacccgaacccggttactaccgagggtacgggtacgggaccgaacggtacttagtttaacgtcggtcggaacggtaagtacggtacggttacctaaccgcgtaccggttggtacgggttggttacggtgggtacggggttcgggtacgggacggggtaacggaacccggacgtcggtacccgggtaccgtaccgggtacggtaccgaaccggtacccggaacgggttcccggtaccccgggtcccggttaccggtaccgttcccgtttcccggttaccccggttcccccgttcccgtttacccttcccggtacccgtttccgggacccgttacccgg

SEQ ID NO: 77714 - DNA, 688 bp, Homo sapiens
  misc_feature: GYAE6OF02IW1QP.49.81.H04.1.454.CMB.1.raw
tcagagtcgagagacacgaccggtgctcgatttagtagtgtagattcgcgggggagtcccaaccaggacacagcatggacatgagggtccctgctcagctcctggggctcctgctgctctggctctcaggtgccagatgtgacatccggatgacccagtctccatcctcctgtctgcatctgtaggagacagaatcaccatcacttgccaggcgactcaggacattagcaactatttaaattgtatcagcagaaaccaggaaacgcccctaacctcctgatctacgatgactatacctaatttaggaaagttacggggtccaatcgaaggttcagtaggaagtgatcgtaggtacgttattttacttcacctatacactacaacgtgctacgtccgtaggacggtaattagttacggaacctaaacgtaatttaatttaaccttaggttaaccctaaaataaagtttaacttaggaaacttaaacttacccttaaccctaaccttaccgttaaccgttttacccggggaacggggtaaccggggtaaacccgtacggggggtaaggtaaccggttaacgttaaaccccggaaaaacgggttaaaccggttacgggttacgggacccgtttaacgacccgtaacccgttaacgtttcccgttaacggtttaccctttaccggttaaccc

SEQ ID NO: 77715 - DNA, 738 bp, Homo sapiens
  misc_feature: GYAE6OF02IE9UR.49.81.H04.1.454.CMB.1.raw
  modified_base (281)..(281): a, c, t, g, unknown or other
  misc_feature (281)..(281): n is a, c, g, or t
  modified_base (408)..(408): a, c, t, g, unknown or other
  misc_feature (408)..(408): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctcgtggaagcagcctaccaaacagttggggaaataattatgtatcggtaggtaccagcacgttccgaaggaaccggccccagacctccncattcatgaacaaataacaagacgacgtacccaaggacgtacttccgtgaaccgtatttcctcgtcggccttaccgaacgttcgtcggccacctcacgcccaccgtcggaccacgtccgaccgtacnccgaaggtaccgtgggggaccgacggtaccgtaatttaacgttacgtcggaaccggtaaacgtacgtacggggtaactttaccggaacggtacccgttaggtacggttgggttacggtacgggtaggggttcgggttacggggccggggtaacgggaaccccgtaaggtccgtaccggtaacccggttccggttaacggtccgaaccgggacccgtaacgggtcccggttacccgggtccccgttaccggttacccgtacccgtttcccggttacccggttcccccgtccccgtttcccgtcccgtttcccgttacccgttccgtacccg

SEQ ID NO: 77716 - DNA, 600 bp, Homo sapiens
  misc_feature: GYAE6OF02I63AA.49.81.H04.1.454.CMB.1.raw
  modified_base (194)..(194): a, c, t, g, unknown or other
  misc_feature (194)..(194): n is a, c, g, or t
tcagagtcgagagacacgaccggtgctcgatttagtagtgtagattcgcggggggacgaagtcttcatcatgactgctccctctcctcctcacccttctcattcactgcacaggtcctggcccagtctgtgttgacgcagccgcctcagtgtctgcggcccaggacagaaagtcaccatctctgctctaggaancagctccaacattggaagaattatcgtaatcgtggtaccagcagttcccaggaacgccccagacctccgtcattcatgacaataacagacacgtccagacgattccgtgaccggaattctacttggccttaccgaagtcctaggtcaccttcgacgtccacctggcccatccaccggactcccagacgtcgggacgacggaccgtatacgttactacgcgaacgatcgggactccgtacgccgtacgagtcggttacgtcgtacgggtggttcgggtacggtacgggacaagggtcctagggtaccgtccgtacggtacaccggtccgaacggtcgtaccggtccccgtacggtccgtaccgtcgttccgtccctaccccgtacctcgtccctcgtccgttacccg

SEQ ID NO: 77717 - DNA, 675 bp, Homo sapiens
  misc_feature: GYAE6OF02I9M9Z.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaagcagcctccaaacagttgggaagaattatgtatcgtggtaccagcagttcccaggaaccggcccccagacctcctcattcatgacaataacaagcgagtcccagacgattcctcgaccgtattctctcggctccaagtctggcacctcacgccaccctggccatccgaccggactccagacgtcggggacgacggccgtatttacgttacgtgacggaactagtgggtacttcccgacgtcctaggtacggttgggttcgtcgtaggggttcggttacggggaccggggtaacggggacccgaacgggtccgttacggtaccccgggttccgtaagggtacccgtaacggaccccgtaaaggggtccccgtccggggtccccccgttaccgggtacccgtacccgtttcccggttcccgtttacccccgtaccccctttcccgttccccgtcccgttaccccgtccggttaccccg

SEQ ID NO: 77718 - DNA, 576 bp, Homo sapiens
  misc_feature: GYAE6OF02F3U48.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaatttatgtatcgtggtaccagcagttcccaggacgccccagactcctcattcatgacaataacaagcgagtcccagagattcctgaccgattctctggctccaagtctggcacctcacgccacccgtggccatcaccggactccagcgtcggggacgaggccgtattacttactgcggaacagtgggacttccgagcctgaggttggtgtcgtagggttgttcgggcgggagggaccaaggccgtacgaccgttccgtacggtccgacgcccgaagggcctacgggcccccgttcgggtacctacccgttccgttccggttcccccgcccttcccgtccttccgttcctccgtaccg

SEQ ID NO: 77719 - DNA, 540 bp, Homo sapiens
  misc_feature: GYAE6OF02I3K52.49.81.H04.1.454.CMB.1.raw
  modified_base (219)..(219): a, c, t, g, unknown or other
  misc_feature (219)..(219): n is a, c, g, or t
  modified_base (329)..(329): a, c, t, g, unknown or other
  misc_feature (329)..(329): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtaccagcagttcccaggaaccgccccagactcctcattcatgacaataacaagcgagtccccagagatcctgaccgattctctggctccaagtcngcactcacgcccacctggccatccaccggactccagacgtggggacaggcgattatactgacgangtgactcancctgngtgntcgngggtgtcggnggaggacagcgtcgaccgttcgaggtcagcccgaggccgtacggtccccctggtcctaccgttccgttcccggttaccccctacccgttccctccttccgtcctaccgtacccg

SEQ ID NO: 77720 - DNA, 589 bp, Homo sapiens
  misc_feature: GYAE6OF02GOCCK.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcgaaggacattagacaacttatttaaattggtatcagacaagaaaccgagggaaacgacccctaacctcctgactactacgatcgcaactcctaatttaggaaagtacggggtccctaagtacgtaaggttcaaggtaggaagtggatacgtacgggtacgttatttacttcactatcatacacctgacagtcctagtaggtatagttcgactaactattattaacgtcgttacaaactaatatagtaactaactactaacctacttctacgtttacgggacggtacggtaaccgtacgggtaggacgtactaacggaaacgtaagttcggtacggctacgacctacgtacttcgtcgttacctcttacccg

SEQ ID NO: 77721 - DNA, 836 bp, Homo sapiens
  misc_feature: GYAE6OF02IPI44.49.81.H04.1.454.CMB.1.raw
  modified_base (184)..(184): a, c, t, g, unknown or other
  misc_feature (184)..(184): n is a, c, g, or t
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
  modified_base (240)..(240): a, c, t, g, unknown or other
  misc_feature (240)..(240): n is a, c, g, or t
tcagagtcgagagacacgaccggtgctcgatttagtagtgtagattcgcggggggacgaagtcttcatcatgacctgctccctctcctcctcacccttctcattcactgcacaggtcctggcccagtctgtgttgacgcagccgcctcagtgtctgccggcccaggacagaagtcaccatctcngctctggaancagcctacaanagttggaaatattatacgtagtccgtaggtaaccngactacgttacccgaaggaaccgacccccgagtaacctccgttacaacgttacaacttacgaacctaaataaaccgaaggaccgacgtaaccccgaagtaacggaacttttacccgtacgaacccggttaattacccgttacgtacgggtacccttaccgtaaaacggttccgttacgggtaacctaccccgttaccaaccggtcccctaacccccggtttacgggacccctaacgtttacccggaaaccccgggtaaccctttacccgaaacggttacccgggaccggggggttaaaccgacggtaacccgggtaactttaaccggtttaactaaccgggtaccggtaaacgtacggtaacggggtacctttacccggaacgtaccgttaggtaacggtacggtcggttacggagggtttacggttaccgggacggggtaaccgtacgggtaaacgtccggtacggtaccgttccgtacggtaacgaccgtaccgtaacggtccggtaccggtccccggtacggtcctaacccggttccgtaccggttacccctacccccgttcttacccggtcctttccccggtacgtacccgg

SEQ ID NO: 77722 - DNA, 616 bp, Homo sapiens
  misc_feature: GYAE6OF02JMEUR.49.81.H04.1.454.CMB.1.raw
  modified_base (217)..(217): a, c, t, g, unknown or other
  misc_feature (217)..(217): n is a, c, g, or t
  modified_base (265)..(265): a, c, t, g, unknown or other
  misc_feature (265)..(265): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
tcagagtcgagagacacgaccggtgctcgatttagtagtgtagattcgcggggggacgaagtcttcatcatgacctgctcccctctcctcctcacccttctcattcactgcacaggtcctgggcccagtctgtgttgacgcagccgccctcagtgtctgcggccccaggacagaaagtcaccatctcctgctctggaagcagctcaacattgggaanaagttatgtatcgtagtaccagcagttccaggaaccgccccagctccncattcatgacaataacaanacgagtcccagngattcctgaaccnttctctggctccaagtcctggcacccgtcacgccacccgtggcccactcgaacccggactccaacgccgttagggggacccagggaccgacgttaacttacgtacgaccggaacgagtacgggtactaccgagtcccgtaggtcgttacgggttcgtacgttaggggtcgtttcgggcgggtaggggaccgtaaggaccgtcggtaacccgtcggtaccggtgaccggacccgtaggaccgtgggtccccctggtcccgtacgtcgtccgttcccggtcccttcctcccgttctccgtccgtacccg

SEQ ID NO: 77723 - DNA, 539 bp, Homo sapiens
  misc_feature: GYAE6OF02INM4X.49.81.H04.1.454.CMB.1.raw
  modified_base (263)..(263): a, c, t, g, unknown or other
  misc_feature (263)..(263): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
tcagagtcgagagacacgaccggtgctcgatttagtagtgtagattcgcgggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcacatcactgccaggcgactcaggacattagcaactatttaaatggtatcagcagaaaccaggaaancccctaactcctgatctacgatgcatccaatttaggaaatagggtccatacaagtcagtggagtgatcgtaggactattttacttacacatcatacaactgcagctgagntatcganaactatacttactagtacaaataatatagaataatacctaccaacttccgtacgtttaccgggacggaacgggacccgtacgggtaggacgtagtaaccgaaaacggtaacgtcggtaggcctagaccaacctagttccttacgttaccttaccgtacc

SEQ ID NO: 77724 - DNA, 674 bp, Homo sapiens
  misc_feature: GYAE6OF02JKPBF.49.81.H04.1.454.CMB.1.raw
  modified_base (217)..(217): a, c, t, g, unknown or other
  misc_feature (217)..(217): n is a, c, g, or t
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgcctcagtgtctgccggcccaggacagaaagtcaccatctcctgctctggaagcagctccaacattagggaanaattatagtactcgtcggtaccagctacgttcccgaaggaaccgccccagacctcctcattcatagaactaaactaacaacggtacggaacgtcccgaagacgtacttccgtagaccgtatttctactcggcctaccgtaagtcgtcggaccaccttccgacgcctacccgtacggaccctactaccgaaccggtccctaaccgaacgaccgttacgggggacgacgggtacccaagtttacttaccgtacgcggaaactacggtacggggatttcccgagtaccgtgtaaggttcggtcgtcggtagggtttcgggtcggacggggtacgacgaggtcgtacggtaccgtccggtagtccgacgtcccggaaggtccgtccgggacccgttggcctaaccgttccgttaccgttccccgtaccccgtccgttccttcccgttcgttacccgtccgg

SEQ ID NO: 77725 - DNA, 604 bp, Homo sapiens
  misc_feature: GYAE6OF02H5C1C.49.81.H04.1.454.CMB.1.raw
  modified_base (397)..(397): a, c, t, g, unknown or other
  misc_feature (397)..(397): n is a, c, g, or t
tcagagtcgagagacacgaccggtgctcgatttagtagtgtagattcgcgggggggacaatcttcatcatgacctgctccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtaatcgtggtaccagcagttcccaggacgccccagactcctcattcatgacaataacaagcagtcccagagattcctgaccgattctctggctcaagtctggcacctcagccaccctggccatccaccggactccagcgtggggacgaggccgattactacgtgacggaaacngtagggacttccgagtccgtggtaagtgggtgttcgaggggttcgttccggggacgggtaacgggaacccgtaaaggccttcggaaccccgttcgtaacgggtccgacgccccgaagggcccgttacgggcccccgtcggtcccacgtttcccgtaccggtttcccccacccgttcccttccctaccgttcccgtacccggtacccg

SEQ ID NO: 77726 - DNA, 623 bp, Homo sapiens
  misc_feature: GYAE6OF02IPMLZ.49.81.H04.1.454.CMB.1.raw
  modified_base (219)..(219): a, c, t, g, unknown or other
  misc_feature (219)..(219): n is a, c, g, or t
  modified_base (335)..(335): a, c, t, g, unknown or other
  misc_feature (335)..(335): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaaacattgggaanaattatgtatcgtggtaccagcagttccagacggccccagacctctcattcatgacaataacaagcgacgtacccagagattcctgaccgattcctctggctaccaagtctcggcncctcacgccacctgccacgtcaccggactccagacgtacgggacgagaccgtattaactactggacgtaacagtacgggtacttaccgacgtcctaggtacgttcggtcgtcggtagggttcggttccgggacggggtaacgggaccgaaaggccgtacgtacccggttcgtaacggtccgaaccgacccgtaacggtccgtaccgggccccgttaccggtacctaccgttacccgtcggttcccccgaccccgttcccgttccctaccgttcccgtaccggtacccg

SEQ ID NO: 77727 - DNA, 555 bp, Homo sapiens
  misc_feature: GYAE6OF02IPAIV.49.81.H04.1.454.CMB.1.raw
  modified_base (422)..(422): a, c, t, g, unknown or other
  misc_feature (422)..(422): n is a, c, g, or t
  modified_base (539)..(539): a, c, t, g, unknown or other
  misc_feature (539)..(539): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggccactcaggacattagcaacttatttaaattggtatcagcaagaaaccaggaaacgcccctaaacctcctgactctacgatgcatacctaagtttggaaaagttcggggtacccatacgaaggttcaggtaggaagtggattcgtagggtacgttattttacttacacctatcactacaacctgacacgcctagaggattagtgactaanattattactagtacaactaatatagtaataacttactacctacttacctacgtttccggacgggacggtaccgaggtcggagaactacgaaacgtacgtggtacgtctagaccactntcgttcttctactacg

SEQ ID NO: 77728 - DNA, 863 bp, Homo sapiens
  misc_feature: GYAE6OF02J1L1B.49.81.H04.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
tcagagtcgagagacacgaccggtgctcgatttagtagtgtagattcgcggggggacaatcttcatcatgacctgctcccctctcctcctcacccttctcattcactgcacagggtcctgggcccagtctgtgttgacgcagccgccctcagtgtctgccggcccaggacagaagtcaccatcctcctgctctaggaagcagcctccaangttagggaataatttagngtatcggtaggtaccagtctacgttcccgaaggaccggccccagacctcctctacttcatacgaacaataacgaagtacgacggtacccaagacgtacttaccgtacggaccgtacgttacctcgtcgtcctaccgtaacggttccgtacggtccaacctttcccgaaggccccaacccccttggggaccccctaacgttaccgtaacccccgggggaacctttcccccaaggggaaacccgttcgggggggaacccgaagggtcccggtaacgtttaacgtttaacccgttacggaccggggtaaaaccgtaagttacgggggtaactttccccgtaagggtacccgtttacggtacgggttcggggttaccggttacgtaccggggttagggttttacggggtaccggggtaacggggttacccgtaaacggggtccggtttacgggtaacccgggttacccggttaaacgggttaccccggtaacgggtacccccggtaacggggtcccgtttaccggggtaccccccggttcgggttacccgtaacccgtttacccgttaccgggttttaccccccggtccccgttaccccgtttcccgttaccccgtttcccgttacccggttaaccccg

SEQ ID NO: 77729 - DNA, 572 bp, Homo sapiens
  misc_feature: GYAE6OF02HX4M1.49.81.H04.1.454.CMB.1.raw
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (284)..(284): a, c, t, g, unknown or other
  misc_feature (284)..(284): n is a, c, g, or t
  modified_base (391)..(391): a, c, t, g, unknown or other
  misc_feature (391)..(391): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (542)..(542): a, c, t, g, unknown or other
  misc_feature (542)..(542): n is a, c, g, or t
tcagagtcgagagacacgaccggtgctcgatttagtagtgtagattcgcggggggacgaagtcttcatcatgacctgctccctctcctcctcacccttctcattcactgcacagggtcctgggcccagtctgtgttgacgcagccgcctcagtgtctgccggcccaggacagaaagtcaccatctcctgctactggaagcaaggtctaccaacattggggaaanaattancgtaatcgtggttaaccagctaacgttcccgaaggaaccggacccccagtaccnctcattcaatgaacaataacaaagcgaacgccagagatctgaccgattctactgctaccaagtctaggcacctcagccacctgcatcgaccgatccagactgggganacgcgactagtactgcgaacgntaggatcgancgttgacgtgagtcgaggttagtcggcggtaacggcgaaacgtcgtacgaacgttccgaacggtacgtaccgcaaacggtcgtaacggcccgtccgtaacgccttacgttcgttacccncccttacccgttcttaccttccagttaccc

SEQ ID NO: 77730 - DNA, 549 bp, Homo sapiens
  misc_feature: GYAE6OF02F9BSH.49.81.H04.1.454.CMB.1.raw
  modified_base (188)..(188): a, c, t, g, unknown or other
  misc_feature (188)..(188): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtagganacagaatcaccatcacttgccaggcgactcaggacattagcaactatttaaattggtatcagacagaaaccagggaaacgcccctaacctcctagactctacgatcgcatacctaatttggaaataggggtacccagtactaaggttctagtagggaagtgatcgtagggacttatttacttactacatcatcaactgcacgtctgagatattgacaactataattactacgtaacaacaatatgaattactactactactctacgtttcggcggaaggtaccgacgggtagagataaccgaaacgtacgtaggtacgacgttacggactaccgtacttaccgttcgtaccttataacccg

SEQ ID NO: 77731 - DNA, 604 bp, Homo sapiens
  misc_feature: GYAE6OF02HG1OH.49.81.H04.1.454.CMB.1.raw
  modified_base (438)..(438): a, c, t, g, unknown or other
  misc_feature (438)..(438): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcactcaggacattagactaacttaatttaaatggtaatcaaggacaaacgaaaaccgagggaaactccccctaaactcctagactactaacgatcgacctataccgtaaagtttaggaaacgttacgggtaccctaagtaccgtaagggtctaaaggtggaaagttgggaacttcgtagggtaactttaattttaccttacacctattcccaagttaccaaccgtnacgtactacgtagaagtactagtcaactaatataacgttactataactaatagtatactaactaactactactacgtacgtacgttacggacggacgtacgaggtacagtaactaacgtaacgtatggtacgactacgacgtaactactcgttactacgttacacg

SEQ ID NO: 77732 - DNA, 722 bp, Homo sapiens
  misc_feature: GYAE6OF02IPXLP.49.81.H04.1.454.CMB.1.raw
tcagagtcgagagacacgaccggtgctcgatttagtagtgtagattcgcgggggggggacaatcttcatcatgacctgctcccctctcctcctcacccttctcattcactgcacagggtcctgggcccagtctgtgttgacgcagccgccctcagtgtctgcggccccaggacagaaagtcacatctcctgctctggaagcagctccaacattgggaagtaattatgtatcgtaggtaccagcacgttcccgaaggaaccggcccccagtacctcctctacttcatcgacaaataacaagcgacgtacccaggagtacttcccgtaggaccgtatttctcgtcggctacctaagtccgtgccacctcgacgccctacccgtggacccagtccgaaccggacctacccgaagtacccggtggggggaaccgtacggggcccgtaatttaacgttaccggtacggtaccgggaaataagggtacgggtaactttcccggaacggtccttagggtacgggttcgggttacggtaccgggtagggggttccgggtttacggggaccggggtaacgggggtaaccctaagggcccgtttagggaaccccgttaccgttacgggtaaccacgggaccccggtaggtcccggtccggggccccctttacgggtctacccgttccgttcgtttacccccacccttccctcccgttctcccttacgtaccg

SEQ ID NO: 77733 - DNA, 550 bp, Homo sapiens
  misc_feature: GYAE6OF02GCBYV.49.81.H04.1.454.CMB.1.raw
  modified_base (336)..(336): a, c, t, g, unknown or other
  misc_feature (336)..(336): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaagcagctccaacattgggaagaattatgtatcgtgtaccagcagttcccaggaacgccccagactcctcattcatgacaataacaagcgagtcccagagattcctgaccgtattctctggcctcaagtctggcacctnacgccacctgccatcaccgactcagcgtgggacgaggccgtattatacgngccggaanagtgggattaccgagtcctgtaggttgtgtcgagggtggttcggacgggtagggaccaagtccgtgaccgttccgtaggtcacgtcccgaaggtcctacggcccctcgggtacctcgtccttccgtccccctaccttcccttcctcctcctcgacc

SEQ ID NO: 77734 - DNA, 527 bp, Homo sapiens
  misc_feature: GYAE6OF02FSU3Q.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatcgtgggacttatttacttcaccatcatcaacctgcagcctgaggatattgacaacatattactgtacaaacaattatgaattaatctaaccacttctacttttcggacggaagggaccaacgggtggagaagtaccgaaaacggtaacttggtaggcctaggcaaccgattcctggtaccttctaaccg

SEQ ID NO: 77735 - DNA, 586 bp, Homo sapiens
  misc_feature: GYAE6OF02IMAI1.49.81.H04.1.454.CMB.1.raw
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgcggccccaggacagaagtcaccatctcctgctctggaagcagcctccaacattagggaagaattatgtatcgtggtaccagcagttcccaggaaccggcccccagacctcctcattcatgacaataacaagcgagtcccagagattcctgaccgattctctgctaccaagtctggcncctcacncccaccctggcccatccaccggacctccgacgaccgtggggacgacggccgatttatacgtgacgaacagtgggtacttccgagccgtgaggtggttgtcgtagggtggttcgggcgggacgggaccgagtcgtacggccgttccgtaggtccacgacccgaggaccgtccggccccgttcggtcctaccgttccgtacgttcccccgccttcccgttacctccgtttaccgccgttacccg

SEQ ID NO: 77736 - DNA, 537 bp, Homo sapiens
  misc_feature: GYAE6OF02JDE6V.49.81.H04.1.454.CMB.1.raw
tcagagtcgagagacacgaccggtgctcgatttagtagtgtagattcgcgggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctcaacattgggaagaattatgtatcgtggtaccagcagttcccaggaacggcccccagactcctcattcatgacaataacaagcgagtcccagagattcctgaccgattctctggctccaagtctggcacctcagccaccctggccatcaccggactccagactgggacgacggccgaattacttaactgacggaacagtagggacttccgaagtcctgagtcggtgtcgagggtgttcggcggagggaccaagctgaccgtcctaggtccagcccaaggtctcgggcccctcggtccacttctacgttccccgcccttccctctcctctcctacc

SEQ ID NO: 77737 - DNA, 535 bp, Homo sapiens
  misc_feature: GYAE6OF02F6YPO.49.81.H04.1.454.CMB.1.raw
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
  modified_base (502)..(502): a, c, t, g, unknown or other
  misc_feature (502)..(502): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccgagggaaacgcccctaacctcctagactctacgatgcatccaatttaggaaatacggggtaccatacaaggttcaggtaggaagtgatcgtgggacttatttacttcactatcactcaactgcagcctagaggatagttgacaactatattactnttacaaacattanagataactctaccactctacgttcgggacggacggaccgagggtaggacgaacgtaacgtaaacggaacgttaggnggtacctgaccactacgttactcgttcttctac

SEQ ID NO: 77738 - DNA, 216 bp, Homo sapiens
  misc_feature: GYAE6OF02FOHKO.49.81.H04.1.454.CMB.1.raw
  modified_base (211)..(216): a, c, t, g, unknown or other
  misc_feature (211)..(216): n is a, c, g, or t
tcagagtcgagagacacgaccggtgctcgatttagtagtgtagattcgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnn

SEQ ID NO: 77739 - DNA, 531 bp, Homo sapiens
  misc_feature: GYAE6OF02FKSWN.49.81.H04.1.454.CMB.1.raw
  modified_base (218)..(218): a, c, t, g, unknown or other
  misc_feature (218)..(218): n is a, c, g, or t
  modified_base (336)..(336): a, c, t, g, unknown or other
  misc_feature (336)..(336): n is a, c, g, or t
  modified_base (395)..(395): a, c, t, g, unknown or other
  misc_feature (395)..(395): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaanaattatgtatcgtggtaccagcagttcccaggaacggcccccagactcctcattcatgacaatacaagcgagtcccagagattcctgaccgattctctggctccaagtctggcacctnacgccacctggccatcaccggctccagactggggacacggccgtattatactggcgaanagtgggacttccgagcctgagtggtgtcgagggtgttcggcggagggaccaaggctgaccgttcaggtcagcccaggctcgggcccctggtccacgttcctgttccccaccttcccttacgtccttctccgtaccc

SEQ ID NO: 77740 - DNA, 749 bp, Homo sapiens
  misc_feature: GYAE6OF02GTHSE.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaagtcaccatctcctgctctggaagcagcctaccaactagttagggaagtaattatgtatcgtcggtaccagcacgttcccgaggtaaccgcccccagacctcctcattcatgaacaataacaagcgacgtcccaagacgtacttccgagaccgtattctcgtcggcctcgaacgtcgtcggacctaccctcaccgccctaaccccgtgggacccctacgtcccgaacccgggtacccttacccgaacggtaccggtacgggggaaccgacgggtacccgtaagttttacgttaccggtacgggtaaccgggaaaccgtaggttacgggggtacctttaccccggaggttacccggttaggtacggttacggggttacggttccgggtaaggggttttccgggtaccggggcgggtaaacgggaccctaagggtccgtaacggtaccccgtacggtacggtaccaccgggtacccgagggtcctacccggggccccttacgggtacctacccgtttccggttcccggtttccccccgacccgtttccgttcccgtccgttccccgtacgttacccg

SEQ ID NO: 77741 - DNA, 685 bp, Homo sapiens
  misc_feature: GYAE6OF02I1RI5.49.81.H04.1.454.CMB.1.raw
  modified_base (173)..(173): a, c, t, g, unknown or other
  misc_feature (173)..(173): n is a, c, g, or t
  modified_base (339)..(339): a, c, t, g, unknown or other
  misc_feature (339)..(339): n is a, c, g, or t
  modified_base (468)..(468): a, c, t, g, unknown or other
  misc_feature (468)..(468): n is a, c, g, or t
tcagagtcgagagacacgaccggtgctcgatttagtagtgtagattcgcgggggggaccaaaatcttccatcgatagaccctgctcccctctcctcctcacccttctcagttcacgtgcgacagggtcctcgggtccctagtctgtgttgaacgcagccgccctcacgtgtcngcgcccaggacagaaagtcaccagtctacctgctactggaaggcagctccaaacgtcttgggaagaattagtgtactcggtaggtaaccctagcctaagttcccaaggaaccgccccaggactcctacaacgttccagtagaacgaataacgaagcgagtcccganaggtacttccaggaccgtattctactggactaccaaagtacgtggcacctcaacgccacctggaccagtaccaccggacctacgacgaaccttacggggaacgacggacccgtaatttaacgtaaccgnggaccgggaaaccgacgtagggaactttacccggaacgtccgtagaggttacgggttgtacgagggtttcgttcgggacgggtaacggaaccgtaacgtcgtaacgtaccgtcgtaggacgacgaccgaagtccggttaacggtccccgttaggtaccgtaccgtttccgttaccgttacccgcccgtttaccgtacgtccctacgttaccgtaccg

SEQ ID NO: 77742 - DNA, 550 bp, Homo sapiens
  misc_feature: GYAE6OF02IAT3G.49.81.H04.1.454.CMB.1.raw
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (392)..(392): a, c, t, g, unknown or other
  misc_feature (392)..(392): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctcaacattgggaanaattangtatcgtggtaccagcagttcccaggaacgcccccagactcctcatcatgacaataacaagcgagtcccagagattcctgaccgattctctggctccaagtctggcactcagccacctgccatcaccggactccagacgtgggacgaggccgattattactgcggaacngtgggattccgagcctgacgtggtgtcgagggtgttcggcggacgggccaagcgtgacccgtctaggtcagccccaaggcctacgggcccccttgggtcctaaccgttccgtcgtttcccccggacccttccctcctttacccttcctaccgtacccg

SEQ ID NO: 77743 - DNA, 674 bp, Homo sapiens
  misc_feature: GYAE6OF02F6OAU.49.81.H04.1.454.CMB.1.raw
  modified_base (199)..(199): a, c, t, g, unknown or other
  misc_feature (199)..(199): n is a, c, g, or t
  modified_base (299)..(299): a, c, t, g, unknown or other
  misc_feature (299)..(299): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggancagctcaatgttgggaagtattatgtatcgtgtaccagctagtccaggacgccccagctctcattcatgacaataacaagcgagtcccagacgattccgngaccgtattctcgtgcctccgaagtctcggcaccgtcacgccacccgtcggcccacgtccgaccgtactccgagacgtgggacgcggaccgtattacgtacgtaggacggaactagtagggtacttccgacgttaccgtaggtacggttcgggttacgtcgggtagggtttcgggttccggggacggggtaacggggtacccgaaggtccggtacggtacccgggtttaccgtaacgggtccgaaccggtcccggaaggtcccgttccggggcccccggttacgggttaccctacccgtttcccgttaccggttttaccccccgttaccccgtttcccgttccctttacccgttaccccgttcccggttaacccg

SEQ ID NO: 77744 - DNA, 529 bp, Homo sapiens
  misc_feature: GYAE6OF02F9JKQ.49.81.H04.1.454.CMB.1.raw
  modified_base (393)..(393): a, c, t, g, unknown or other
  misc_feature (393)..(393): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgattctctggctccaagtctggcactcagccacctggccatcaccgctccagactggggacaggccgattatactgcggtaacngtgggattccagcctgacgtggtagtcgagggtgttcgggcggtagggaccaaggctgaccgtctaggtcagcccaggctcggcccctcggtccaccgttcgtcgttccccacccgttcctacgtcctctcgtacc

SEQ ID NO: 77745 - DNA, 596 bp, Homo sapiens
  misc_feature: GYAE6OF02I96H0.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcacatcacttgccaggcgactcaggacattagacaactatttaaatggtatacagacaagaaaccgaggaaacgcccctaactcctgaatctacgatcgacatccaagtttaggaaagtacgggtacccatacgtaaggtcaaggtggaagtggataccgagggtacttacttttacttcactatctatcaacctgactagcctagagtatacgttgacaacgtattactttacgattaaccgaaataaacgtatcgtaaacttaaagtacctaacctacgtactttaccggttacgggacggtaaacgggtaccctaaggggtacgaagtacctaacgaaaaccgtaattcgggtaacgagtacgacctaccgtaatttcctacggttacctcgtaaccc

SEQ ID NO: 77746 - DNA, 687 bp, Homo sapiens
  misc_feature: GYAE6OF02JKIWH.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcgaggtgccagatgtgacatccggatcgacccagtctccatcctccctgtctgcatctgtaggagacaagactcaccatcacttgccaggccactcgaggactattagactaacttaatttaaattggtatacgagcaagaaaccgaggtaacgcccctaactcctagactctacgatcgactactaccgtaagtttaggaaacgtacgggtaccctaagtcgtaaaggttcaaggtaggtaagtggacttcggtaggtactttattttactactaccgattacgtactaccgtaactcgactacgtccgtaggtaagtacttacgtacgtaacaacgttacttagttaccgttaataccgtaaaacttaattaacggtataacttaaaccttacccttaaacctaccgtttacttaccggtttacggggaccgggtaaaccggtacccgtagggtagtacgaacgttaacccggaaaacggtaacgtttcgggtaacggtacccgttacggtaaccttaccggtacgttacccggtttagttacccgtttacgttaccccg

SEQ ID NO: 77747 - DNA, 610 bp, Homo sapiens
  misc_feature: GYAE6OF02IPW9V.49.81.H04.1.454.CMB.1.raw
  modified_base (219)..(219): a, c, t, g, unknown or other
  misc_feature (219)..(219): n is a, c, g, or t
  modified_base (581)..(581): a, c, t, g, unknown or other
  misc_feature (581)..(581): n is a, c, g, or t
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagcctcaacattgggaanaattatgtatcgtggtaccagcagttcccgaggaaccggccccagacctcctcattcatgaacaataaacaagcgacgtcccagagacttcctcgaccgattctcgtcggcctacctaagtcgtggccacctcacgcccacccgtgccatccaccggctccagaccgtcggggacgacgggaccgtatttaactacgtcggaccggaaacgtagtagggtacttcccgacgtccgtaggaggttggtgtcgtaggggttcggttcggacgggaggggaaccaggcctcggaccgtaccgtaggtcgacgaccgaggtccgtccggccccgttcggtcctacgttcccgttccggttaccccncccgttcctcctccgttccgtcgtacccg

SEQ ID NO: 77748 - DNA, 540 bp, Homo sapiens
  misc_feature: GYAE6OF02G7OPP.49.81.H04.1.454.CMB.1.raw
  modified_base (263)..(263): a, c, t, g, unknown or other
  misc_feature (263)..(263): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaatgtatcagcaagaaccaggaaacncccctaactcctgatctacgatgcataccaatttaggaaatacgggtccatcgaaggttcagtggaagtggatcgtggtacgttatttacttcactatcactcaactgcacgctagagtatatgacaactataacttacgtgtacaactaatatagtaataactacctaacctacttacgtacgtttcggacggtacggaaccgtaggtaggacgtataaccgaaacgtacgtcggtacggtctagcctaactcgttactacgttcctacttacccg

SEQ ID NO: 77749 - DNA, 698 bp, Homo sapiens
  misc_feature: GYAE6OF02GSJUI.49.81.H04.1.454.CMB.1.raw
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttccaggaaccggccccagactcctacattcatgacaataacaagcgacgtcccagacgtacttcctagaccgtattctcgtggcctaccaagtctggcctacctcacgcccacccgtcggacccactccgaacccggtacctcccgaacggaccggtacgggggaaccgtacgggacccgttaattttaaccgtttacgtcgggaaccgggtaaacgtaggtacggggtactttacccgacggtccgttagggtagttcgggttcggtacggtaggggttcggttcgggggacgggaacggggtaccgaaggtccgttacggacccgttccgtacggtacgaccgtacccgaacggtccgtcccgggtcccccgttacgggttacctaccggttaccgttccggtttccctccccggtcccctttaccccgttccgttcccttccgttacccgg

SEQ ID NO: 77750 - DNA, 207 bp, Homo sapiens
  misc_feature: GYAE6OF02GSIO4.49.81.H04.1.454.CMB.1.raw
  modified_base (201)..(207): a, c, t, g, unknown or other
  misc_feature (201)..(207): n is a, c, g, or t
tcagagtcgagagacacgaccggtgctcgatttagtagtgtagattcgcgggcacgaccggtgctcgatttagtagtgtagattccgcgggcacgaccggtgctcgatttagtcacgcgagaaagggaaggggctggccctgacgtgtttctgttcccgcctcctctctctcgactctgagcggctggcaaggcgcatagnnnnnnn

SEQ ID NO: 77751 - DNA, 723 bp, Homo sapiens
  misc_feature: GYAE6OF02H8PF9.49.81.H04.1.454.CMB.1.raw
  modified_base (216)..(216): a, c, t, g, unknown or other
  misc_feature (216)..(216): n is a, c, g, or t
tcagagtcgagagacacgaccggtgctcgatttagtagtgtagattcgcggggggggacaatcttcatcatgacctgctccctctcctcctcacccttctcattcactgcacagggtcctgggcccagtctgtgttgacgcagccgcctcagtgtctgcggcccaggacagaaagtcaccatctcctgctctggaagcagctccaacattgggaanaattatgtatcgtggtacagcagttccaggacgccccagactcctcattcatgacaataacaagcgacgtcccagagtacttcctgaccgtattctctggctccaagtctacggcacctccacgccacccgtggacccataccgacccggactccgacggtacgtcggggaacgtacgggaccgtaagtttacgttacgtggaccggtaaacgtagtcggggtaacttccgaacggtcccgttaggtacggttcggggttcgttacggttacggggtcggtttaccggggacggggtaaccggggtaccgaaaacggtccggttaaccgggtaacccgttacccgtttagggtacccgtaacggggtaccccgaaacgggttcccgttaaccgggggtcccccctttaccggggttccctaacccgttttcccgtaacccgggttttcccccaacccccgtttccccgttccccgtttaaccttcccccggttaccggttaaccccg

SEQ ID NO: 77752 - DNA, 579 bp, Homo sapiens
  misc_feature: GYAE6OF02HV27A.49.81.H04.1.454.CMB.1.raw
  modified_base (269)..(269): a, c, t, g, unknown or other
  misc_feature (269)..(269): n is a, c, g, or t
  modified_base (438)..(438): a, c, t, g, unknown or other
  misc_feature (438)..(438): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagctaacttaatttaaatggtatcagcaagaaaccagggaacncccctaacctcctagatactacgatgcatcctaatttaggaaagtacgggtccataccaaggttcagtggaagtgatcgtagggtacttaattttcttacacctatctatacgtaacctgacacgcctaggaacggtattagtacgactaactatattactagtacaanatatataattactactacacttacctaacgtttcgggacggtacgggaaccgtacgggtaggtagacgttaaccggaaaacgtacgttggtacggaccttacgacccgtactaacgtttccgttacgttcctttatacccg

SEQ ID NO: 77753 - DNA, 746 bp, Homo sapiens
  misc_feature: GYAE6OF02ILMOP.49.81.H04.1.454.CMB.1.raw
  modified_base (190)..(190): a, c, t, g, unknown or other
  misc_feature (190)..(190): n is a, c, g, or t
tcagagtcgagagacacgaccggtgctcgatttagtagtgtagattcgcgggggagtcccaaccaggacacagcatggacatgagggtcccctgctcagctcctggggctcctgctgctctggctctcaggtgccagatgtgacatccggatgacccagtctccatcctccctgtctgcatctgtagganacagaatcacatcacttgccagcgactcaggacatagactaattatttaatggtatacagcaacgaaaccgaggaaacacccctaacctcctagactactaacgactagtaccataccgtaagtttaggaaagtacgggtaccatacgaaggtcagtaggaagtcggatacgtaggtacgtattttacctacgacctagtacacttcgtaaaccgtgacctaacggtcctaaggtaacggtacttaagtttacgaaccgtaaacttacgttaactttaaccgttagtaaaccctaaacgttaaattaacgtttaacgtaaacgtttaaaaccgttacccttaaaccccggtttaacttttacccggttaaaccggtttacccggggaaaccggggtaaaccgggtaaaccgtaccgggggttaaggtaaccggtaaccgttaaaccggtaaaaccggttaacccggttacgggttaccgggtaaccttaacggtaccccggtaaactttaacgggttacccgtttaccgtttaccggttaacccctttaaccccgg

SEQ ID NO: 77754 - DNA, 658 bp, Homo sapiens
  misc_feature: GYAE6OF02HQ82X.49.81.H04.1.454.CMB.1.raw
  modified_base (274)..(274): a, c, t, g, unknown or other
  misc_feature (274)..(274): n is a, c, g, or t
  modified_base (409)..(409): a, c, t, g, unknown or other
  misc_feature (409)..(409): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaacttatttaaatgtatcagcagaaacaggaacgacccctaaccncctgactctacgatgcatcctaatttaggaaagtagggtaccatacgtaaggttcaggtggaagtggatcgtgggtacttattttacttacactatactaatactaacttgacacgtccgtagaggtattagttnacgtaaactattaacgtttacttacgtactaaacaaattacgtaagtaattaaacgttaccttaaaccctaaccttaccttaaccggtttaccggggtaccgggtaaacggggtaacccgtaacggggttacgggtaacgtaacgttaaacccgaaaaccgggttaaccgttacggggttaccggtacgttaccggtaacccgtaacccgtaacgtttacctttaccggtttaccctttcttaaccccg

SEQ ID NO: 77755 - DNA, 574 bp, Homo sapiens
  misc_feature: GYAE6OF02GU372.49.81.H04.1.454.CMB.1.raw
  modified_base (271)..(271): a, c, t, g, unknown or other
  misc_feature (271)..(271): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatccctccctgtctgcatctgtaggagacagaatcaccatcacttgccaggcactcaggacattagacaacttatttaaattggtatcagacaagaaaccagggaaacncccctaaacctcctagactctacgatcgcataccaatttaggaaagtacggggtacccatacgaaggttcaaggtagggaagtggatcgtagggtactttattttacttcactatctatacaacctncagtcctaggagatattaganaacattattactagtacaaactatatagtaataactacctaaccacttactacgtttaccgggacggtacgggaaccacggggttaggactaagtaaccgtaaaggtacctaggtcggctacgaccaccggtattcgttgttaccttactacccg

SEQ ID NO: 77756 - DNA, 662 bp, Homo sapiens
  misc_feature: GYAE6OF02GYKUI.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctaccaacagttagggaagtaattatgtatcgtaggtaccagcagttcccaggaaccgccccagactcctcattcatgacaaataacaagcgagtcccagagacttcctagaccgattctacgtggtacctccaagttctcggacctacctacacgcctaccctcggcccactccgaccggtacctacccgagtaccggtcggggaacgacggaccgtatttacgtacgtgacggaactagtagggtactccgagcctgtaggtggtcgtcgtagggttcgtccggggtacggacgggacccgaagtccgtacggtacccgtacgttacgggaccgtacggaccccgtaaggtccgtaccgggtcccccgttacgggtaccctaccgtttcccgggttacccggttccccgtccccccgttcccgttacccgtttcccgttacccgtcccgttaaccccg

SEQ ID NO: 77757 - DNA, 897 bp, Homo sapiens
  misc_feature: GYAE6OF02JVLOL.49.81.H04.1.454.CMB.1.raw
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
tcagagtcgagagacacgaccggtgctcgatttagtagtgtagattcgcggggggacgaatcttcatcatgacctgctcccctctcctcctcacccttctcattcactgcacaggtcctgggcccagtctgtcgtgacgcagccgcctcacgtgtctgccggaccccaggaccagaaacgtcaccattcctaccngcctctaggaanccagcctaccgaatagttaggggaaataacgtttatcggtaacttcggtacgggtaaccacggccgtaagtttaccccgaggtaacccggaccccacgtacctaccacgttactacgactacgtaaccaaagttaaccaaagtccgaaccggtaccccgaagacgtaacgttacccgtacggtaacccgtaacttttcccgtacccgttagggtacccgttaccccgtaaaggtttcccgtacggggtaccaccccgttaccggaacctacccccgaacccgttcgggacccctaaccgttcccggtaaaccccgggttaaccctacccccgggttaaggaaacccgggttccgggggtaaacccggggaacccgggttacccgggtaaacgtttttaacgggttaaacccgttaccggggaaccgggaaacttaccgggtacggggttaacctttacccgggaacctttaccggaccggttagggttacgggttaccggttacggtacggggttcggtttacgggaacgggtaccgggtaacgtaaccgggtactaccggggtacccgttacggttaccggaacgtccggaaccgtacggtcaaccgggtccccggttcgtaccggtcccttacgggtccccgttacccggttaccctcccgttacgttcccttaccgaccgtttcccg

SEQ ID NO: 77758 - DNA, 536 bp, Homo sapiens
  misc_feature: GYAE6OF02FLWW6.49.81.H04.1.454.CMB.1.raw
  modified_base (190)..(190): a, c, t, g, unknown or other
  misc_feature (190)..(190): n is a, c, g, or t
  modified_base (267)..(267): a, c, t, g, unknown or other
  misc_feature (267)..(267): n is a, c, g, or t
tcagagtcgagagacacgaccggtgctcgatttagtagtgtagattcgcgggggagtcccaaccaggacacagcatggacatgagggtccctgctcagctcctgggggctcctgctgctctggctctcaggtgccagatgtgacatccggatgacccagtctccatcctccctgtctgcatctgtagganacagaatcaccatcacttgccaggcgactcaggacattagcaactatttaaatggtatcagcagaaaccagggaacncccctaactcctagactctacgatgacatccaatttggaaatagggtccatcaaggtcaggtggaagtgatcgtgggacttatttacttcactatcatacaactgacacgtcctaggaggtattagttcgacctaatataatttactgttacaactaaatatagtaataactctaacctactactacgtttcggacggtacggacctagggtaggtacatacgaaacgtacgttggtgacgtagacaccgtattcgtcgttactctacg

SEQ ID NO: 77759 - DNA, 894 bp, Homo sapiens
  misc_feature: GYAE6OF02HWXCA.49.81.H04.1.454.CMB.1.raw
tcagagtcgagagacacgaccggtgctcgatttagtagtgtagattcgcggggggacaatcgttcatcatgacctgctcccctctcctcctcacccttctcattcactgcacagggtcctgggcccagtctgtgttgacgcagccgcctcagtgtctgcggccccaggacagaaagtcaccatcctctgctctggaagcagctaccaacagttagggaagtaacttagtgtactccggtaggtaaccctacggcctaacggtttccccaacgggtaacccggtaccccccgaaggaacccttccctacctactttccaattacggaacctaaataaaccgaaaggtaccgaaccgttacccgaaggtaacgtaactttcccgtacgacccgtaatttccgtacgtcgggtacctacccgtaaagttccgtacggacctaacccgttcgaacgtcccctaaccccgttacgggaccctaacgttcccgaacccggtacctacccgaacggtaccggtacgggggaccgtaacggggtacccgttaagtttaaccgtttaacgttacgggaacccggtaaaacgttacggtacggggttaaaccttacccggaacgttcccgttaaggtacgggttcggggtacgttaccggggtacggggtttacgggtttacggggacccgggggttaaacgggaaacccgtaaacgggtccgtaccgggttaaccccggttccgtaaacgggtcccaaccgggtaaccccgtaacgggtccgttacccggggacccccggtttcgggtaacccgtaccccgtttacccggttaccccggtttcccccccggttaaccccgttccccgtttacccgttccgtttacccggtacccgttaccccg

SEQ ID NO: 77760 - DNA, 786 bp, Homo sapiens
  misc_feature: GYAE6OF02I71M2.49.81.H04.1.454.CMB.1.raw
  modified_base (323)..(323): a, c, t, g, unknown or other
  misc_feature (323)..(323): n is a, c, g, or t
  modified_base (389)..(389): a, c, t, g, unknown or other
  misc_feature (389)..(389): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaagcagctaccaactagttagggaataattatgtatcgtggtaccagcagttcccaggaaccggccccagacctcctacattcatgaacaaataaacaagacgacgtacccagaagtactttaccngaaccgtattctacgtcggctaccaagtctcggcctaccgtcacgacctacccgtggtacttaacnccgaacccggtacttaccgaaggtaccggtacgggggaacgacgggtaccgttaaacggtttaacttaccgtaacgggaccggtaaaactacgggtttacgggtaacctttacccgacggtaccgttagggtaacgggttcgggttacggtaccggttaagggggttccgggtttaccggggaaccggggtaaacggggaaacccgaaaagggtccggttaccggtaacccggttaaccccggtaagggttcccaaacgggacccccgtaaagggtcccggttaccgggtccccccggttaacggggttacctaaacccggtttcccgttacccggtttccccccgtaccccgtttacccgttcccggtttaacccttcccggtaacccgtacccgg

SEQ ID NO: 77761 - DNA, 754 bp, Homo sapiens
  misc_feature: GYAE6OF02H12OG.49.81.H04.1.454.CMB.1.raw
  modified_base (205)..(205): a, c, t, g, unknown or other
  misc_feature (205)..(205): n is a, c, g, or t
  modified_base (226)..(226): a, c, t, g, unknown or other
  misc_feature (226)..(226): n is a, c, g, or t
  modified_base (377)..(377): a, c, t, g, unknown or other
  misc_feature (377)..(377): n is a, c, g, or t
  modified_base (393)..(393): a, c, t, g, unknown or other
  misc_feature (393)..(393): n is a, c, g, or t
  modified_base (430)..(430): a, c, t, g, unknown or other
  misc_feature (430)..(430): n is a, c, g, or t
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctcgtggaacgcngcctccaaactagttgggaanaattatagttatcgtggtaccagcagttcccaaggaccggccccagtcctcctcatcatgacaatacaagcgaactccaagagtacttccgtagaccgtatttactcgtacggtcctacctaacggtcgtcggcctaccctagaccgcccncccgttacgccgtacnccgtaccggacttaccgacgacggtcgggggaaccgnggtacccgaatttacgttaaccgtcggaaccggtaacgtaagttcgggttacctttacccgaacggtcccgttggtaacggtttcgggttacgtaccgggtagggtttaaccggggttccgggtaacggggtaccgggtacccgtaaacggtcggttacccgggtacccgtttaaccggtacggttaccggaaccgacccggttaaccgggtaccggtcccgggtaacccccgttccggtaacccgttacccggtcggtttacccccggtttcccgttcccccgttacccgtttcccgttacccgttccggtacccttccccgg

SEQ ID NO: 77762 - DNA, 813 bp, Homo sapiens
  misc_feature: GYAE6OF02IRT4A.49.81.H04.1.454.CMB.1.raw
tcagagtcgagagacacgaccggtgctcgatttagtagtgtagattcgcgggggggggacaatcttcatcatgacctgctcccctctcctcctcacccttctcattcactgcacagggtcctgggcccagtctgtgttgacgcagcccgccctcagtgtctgcggccccaggacagaaagtcaccatctcctgctctggaagcagctccaaacattgggaataattatgtatcgtggtaccagcagttcccaggaaccgccccagactcctcattcatgaacaaataaacaagcgacgtacccaaggagtacttcctacgaaccgtattctcgtcggtacctaccaaagttcgtggacctacctcgaacgccccaaccccgtcgggaccctaacgtacccgaacccgggtacctacccaacggtaccggttaggggggaaccgtacgggacccgtaaatttaaacttaaccgtacggaccgggtaaaacgtaggtacggggtaactttacccgaaggtcccgttagggtaggtacgggttgttacggagggggttcggtttacggggaccggggtaacgggtaacccgaaaggtccggttaaccggtaacccggtttacccggttaaacgggtacccgtaaaccgggtaacccccggtaaaggggtccccgttaacccgggggtcccccccgtttaccggggttacccgtaaccccggtttcccggtttaccccggttttacccccccggtaccccccgtttacccgttttccccggtttaccccgtttaccccggttacccggtaaaccccg

SEQ ID NO: 77763 - DNA, 687 bp, Homo sapiens
  misc_feature: GYAE6OF02JIDNW.49.81.H04.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgcctcagtgtctgccggccccaggacagaagtcaccatctcctgctctggaancagctaccaanattgggaataattatgtactcgtggtaaccagccgtagttcccaaggaaccggtcccccagacctccgtcattccgatcgaacaataacaagcgacgtaccagtagacttccagaccctattcctcgtcggtcctaccaacggttccgtagccctacctacgtacgcccctacccgttcgacccagtacccgaccggaccttaccggacgtacggtcggggaaccgtagggtacccgtaattttacgtaaccgtcggtaaccggaaacttggtacggtcttacccgaggtcccgttaaggtacggttacgggtcgtacgtaggggtttcgtacggggaccggtaacgggacctacggtcgtacggaccgtcgttagccgtacgacccgtaggtccgtaccgtcccggttacggtacctaccgttccgtaccgtttcccccgaccgtttcccttaccgtaccgttccgtaccgtaccgg

SEQ ID NO: 77764 - DNA, 706 bp, Homo sapiens
  misc_feature: GYAE6OF02GIU9F.49.81.H04.1.454.CMB.1.raw
  modified_base (343)..(343): a, c, t, g, unknown or other
  misc_feature (343)..(343): n is a, c, g, or t
  modified_base (358)..(358): a, c, t, g, unknown or other
  misc_feature (358)..(358): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcacatctctgctctggaagcagcctaccaacgagttagggaaataattatgtatcggtaggtaccagcctagtcccgaggaacccggccccagactcctcattcatagaacaataacaagacgatccagagtacttcctgacctattctgtcgactacaagtccngcctacctacgaccnccctacccgtcggaccctacgtaccgaacccggtacctacccgagtaccggtacggggaaccgacgggccgtaatttacgttacgtacgggacggtaaactacgtacggggtaacttacccggacggtccgttacggtaacggttcgggttacggtaccgttagggggtacgggtttaccggggacggggaaaccgggtacccgtaacgggtccgtaccgggtaacccgttaccgtagggtacccacggtaccccgtaggtcccgtaccgggtccccgtacggtacccgttaccgttcccggttcccgtttcccccctcgttcccttccgttcctccggttactccgg

SEQ ID NO: 77765 - DNA, 702 bp, Homo sapiens
  misc_feature: GYAE6OF02H6YFZ.49.81.H04.1.454.CMB.1.raw
  modified_base (188)..(188): a, c, t, g, unknown or other
  misc_feature (188)..(188): n is a, c, g, or t
  modified_base (275)..(275): a, c, t, g, unknown or other
  misc_feature (275)..(275): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtagganacagaatcacatcacttgccaggcactcaggacattagactaacttaattttaaaattggtaatcgaagacaagaaaccagggaacncccctaaacctcctagatctaacgatcgactatcctaaagttttagggaaaacgttcggggttaccccaagttaccgtaaaagggtttccaaggttagggaaaggttgggtaacttcggttagggggttaaaccttttacgttttttaacccgttttaccaacccgttattaccgactttaacccgtaaacccttgaccgtaacggtcccgttaggaacgggtaacttaacgttacgaactaaacgttatttaacgtttaactacgttacctaaactaaattaatagtaaacttaaactaccgttaacctaaccttaccgtaacgttttaccggggacgggtaacggaacccgtagggttacgacgtaactacgaaacgtaccgtggacgtcgtagacctacctatccgttcgttaccttactaccg

SEQ ID NO: 77766 - DNA, 710 bp, Homo sapiens
  misc_feature: GYAE6OF02FK21J.49.81.H04.1.454.CMB.1.raw
  modified_base (188)..(188): a, c, t, g, unknown or other
  misc_feature (188)..(188): n is a, c, g, or t
  modified_base (255)..(255): a, c, t, g, unknown or other
  misc_feature (255)..(255): n is a, c, g, or t
  modified_base (685)..(685): a, c, t, g, unknown or other
  misc_feature (685)..(685): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtagganacagaatcaccatcacttgccaggcactcaggactagttagactaacttaatttaaattggtatcanacaagaaaccgagggaaacgcccccttaacctcctagacttctacgatcgactactacctaagtttaggaaagttcggggtaccctagtacgtaaggttcgtaggtagggtaaacggtggtacgttcggtagggttaacgtttaatttttaccgttacctaacctaacgttccgtaataacccgtacgtcggtactacgtaccgttaggtaacgtacgttaggttaccaaacttaacctaacgtttaacgtttcccgtaagttaaccaaaaccttaagtatttaaccggtaattaaccgtacttaaccctaccgttaccgtttaaccgggttaccgggtaccgggtaaccggtaaccggtaccggggttacgacgtaaccgtaacgtaaaacggtacggttaccggtggtacctacggacctaccggttnttaccggttcgttactccttacccg

SEQ ID NO: 77767 - DNA, 861 bp, Homo sapiens
  misc_feature: GYAE6OF02GJAO5.49.81.H04.1.454.CMB.1.raw
  modified_base (135)..(135): a, c, t, g, unknown or other
  misc_feature (135)..(135): n is a, c, g, or t
tcagagtcgagagacacgaccggtgctcgatttagtagtgtagattcgcggggggacgaagtcttcatcatgacctgctccctctcctcctccacccttcctcacttcactgcacaggtcctggcccagtctgtnttgacgcacgccgccctcacgtgtcgtgccggcccccaggtaccagaaacggtaccaccaatcttccgtcgcctacctagggaaacgcacggtaccttacccgaaaccacggtttaggggaaacgtaaatttaacgtggtttaactaccggttcgggttaacccagcccgttaacgtttcccggaaggaaccccggaccccgacgaccgtcccgtacctacgtttccaagttacgaacctaaataaccgaacgtacgacgtaaccgacacggtacttacgacggacctacttctacgtacggccgttacctacggtcttcgggacctacccgtagtacccggaccctacccgtaccgggaccctacaccgtaacccccgggaacttcccggaaccggtaacggttccgggggaacgaccgggaccgtaacgtttaaccgtaacgttcggaaccggtaacgtacggttacggtacgttacccgaacggttaccgtacggtacggttcgggtacggtacggacgggtttcggaccggggttacggacgggtaccgggacggtacgggtaccggttaccggaccgttacgggtaccgaccgttacccggaggtaaccccggtccggttccccgggtaaccggggtccttaccccgggtacgtttaacccccgggttcccgtacccccgtttcccgtacccttcccggtttaacccggtcccttccccgg

SEQ ID NO: 77768 - DNA, 715 bp, Homo sapiens
  misc_feature: GYAE6OF02FFP6T.49.81.H04.1.454.CMB.1.raw
  modified_base (279)..(279): a, c, t, g, unknown or other
  misc_feature (279)..(279): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatcgacccagtctccatccctccctgtctgcatctgtaggacgacagaactcaccatcacttgccaggcgactcaggacattagactaaactatttaaattggtatcagcaacgaaaccgaacgggaaacnccccctaactcctagacttacacgtatgactattacctaagttttacggaaagttaccggggtacccagttacaaggttcaggtagggtaagtggattcggtagggtactttatttaccttacgacctatcctaataccaacttgacaacgtccgtaggaaggtacttaacttacgaactaaacgtatttaacgttacgtataaccgtaaactaaagttacgtaagttaacttaaaccgttcccttaaacccgtaaccgtttacgttaaacccgggttttccgggggaaaccggtaaccggggtaacccgtaacggggttagggtaacctaaccgttaacccggtaaaaaccggtggttacggttacccggtaacgttccggaaccttaacccgttagtttacccgtttaccgttaccgtttaccgttaaccccgg

SEQ ID NO: 77769 - DNA, 689 bp, Homo sapiens
  misc_feature: GYAE6OF02GKBM3.49.81.H04.1.454.CMB.1.raw
  modified_base (271)..(271): a, c, t, g, unknown or other
  misc_feature (271)..(271): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaaacagttgggaagtaattatgtatcgtggtaccagcagttcccaggaaccgccccagactcctnattcatgacaataacaagcgacgtcccagacgattcctgaccgattctctggcctaccaagtctggccacctcacgcccaccctggcccactccgaccggacctcccgaacgtacggtcggggacgacgggcccgtaatttaacgttacgtggacggaactagtcgggaacttcccgacgccgttggacggttgggttgtacggtagggttcgggttcggggccgggaacggggtaccgaaacgggtccgtaccggtaccccggttccgtaacgggtccgaaccggccccgtaacggggtccgttacccgggtccccccggttacggggttacccctaaccgtttcccgttcccggtttaccccccgtaacccccttccccgttccctttacccgttccccgttacccggttaccccg

SEQ ID NO: 77770 - DNA, 555 bp, Homo sapiens
  misc_feature: GYAE6OF02FJ73T.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgtattctctggctccaagtctggcacctcagcccaccctggccatccaccggacctccacgacgtggggacgaggccgtattacttactgcggaacagtgggacttaccgagtcctgagtggtgtcgtagggtgttcgggcgggagggaccaagctcgaccgtcctaggtcacgcccgaggcctcggcccccgtcggtcctaccgttccgtcgttccccacccgttccctctcccttctccgtacc

SEQ ID NO: 77771 - DNA, 797 bp, Homo sapiens
  misc_feature: GYAE6OF02IWBFS.49.81.H04.1.454.CMB.1.raw
  modified_base (200)..(200): a, c, t, g, unknown or other
  misc_feature (200)..(200): n is a, c, g, or t
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgccggccccaggacagaaagtcaccatctctgctctggaancagctaccaacagttgggaagtaattatgtatcgtggtaccagcacgttcccaggaaccgcccccagacctcctctattcatacgacaataacaagtacgagtacccaagagtaacttcccgtacggaaccgtactttcctcgtacgggccttaaccgaacgtttccacgggtccaacccgttccaaccgtccccctaacccccgttcgggtaaccccacgttaacccgaaccccggggtaacccttccccgaaacgggtaacccgggttacggggggaaacccggtaacgggggaccccgttaaacgttttaacgtttaaaccggtaccggacgggttaaaccctaagggttacggggttaaacctttacccgagggttacccttagggtacggtttggggttacgtaccgggttacggggtcgggtttaccgggaccggggtaacgggtaaccgaaacggtccggttacggtacccgggttaccgtacggttaccgaccgacccggaaggtcccgttccgggcccgttccggtacctccgttccgtaccgtttcccccggtacctttcccctcgtcccgttccgtacccgtccgg

SEQ ID NO: 77772 - DNA, 910 bp, Homo sapiens
  misc_feature: GYAE6OF02GWQ2Z.49.81.H04.1.454.CMB.1.raw
tcagagtcgagagacacgaccggtgctcgatttagtagtgtagattcgcggggggggacaatcttcatcatgacctgctcccctctcctcctcacccttctcattcactgcacaggtcctggcccagtctggtgttgacgcagcccgccctcagttgtctggccggtaccccaggaccaagaacgtcaccatcctcctgctcgtggaacgcagcctaccaacgtaggttaaggggaaagtaatttattgttacgtcggttacggtacccaggtccttacggttaccccgaacgggtaacccccggtcccccaaggacccttaccctactaactttccgagtacgaaaccgtaaataaaccggaacggtaccgtaccggtaccccgaaggtacgttaccgttacccggtacggaacccttagtttcccgtcgtacggtaccgttacctaaggtccttacggacctacccgtaccgaccgtccccgttaacccgtcgggtaccctaaccggtccccggtaacccgggttaccctacccgaaccggtaaccgggtcggggtaaaccggacggggtacccgttaaacgtttaacggttacggtacgggtaaccggtaaacgtacgggttacgggtaacctttacccggaacggttccggttaacgggtacgggttaccgggttacgttacccggggttagggggtcccgggtttaccggggacgggggttaaacccggaacggttaaaccggccgggtttaaccggtaccgtttaccgggtaaggttaccggaccggtaccccggtaacggtcccgggttacccggtaccccggttcggtaaccctaccggtttccccgtcccgtttacccccgcccgtttaccgttcccctttacgtcccgtaccggttcccg

SEQ ID NO: 77773 - DNA, 812 bp, Homo sapiens
  misc_feature: GYAE6OF02J0I23.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaagcagctaccaacattgggaataattatgtatcgtggtaccagcacgttcccaggaccgccccagacctcctcattcatgaacaataacgagacgacgtcccagacgtattcctacgaccgtacttctcgtcggccttaccgaagttccggtcggaccaccttccgacgccccgtaacccgtcggaccctaactaccgaacccgggtaacctcccgaacgggtaccgtagggggaacccgtacggggtacccgttaatttaacgtttaacgtccgggaacgtaaaccgaaggttacggggttaccttaccgaacggtccgtgggttacgggttacgggttcgggtaacggttacgggggtttcgggttaccggggaccggggtaaaccgggaaccgtaaccgggtccggttaaccgggtaacccgtttacccggtaaaccgggttccgaaaccgggaccccgggtaacggggtacccgttacccggggtaccccccggttacgggttacccgtaaccccggttttccccgttaacccccgggttttaccccccctccccgtttaccccggttttaccccgttcccgtttaccccggtacccggtttaacccggg

SEQ ID NO: 77774 - DNA, 759 bp, Homo sapiens
  misc_feature: GYAE6OF02HY3RE.49.81.H04.1.454.CMB.1.raw
  modified_base (185)..(185): a, c, t, g, unknown or other
  misc_feature (185)..(185): n is a, c, g, or t
tcagagtcgagagacacgaccggtgctcgatttagtagtgtagattcgcgggggggacaatcttcatcatgacctgctccctctcctcctcacccttctcattcactgcacagggtcctgggcccagtctgtgttgacgcagccgccctcagtgtctgccggcccaggacagaaagtcaccatcncctgctctggaagcagcctaccaaactagttaggggaaataatttagtagtaacttcggtacggtaacccagtctacggttcccgaaggaaccggcccccagacctcctcattaccatcgaaactaactaaacgaacgtacgacgtacccgaagtacgtaacttccgtacgaaccgtattcgtcgtcggctaccgtaagtcgtcggcctaccgtcgacgacccaccgttcggacccactaccgacccggtactacccgacggaccggtacggggaaccgtacgggtaccgttaacgtttaacttaccggtcggtaaccggaaacgtagggtacgggtaaccttccgacgtcccgttagggtacggtaggttccggtacggacggggttacgttaccgggggacgggaaacgggtaacccgtaacgggtaccgtaccggtaacccgttaccggtacggtaccgacggtacccggaccgggtcccgtacgggtccccgttacggtcccgtaaccgttcccgttccgttacccccgtacccgttcccttacccgtccgttcccgtaccggttacccg

SEQ ID NO: 77775 - DNA, 598 bp, Homo sapiens
  misc_feature: GYAE6OF02F72T6.49.81.H04.1.454.CMB.1.raw
  modified_base (187)..(187): a, c, t, g, unknown or other
  misc_feature (187)..(187): n is a, c, g, or t
  modified_base (428)..(428): a, c, t, g, unknown or other
  misc_feature (428)..(428): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaganacagaatcaccatcacttgccgaggcgactcgaggactattacgactaacttaatttaaagttggtatcgagacaacgaaacgagggaaaccgtaccccctaaacctcctagacttaccgtacgtacgtacgactacttacctaaagtttacggaaaacgttcgggtacctagtacgtaaggttcaggtaggaagttggacgtgtaggtacgtttatttactacactatactactacactnacgtatcgtagagtattatagactaactattacttacgtacgtaacaaacgtaatatctaattaactactacctactcgtacgttcgggacgaccggacgtacgggtagacagtaaccgaagtacgtgtacgtacacggactaccgtagttcgtcgttacttcgtacccg

SEQ ID NO: 77776 - DNA, 761 bp, Homo sapiens
  misc_feature: GYAE6OF02G07XF.49.81.H04.1.454.CMB.1.raw
tcagagtcgagagacacgaccggtgctcgatttagtagtgtagattcgcgggggggacgaatcttcatcatgacctgctcccctctcctcctcacccttctcattcactgcacaggtcctgggcccagtctgtgttgacgcagccgcctcagtgtctgcggccccaggacagaacgtcaccatctcctgctctggaacgcacgctaccaacagttagggaagtaattatgtatcgtggtaccagcacgttccaaggaaccggccccagacctacctcgattccatcgaacaactaacaagccgacgtcccaggagtaccttccacggaaccgtactttccttacgtcggacctaccgtaagttccgtcgggaccacctcgaacgtccccaaccctgggaccccacgtaccgaaacccggtaccttcccgaacggtaccggttacggggaaccgtaccgggtacccgtaaagttttaaccgttaccggtagggtaacccgggttaacctaagggtacgggggttaacctttacccgaacggtcccgttaagggaacggtttcgggtacggttacgtaacgggggtttgggttccgggaccgggtaaggggtaaccctaaaggttcccggtaacgggttaccccgtcggttaaacggaccgaccgggtaccccggtaaggtccctaccggggaccccgtttcggtaccgtacccgtacgttcgttaccccgccctacccgttcctacctccgtacgttacccg

SEQ ID NO: 77777 - DNA, 704 bp, Homo sapiens
  misc_feature: GYAE6OF02IFBP2.49.81.H04.1.454.CMB.1.raw
  modified_base (200)..(200): a, c, t, g, unknown or other
  misc_feature (200)..(200): n is a, c, g, or t
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaancagctccaacattgggaagaattatgtagtcgtggtaccagcagttcccaggaccgccccagacctctcattcatgacaataacaagcgacgtacccgagagtacttcctgaccgattctcgtggcctccaagtctggactacctcacgcccacccgtggacccatccaccggacctaccgacgtacggtcggggaccgtacgggccctaatttaacttaccgtggtaccgggaaactacgttagggaacctttcccgaacggtccctagggtaggttcgggtacggttcgggacggggtttccggtacgggggccgggtaaccgggaccgtaaacgggtccgttaacggacccggttaacccgtacgggtaccaaccgggtacccgaacgggtcccttaccggggccccccgttaccgggtaccgtaccctcccgtttccggttacccccccttacccggttaccccttcccgttacccgtttacccgtaccggttaaccccg

SEQ ID NO: 77778 - DNA, 726 bp, Homo sapiens
  misc_feature: GYAE6OF02JX8P2.49.81.H04.1.454.CMB.1.raw
  modified_base (223)..(223): a, c, t, g, unknown or other
  misc_feature (223)..(223): n is a, c, g, or t
  modified_base (707)..(707): a, c, t, g, unknown or other
  misc_feature (707)..(707): n is a, c, g, or t
tcagagtcgagagacacgaccggtgctcgatttagtagtgtagattcgcggggggacgaatcttcatcatgacctgctccctctcctcctcaccttctcattcactgcacaggtcctggcccagtctgtgttgacgcagccgccctcagtcgtctcgccggccccaggaccagaaacgtcaccatcgtcctgctcgtcggaagcagctaccacagttgggaanaattatcgtaatcgtcggtaaccagcgacgttaccacggtaaccgccccaagtacctacctacgtactaccagtacgtaaccaaactaacaacgacgtaacgtaccccgaagacgtaactccgtacgaccggtaattccgtacgtacgaccttacctaacggtcgtacggacctacctcgtaaaccgcctaaccccgtacggtacccacgtaacctacccgggaccttaccgacggaaccggttacggggaacgtacggaaccgttaacttacgttaacctcgggaccggtaaactacggtacggtaccttacgacgtaccgttagtaggtcgttcgtacgagggtttcgttacgggcggtaacggacccgtaaaggtccgtacgtaccggttcgtacggacgaacgtccgacgtacgtcccggtaaccggttcggacctaccgtaccgtttcccgtaccccggttacccgtcttaccccggtnttaccccgtacgttaccgg

SEQ ID NO: 77779 - DNA, 678 bp, Homo sapiens
  misc_feature: GYAE6OF02I0XK3.49.81.H04.1.454.CMB.1.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (318)..(318): a, c, t, g, unknown or other
  misc_feature (318)..(318): n is a, c, g, or t
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagcccgccctcagtgtctgccggcccaggacagaagtcaccatctcctgctctggaagcagctccaacngttgggaanaattatgtatcggtgtaccngcagtccaggaccgccccagacctctacacttcatcgaactaaataacaacggcgacgtacccagtacgtacttccgnggaacctatttcctacgtggtccctacgtaacgttcgcggacctaacctcgacgccctacccgtcggacccacgttccgaacccggaccttaccccgaaggtaccgtcggggaaccggacgggtacctaaacgttttaccttaacggccggaacgggtaacctaggtaagggtaccttacacggttacggtacggtaggtcgggttacgtcgggtacgggtccggttacggggacgggaacgggaccctaagggcgtacggtaccgttcgaggtccaacggccgacggctaccgggtccctagggtacctcttcccggttccgtccccgtcccttccgtaccttccgtcgtacccgtacg

SEQ ID NO: 77780 - DNA, 703 bp, Homo sapiens
  misc_feature: GYAE6OF02JQE5J.49.81.H04.1.454.CMB.1.raw
  modified_base (191)..(191): a, c, t, g, unknown or other
  misc_feature (191)..(191): n is a, c, g, or t
  modified_base (267)..(267): a, c, t, g, unknown or other
  misc_feature (267)..(267): n is a, c, g, or t
tcagagtcgagagacacgaccggtgctcgatttagtagtgtagattcgcggggagtccgaaccaggacacagcatggacatgagggtcctgctcagctcctggggctccgtgctgctctggctctcaggtgccagatgtgactatccggatcgacccagtctccatcctcctgtctgcatctagtacgganacgagatcaccatcactgacaggcgactcagacattagcaatattaatgtatacagacaagtaaccgagggaaacnccccgtaactaccgtacgtataccgttaacgagtacgactaacgtacccttaaagtttaggaaaacgttcgggtaccctaagtactaacggttgaacgtaggaaacgttggaacgttagtacggggtaacttttacttttaacggtacctaacctaactagtcttaaaccgtacctggtacctaggtaccctaaggtacggtaacttaacgtttagaccttaaaacgtatttaaaccgttagtctaaaacttaaacgaaactttaagtacgtttaaaactagttaaccctttacgtaaacttaccgttaacccgtttcgggaaaccgggacggttaaccgaacgggttacggtaactaacggttaaaccaaacggttaccgtaaggtacgggccttaaccgactaaccgtagtttccaacgtttacgtctaacccg

SEQ ID NO: 77781 - DNA, 683 bp, Homo sapiens
  misc_feature: GYAE6OF02IL1VH.49.81.H04.1.454.CMB.1.raw
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctcgtggaagcagctaccaactagttagggaagtaattatgtagtcgtaggtaccagctacgttcccgaaggaacccggccccagacctcctacattcatgacaataacaagcgacgtacccaaggacgtacttccgtaggaaccgtatttctcgtcggtcctaccgtaagtccgtaggacctaccgtcgaccgcccgtacccgtcggaccctacgtacccgaccggacctacccgaacggaccggtacgggggaacgtacggtaccgttatttaacgttacggtcggaacggtaactaggtacgggtacttaccgacgtaccggtaggtacgttgggtcgtacggtagggttcggttcgggacggggacggaaccgagtccgtacgacccgtagtacggacaccgaccgaggtccggtcccggtacccttcggtacctcgttccgttaccggttaccccctccgttcccttccgtacttcccgtccgtacg

SEQ ID NO: 77782 - DNA, 787 bp, Homo sapiens
  misc_feature: GYAE6OF02HVB8X.49.81.H04.1.454.CMB.1.raw
  modified_base (726)..(726): a, c, t, g, unknown or other
  misc_feature (726)..(726): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggcccaggacagaaagtcaccatctcctgctctggaagcagctaccaactagttagggaataattatgtatcgtggtaccagcacgttccgaggaccgccccagacctcctcattcatagaactaataaacaagcgtaacgtacccgaaggacgtacttccgtacggtacccgtatttcctccgttaggtaccttacccgtaaacgttccggtacggtaccctaaccccgttccgaacccggacccctaaccccgtaccgggacccctaaccgtacccggtaaaccccgggtaacccttacccggaacggtaacccgggtacggggggaaacccgtacggggtaacccgttaagttttaacgttaacggttacggaccgggtaaaacgtacggttacggggtactttacccggaacgtccgttagggtacgttgggttcgtacggtcggggttacggttcggggaccgggaagggtacccgtaaggtccgttaccggtaaccggttacccgtaggtaccgaaccggtacccgacggtccgtcccgggtaccccgtcggttacccnccgtttaccgtttcccgttccccgtacccgttccccttccgtaccttcccgtacgtacccg

SEQ ID NO: 77783 - DNA, 653 bp, Homo sapiens
  misc_feature: GYAE6OF02IHANK.49.81.H04.1.454.CMB.1.raw
  modified_base (513)..(513): a, c, t, g, unknown or other
  misc_feature (513)..(513): n is a, c, g, or t
  modified_base (594)..(594): a, c, t, g, unknown or other
  misc_feature (594)..(594): n is a, c, g, or t
tcagagtcgagagacacgaccggtgctcgatttagtagtgtagattcgcggggggggacaatcttcatcatgacctgctccctctcctcctcacccttctcattcactgcacagggtcctgggcccagtctgtgttgacgcagccgccctcagtgtctgcggccccaggacagaaagtcaccatctcctgctctggaacgcagcctaccaaacagttggggaaagaatttatgtaattccggtaggtacccagtcacgttcccgaaggaaccggcccccagacctcctctatccatgacaaataacaagcgacgtcccagacgtatcctgaaccgtagtttctctcggtcctacctaacgtctacggacctacctcgacgccctacccgtcggccctaacgtacccgacccggtactcccgacggaccggtacgggggaccgacgggtacccgtagtttacttaacgtcgacggaacagtacgggtattccaggtcctggtagtggtacgtgngggtgtacgggcggacgggacgtacgcgacgtcccgttcggtagtccgacgaccgtaggtcgtaccggtcccgtcgttacncccgttaccgttccggttcccccgtccttccccgttacgtcccgttaccgtacttccgg

SEQ ID NO: 77784 - DNA, 574 bp, Homo sapiens
  misc_feature: GYAE6OF02GMC3Z.49.81.H04.1.454.CMB.1.raw
  modified_base (408)..(408): a, c, t, g, unknown or other
  misc_feature (408)..(408): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagctaactattaaatggtatcagcagaaaccagggaaacgcccctaacctcctagactctacgatgcatcctaagtttaggaaagtacgggtcccatacaaggttcagtaggaagtggatcgtggtaacgttattttacgttcactatcatacaactgacagcctgaggtatattgactaanattaacttactcgttaacaaactaataactagaattaaactctaacctactacctacgtttcgggacggtaacggaccgtagggtaggagtaacgtaaccgaaaacgtaacgttgtacggtacgtacgcctaaccgtactttccgtacggttaccttacgtaaccc

SEQ ID NO: 77785 - DNA, 701 bp, Homo sapiens
  misc_feature: GYAE6OF02IQXSN.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctaggaagcagcctaccaactattagggaaataattatgtatcgtggtaccagctacgttcccgaggaaccgcccccagacctcctctattcatgaactaataacaagcgacgtacccagacgtacttcctacgaccgtattcctcgtggacctaccgtaacgtcgtacgtccaccgtcacgtccccaccgtcggaccctactccgaccggtactcccgaacgtaccggtaggggaccgacggaccgttaatttaacgttaccgtcggaaccggtaaactacggtacgggtactttccgacgtccgttaggtagggttcggtacgtacgggtagggttcggttacgggcggggtaacggaccgtaacggtccgtacggtaacccgttccggtaacggtccgaaccggtacccggacggtccgtcccgggaccccgttccgggtcctaaccgttccgtttacccggttccccgtcccgttacccttcgttcccttaccggtccgtaccg

SEQ ID NO: 77786 - DNA, 695 bp, Homo sapiens
  misc_feature: GYAE6OF02GJY74.49.81.H04.1.454.CMB.1.raw
  modified_base (268)..(268): a, c, t, g, unknown or other
  misc_feature (268)..(268): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcaagaaaccagggaaacncccctaaacctcctagatctaacgatgctactacctaagtttaggaaaacgttacggggtacccagtacgtaaaggttctaggtacgggtaaagtcgggtatcggttagggtaacgtttagtttttaacctttacgacctaacgttcaacttccaaacccttgaccgaacgtcccggtaggtaagggtattaagttacgacctaaaacgtactttaactttaacccgtaggttaaccaaaacttaaataacggttagtaaacttaaacctttacctaacccgtacttaccgttaccggttttacgggaccgggtaaacgggtacccgaaggggttacgggaagtacgtaaccgtaaaaccggtaacgttcgggtacggtaccgtcgacctaccgtaacttccgttggtttacccttacttaaccccg

SEQ ID NO: 77787 - DNA, 735 bp, Homo sapiens
  misc_feature: GYAE6OF02FUFBD.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacagttgggaagaattatgtatcgtggtaccagcagttcccaggaaccggccccagactcctcattcatgacaaataacaagcgacgtcccagagacttcctgaccgtatttctctggtcctaccgaagttccgtggacctaccctcgaccgtcccaccccgtcggcccaacgttccgaaccccgggtacctacccgaaggtacccggtcgggggaaccgacggggacccgtaattttaacgtaccgttcggaccgggtaaactaggttacgggtactttacccgaaggcccttaaggaggttcgggtcgttcgggaggggtttcggtaccggggcgggaacggggaaccctaacgggtccgtcggtacccgttaccgtacggtccgaccggtacccggacggtccgttacccggggcccccgttaccgggttccccgtaaccgtttccccgttacccggttttccccccccgggcccctttaccccggtttcccgttcccccgtttaccggttacccgttaccccgg

SEQ ID NO: 77788 - DNA, 686 bp, Homo sapiens
  misc_feature: GYAE6OF02H5IPI.49.81.H04.1.454.CMB.1.raw
  modified_base (125)..(125): a, c, t, g, unknown or other
  misc_feature (125)..(125): n is a, c, g, or t
  modified_base (132)..(132): a, c, t, g, unknown or other
  misc_feature (132)..(132): n is a, c, g, or t
  modified_base (137)..(137): a, c, t, g, unknown or other
  misc_feature (137)..(137): n is a, c, g, or t
  modified_base (179)..(179): a, c, t, g, unknown or other
  misc_feature (179)..(179): n is a, c, g, or t
  modified_base (182)..(182): a, c, t, g, unknown or other
  misc_feature (182)..(182): n is a, c, g, or t
  modified_base (281)..(281): a, c, t, g, unknown or other
  misc_feature (281)..(281): n is a, c, g, or t
  modified_base (341)..(341): a, c, t, g, unknown or other
  misc_feature (341)..(341): n is a, c, g, or t
  modified_base (565)..(565): a, c, t, g, unknown or other
  misc_feature (565)..(565): n is a, c, g, or t
  modified_base (662)..(662): a, c, t, g, unknown or other
  misc_feature (662)..(662): n is a, c, g, or t
tcagagtcgagagacacgaccggtgctcgatttagtagtgtagattcgcggggagtcccaaccaggacacagcatggacatgagggtccctgctcagctcctggggctcctgctgctcgtgctcncgtggcncagtntgtagactcgtacgagtccacgtctcctacctctccctcctntcncactctcgtagaggacagaatacacactctactacgtcgacggacggactactacgacggtacttagtacaactttaatttaaaagtttagtacgtaanacggactaacggaaaacgaacggaacggtacccccctacgtacctatacgtactacgtancgactctaactacgttaaggttaaacgaacgggtcctaacctgtaacggtacgtagaggtaacgtaggtcgtgttacgggttaacggtttacttttaactttcacaacttcgactaacgtacccgttagcgtaccgtaccgtaggtacgtagttacgttagacgtactaagttacttacgttacgttaaacaactaataatacgtaattaacctaccttaaccnccttaacgtacggttaccggttacgggaaccggtacggaacggtacggtacggaacttaccgaaacggtcgtaggtcgtacgtacgacctcggtacnccgtttgtaccttacgtactcccg

SEQ ID NO: 77789 - DNA, 907 bp, Homo sapiens
  misc_feature: GYAE6OF02FWGJS.49.81.H04.1.454.CMB.1.raw
  modified_base (220)..(220): a, c, t, g, unknown or other
  misc_feature (220)..(220): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaagcagctccaacagttgggaanaattatgtatcgtggtaccagcacgttcccgaggaaccgccccagactcctcattcatgaacaataacaagcgacgtccagagtacttccgtagaccgtattctcgtggcctacaaggtctcggcctacctcgacgccctacccgtggacctacgtaccgaacccggtacctacccgaacggtaccggttcggggggaaccgtaacggggtacccgttaaagttttaaccgtttaaccgtacgggtaacccgggtaaaacgttaagggttacgggggttaacctttacccggaaacgggtttcccggttaagggtaaaccggggttttcgggggtttaccgggttaccggggttaacgggggggttttaccgggtttacccgggggggtaaccgggggtaaaccggggggtaaaccccgtaaaacgggtcccgggtttaacccggggttaacccccgggtttaaccggttaaaccggggtacccgtaaacccggggtaaccccccgggttaaacgggggtccccggtttacccccgggggtaacccccccggtttcggggtttaaccccccgttaacccggttttacccccggtttacccgggttttaccccccccgggtacccccccttttccccggtttaccccgtttaccccggttttccccgtaccccggggtttaacccccg

SEQ ID NO: 77790 - DNA, 720 bp, Homo sapiens
  misc_feature: GYAE6OF02IHK0B.49.81.H04.1.454.CMB.1.raw
tcagagtcgagagacacgaccggtgctcgatttagtagtgtagattcgcggggggggacaatcttcatcatgacctgctccctctcctcctcacccttctcattcactgcacagggtcctgggcccagtctgtgttgacgcagccgccctcagtgtctgcggccccaggacagaaagtcaccatctcctgctctggaagcagcctaccaacattgggaataattatgtatcgtggtaccagcagtccaggaccgccccagacctcctcattcatgacaataacaagcgagtaccccagagtacttcctcgaccgtatttcctcgtcggccttaccaaggtctcggaccacctcaacgccccaacccgtcggaccctactaccgacccggtacctccgaacggtaccggtacgggggaaccgacgggtacccgtaatttaacgtttacgacggtacggtaaactaggtcggggtactttacccgaggtcccgttgggaacggttgggttacgttacgggtagggggttacgttccggggacgggtaacggggacccaacgggtctaccggtaacccggttccgtacgggtacccgaacggaccccgtaacgggtcccgtaccggggtcccccgttaccgggttacctacccgtttccgttcccggtttccccccgcccctttccccgttcccgtttacccgttcccgttaccggtaccccg

SEQ ID NO: 77791 - DNA, 616 bp, Homo sapiens
  misc_feature: GYAE6OF02GJ12V.49.81.H04.1.454.CMB.1.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (471)..(471): a, c, t, g, unknown or other
  misc_feature (471)..(471): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgcctcagtgtctgcggcccaggacagaaagtcaccatctcctgctctaggagcagctccaacngttgggaataattntgtactcggtggtaccagcagttcccaggaaccgccccagactccgtcattcatcgacaatacagcgagtcccagactacttcctacggaccgtattctcgtacggtcctaccgagtcctacggacctaccgtcacgtcccctaccgtggccagtccgaaccggtacctaccgaggtaccgcgggacgacgacgtaattactacgtagacgtacgagtcggtaacttccgagtaccgtgtagtcggttncggtacggttcgtacggcggtacggacacgcgtacggacccgtacgtacgtagaccgtacgtacgtccgtaccggtcccgtcgtacccgacctttccggtccgttaccccgtccgtccgtacccgtcgttaccgtaccctaccgg

SEQ ID NO: 77792 - DNA, 613 bp, Homo sapiens
  misc_feature: GYAE6OF02H63ZU.49.81.H04.1.454.CMB.1.raw
  modified_base (415)..(415): a, c, t, g, unknown or other
  misc_feature (415)..(415): n is a, c, g, or t
  modified_base (491)..(491): a, c, t, g, unknown or other
  misc_feature (491)..(491): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatccctccctgtctgcatctgtaggagacagaatcaacatcacttgccaggcgactcaggacattagactaacttaatttaaattggtaatcgaagaccaagaaaacccgaaggggaaacctccccctaaacctcctagaactctaacgatcgtactactacctaaagtttaggaaacgtacgggtcccaagttacgaaggttcaaggtaggtaagtggattcggtagggtaactttattttacttacaactnttacactactaactgacacgtacctgaagtattattacgactaatattaacttactagtaacaaactaataataanaattaactacctacctactccgttacgtttacgggcgggtaacgaccgtacgggtagacgtactaacgaacgtaacgtgggacgtactcgacctaacacgttcgtcgtttaccttatacccg

SEQ ID NO: 77793 - DNA, 694 bp, Homo sapiens
  misc_feature: GYAE6OF02GRMZY.49.81.H04.1.454.CMB.1.raw
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (332)..(332): a, c, t, g, unknown or other
  misc_feature (332)..(332): n is a, c, g, or t
tcagagtcgagagacacgaccggtgctcgatttagtagtgtagattcgcgggggggacgaatcttcatcatgacctgctcccctctcctcctcacccttctcattcactgcacagggtcctgggcccagtctggtgttgacgcagcccgccctcagtgtctgccggccccaggacagaaagtcaccatctccngctctaggaagcagcctacaatgttagggaanaattntgtatcgtggtaccngctagtcccaggaccgccccagactcctcattcatgaactaataacagacgacgtacccgagacgtactacgtcgaaccgtattccncgttcggaccttaccgtaacgtcgtacggtacaccctgaaccgtccaccttcggccctaactccgacccgactcccgacggacggtacggggaacgacggtcccgtaatttacgtacgcggaccgaataggtacggtactaccgcgtacgtggtaacggttggtacgtcgggtacgggtcgggtaccgggtacgggacgggaaccgtaggccgttaacgggtacccgttacggtaaccggtacaaccgggtaccccggaggtcccggtaccgggtcccccggttacgggttacctaccggtttccggtacccgttccccgacccgttttccggccctttaccggtaccgtcgttaaccccgg

SEQ ID NO: 77794 - DNA, 607 bp, Homo sapiens
  misc_feature: GYAE6OF02F3A9O.49.81.H04.1.454.CMB.1.raw
  modified_base (219)..(219): a, c, t, g, unknown or other
  misc_feature (219)..(219): n is a, c, g, or t
  modified_base (307)..(307): a, c, t, g, unknown or other
  misc_feature (307)..(307): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaagcagctccaacattgggaanaattatgtatcgtggtaccagcagttcccaggaaccggcccccagactcctcattcatgacaataacaagcgagtcccagagattccngaccgattctctggctccaagtctggcacctcagcccaccctggccatccaccggacctccagaccgtggggacgacgggccgattattactaggaccggaacagtgggacttccacgtcctgagtggtcgtcgagggtgttcgggcggagggaccaaggtcgtacggacccgttccgtacggtcgacgcccgaaggtccgtaccgggtcccccgtcgggtccctaacccgttccgtttcccggttaccccccgtaaccccgttcccgttccccgttccttcccgttacccggtaccccg

SEQ ID NO: 77795 - DNA, 828 bp, Homo sapiens
  misc_feature: GYAE6OF02IFEDD.49.81.H04.1.454.CMB.1.raw
  modified_base (332)..(332): a, c, t, g, unknown or other
  misc_feature (332)..(332): n is a, c, g, or t
tcagagtcgagagacacgaccggtgctcgatttagtagtgtagattcgcgggggggggacaatcttcatcatgacctgctcccctctcctcctcacccttctcatttcactgcacagggtcctgggcccagtctgtgttgacgcagcccgccctcagtgtctgcggccccaggacagaaagtcaccatctcctgctctggaagcagcctaccaactagtttacgggaataatttagtgtaatccggtggtaccagctacgttcccaggaaccgcccccagacctcctctattcatcgacaataacaagcgacgtacccaggacgtacttccnggaccgtatttccgtccttcgggcctaccgtaaggttccgtacgggaccctaaccgttcgaccgtacccctaccccgtacgggacccctaagtacccgacccggtacctacccgaacggtaccggttacggggaaccgacgggtaccgtaagtttaaccttacgtacgggaccgtaaacgtacggttacggggtaacctttccgaaggtacccgttagggtaacggttacggggttcgtaccgggtagggggtttccgggtttaccgggggaccggggtaaaccggggtacccgtaaacggggtccggttaacccgggtaaccccggttaccggttaacgggtacccgtaaccgggtaccccgaacggggttccccgttaccggggaccccccgtttacgggtacccgttaaccgtttcccggttacccggtttacccccctaccccgttaccccgtttacccgttcccgtttacccggtacccggttaaccccgg

SEQ ID NO: 77796 - DNA, 690 bp, Homo sapiens
  misc_feature: GYAE6OF02IG0UX.49.81.H04.1.454.CMB.1.raw
tcagagtcgagagacacgaccggtgctcgatttagtagtgtagattcgcgggggagtcccaaccaggacacagcatgggacatgagggtccctgctcagctccgtgggggctcctgctgctctggctctcagggtgccagatgtgacagtccggatcgacccagtcctccactccctccctgtctgctatctaggtaggacgacgagtaactaccaacctattaccgtacctttcggacccgagggtccgactacgaacggtactaagttacgactaacttaatttaaagtttaggtatcagacaacgaaaccgaacggaaaccgacccctaacctcctacgtactacgtacgtagtcgactactactaagttaggtaaaggtacggtaccgtactacgtaaggttacgtaggtaggtaggtagtagtacgtaggttacgtttactttacggggggggggggggtttactactactactactacctaacctcgacgtacgtcgtacgtaggtacttacgttacgtaccgtaactaattaacttacgtactactaactaactatagtaataactacctacctactacgtacgttacggtacggacggaccgtacggtaggacgacgtacgaacgtaacgtacggtacggtacgtacgtacgtaccgtacgtacgttacgttcgttactacc

SEQ ID NO: 77797 - DNA, 789 bp, Homo sapiens
  misc_feature: GYAE6OF02H88T4.49.81.H04.1.454.CMB.1.raw
  modified_base (131)..(131): a, c, t, g, unknown or other
  misc_feature (131)..(131): n is a, c, g, or t
  modified_base (189)..(189): a, c, t, g, unknown or other
  misc_feature (189)..(189): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtnccagatgtgacatccggatgacccagtcctccatcctccctgtctgcatctgtagganacagaatcacatccacttgccaggcactcgaggacattacgactaaacttaattttaaattggtaactcgaagacaaacggaaaacccgaaggggaaaaccgtaccccccttaaacccgttcctacgtaactccgttaacgatccggactacttacccgtaaagttttacgggtaaaacggttcggggttaccccaagtaccgttaagggttacgaggtaggtaaggttggtagttacggtacggggttacgttttaactttttaccgtttaccaaccgttacttacctaactttacccgtaaaccgtcggaccttaacggaccggtttaggaaacggttaacttacgttaccgaactaaaaccgttactttaaacgtttaacctacgtaaacctaaacttaaagttaactacggtaaaactttaaccgtaccctttaacccgtaacccttttaccgtaaccgggtttccggggaaaccggggtacccggtaaaccggtacgggggtacgtaaccggtacgtaaaccggtaaaaccggtacgttacgggttacgaccgtacgacctaccgttagttcccgttacgtttcctaacttcccg

SEQ ID NO: 77798 - DNA, 837 bp, Homo sapiens
  misc_feature: GYAE6OF02GO7JI.49.81.H04.1.454.CMB.1.raw
tcagagtcgagagacacgaccggtgctcgatttagtagtgtagattcgcgggggagtcccaaccaggacacagcatggacatgaggtccctgctcagctccctggggctcctgctgctctgctctcaggtgccagactgtgacatccggatgacccagtctccatcctcctgtctgcatctgtaggagacagaatcaccatcacttgccaggcgactcaggactagttagcaacttaatttaaattggtattcagcaagaaaacccagggaaaacgtccccctaaacctccgtagactccgtaacgactgctactaccgaaagttttaggaaaacttacgggggtaccccaagttacccgtaaaagggtttaccaacggtttacgggaaaagggtttcgggtaaactttcccggtttaggggggtaaacccgttttaactttttttaaaccgttttccctaaacccgtaactttaccctaaactttacccggttaaaacccctttcggtaacccaacggtaccccgttttaggggaaacgggttaaactttaacgtttcggaaacctaaaaccgtaagtttaacttttaacgtacggtttaaaccaaaacctaaatttaacggttagtaaactttaaaacgttacccttaaacccgtaacctttaccgtaaaccgtttttccggggaaccgggttaacggggtaacccgtaaccggggttacgggaagtaaccgttaacggtaaaaaccgggtaactttacggggtaacggtaccgttacgggaacctaacccgttaaacgttcccggtttacggtttaccctttaccggtaacccg

SEQ ID NO: 77799 - DNA, 757 bp, Homo sapiens
  misc_feature: GYAE6OF02GDCTR.49.81.H04.1.454.CMB.1.raw
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgccggccccaggacagaagtcaccatctcctgctctggaagcagcctccaanagttgggaaanaattangtatcgtaggtaccagcagttcccaggaaccgccccagactcctcattcatcgacaataacaagacgacgtccagacgtacttcctagaccgtattctctggcctaccgaagtcctcggcctacctcacgcccacccgtcggacccacgtaccaacccggtacctcccaaggaacccggttcggggaaccggtacgggtacccggtaacttttaagttaaccgtcggtaaccgggaaactacggttacgggggtaacctttacccggaacggttacccgttaggtacgggtttcggggttacgggtttaccgggtaacgggggtttacgggttcccgggggaacggggtaaccgggaaccgaaacggttccggtacggtaaccccggttccgtaaacggtccgaacgggtaccccgtaaggggtcccgttacccgggtcccccggttaccgggttacctacccggtttccggttacccgttcccccctaacccgtttcccttcccgttaccccttcgtcccggttaacc

SEQ ID NO: 77800 - DNA, 788 bp, Homo sapiens
  misc_feature: GYAE6OF02HSPLC.49.81.H04.1.454.CMB.1.raw
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctcgccggccccaggacagaaagtcaccatctcctgctctaggaagcagcctaccaactagttaggggaaataatttatggttaacttcggtacggtaaccgagtccgtacgtttaccccgaagggtaaccccggacccccgagtacccttcctactaactttacaagttacgaaacctaaaactaaacgaacggaccggtaacgtacccgaaggaacgtacttaccgtacgaaccgttactttacgttcgtcggtccttaccgtaacgttacgtcggacctaacccgtccgaccgtacccctaacccgtcggaccctaacgtcccggaacccgtacctacccgaacggtaccgggtacggggaacggacggtaccgttaagtttaaccgttacgtggaacccgggtaatagggttacgggtacttacccgaggtccgtgggtacggttcggtacgtcgggtaggggttcgggttacggggaccgggtaaggggtacccaggtccgtaccggtaccgttacggtacggacctaccgggacgtacgggcgtaccccgggtcccgttacggtcctaccgttcccgttaccgtccccttacccgcccgttaccgttaccctccggtcctaccgg

SEQ ID NO: 77801 - DNA, 680 bp, Homo sapiens
  misc_feature: GYAE6OF02JFQTB.49.81.H04.1.454.CMB.1.raw
  modified_base (219)..(219): a, c, t, g, unknown or other
  misc_feature (219)..(219): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctctggaagcagctccaacattgggaanattatgtatcgtggtacagcagttcccaggaccggccccagactcctcattcatcgacaataacagcgagtcccagagattccgtgaccgtattctactggcctccaagtctacggccaccctcgacgtcccaccccgtggacccacgtcacccgggtaccttacccgaacgacggtcggggacggacgggacccgttaagtttacgtttaaccgtagggaccggtaaacgagttcggggaaacctttccgacgtccgttgaggttcggttagcgtaggggtgttcgggacgggtacgggaccgtaagtaccgtcggacccgttaccgtacgggtaccaccggtcccgaacggttccgtacccggggtcccccgttacgggttacctaccggtttccccgtttaccgttccccccgtaacccctttcccgttacccgttcccgttaccttccccggtaccg

SEQ ID NO: 77802 - DNA, 562 bp, Homo sapiens
  misc_feature: GYAE6OF02H6YR5.49.81.H04.1.454.CMB.1.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (343)..(343): a, c, t, g, unknown or other
  misc_feature (343)..(343): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
  modified_base (447)..(447): a, c, t, g, unknown or other
  misc_feature (447)..(447): n is a, c, g, or t
tcagagtcgagagacacgaccggtgctcgatttagtagtgtagattcgcggggggggacgaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaanattgggaanaattatgtatcgtggtaccagcacgttccaggaaccgccccagacctcctcattcatgaacaataacaagcgacgtccagagacttctagaccattctcgtgctcaagtctcggcactcgacnccacctgccataccgaccgactcagacgtggggacaggcctatattacgngacggaacngtagggtacttacgagtctggtagtggtgtcgagggtgttcgggngggaacgggacaagtcgacgtacccgtcgtacggtcacgtacccgagccgtacggccccgtacggtccgaacttcctaccgttccccacccgttcctccgtacttccgcttaccg

SEQ ID NO: 77803 - DNA, 704 bp, Homo sapiens
  misc_feature: GYAE6OF02JP8CT.49.81.H04.1.454.CMB.1.raw
  modified_base (345)..(345): a, c, t, g, unknown or other
  misc_feature (345)..(345): n is a, c, g, or t
  modified_base (561)..(561): a, c, t, g, unknown or other
  misc_feature (561)..(561): n is a, c, g, or t
tcagagtcgagagacacgaccggtgctcgatttagtagtgtagattcgcggggggggacaatcttcatcatgacctgctcccctctcctcctcacccttctcattcactgcacaggtcctgggcccagtctgtgttgacgcagccgccctcagtgtctgccggccccaggacagaaagtcaccatcctctgctctggaagcagctccaaactgttagggaataatttatgtaacgttcggtacgtaccagacgtacgttcccgaagggaacccggccccaagtacctcctactacttcatacgaactaataaacaacgccgtacgtacccaagtacgtacttccncgaaccgtacttcgtacgtcggtaccctacgtaacgttcgtcggacctaccgtacgaaccgtcccacccgttcggacctacgtaaccgtaccggacctaccgaacggtaccggtacggggacggtacggtaccgtaacttacgttaccgaggaccggtaaacgtgttacgggaaccttccgaacgtcgtacggtaggtcggtagtcgtacggggtnttccgggaagggtaccggtaacgtacgcggtaccgtaccgttaccggtaggtaccacggtaacccgcgggtacgtcccggacccgttgtaacctccgttacccgttcgtcccccgtacctcgtccttccgtacgtcgtaccgg

SEQ ID NO: 77804 - DNA, 845 bp, Homo sapiens
  misc_feature: GYAE6OF02H4O17.49.81.H04.1.454.CMB.1.raw
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgccggccccaggacagaaagtcaccatctcctgctcgtggaacgcaagcctaccaactagttagggaagtaacttagtgttatcggtcggtaaccagactacgttcccgaacggaacccggcccccagtacctcctactacttcatacgaactaaataacgaagaccgacgttaccccgaggtacgtacttcccgtacggaaccgtactttaccgttccggtacggtaccctaccgtaacggttccgtacgggtacccctaacccttacgaacccgtccccgaaccccgttacgggtacccctaccgtaccccgaacccggggtaccctacccgtaacgggtaacccgggttacggggggaacccggtaacgggtacccgggttaaactttttaaaccggtttaccggttaaccgggaaccgggtaacgttaaggtaccggggttaccgttacccgaacggtcccgttaggtacggtttcgggttacgtacgggtaggggtttccgggttaccggggacgggaaccgggtacgaacggtccgtaccggtacccggtcgtacgggtaccacggcccgtaggcccgttaccgggtacccccgtaccggttcgtaacccgttcccgttaccccgttacccccgtaccccttcccgttaccccgtttaccgttcccgtacccgttaccgg

SEQ ID NO: 77805 - DNA, 780 bp, Homo sapiens
  misc_feature: GYAE6OF02HZ8O1.49.81.H04.1.454.CMB.1.raw
tcagagtcgagagacacgaccggtgctcgatttagtagtgtagattcgcgggggggacgaatcttcatcatgacctgctccctctcctcctcacccttctcattcactgcacaggtcctgggcccagtctgtgttgacgcagcccgcctcagtgtctcgccggcccaggacaagaaagtccaccatcctcctcgctctaggaacgcacgcctaccaactagttaggggaaataatttagtcggtaacttcggtacggtaaccaggtcctaaccggttacccgaaggggtaacccggccccccaaggtaccctccttactaacgtttaccaagttacgaaactaaaacttaaaccgaaacggtaccgtaaccgtacccgaaaggtaacgtacttacccgtacgtaaccgtacttcttacgtcggacctaccgtaagttcgtacggtcctaaccgtcaacgtacccaccggtcgacctacgtaccgaccggacctccgaggtacgtaggggaaccgagacgtaactttacgttaacgtcggaacggaaacgtcgttacgggtaccttaccgaacgtcgtacgggtacgttggtacggcgttacggggtacgggttccgggacgggtaacggaccgtacggtccgtaacgggtacccgttacggtacggtaaccgtacggacccggtaagggtcccggtacccggtaccccgttcggtaccgtaccgttcccggtaccgttaccccacccgttcccgtacgtttccctaccggtaccttccgg

SEQ ID NO: 77806 - DNA, 761 bp, Homo sapiens
  misc_feature: GYAE6OF02HQIAL.49.81.H04.1.454.CMB.1.raw
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctggtgttgacgcagcccgcctcagtgtctggccgcccaggacagaacgtcacntctcctgctcgtaggancagcctacaactagttagggaaataatttgtagttacgtcggtggtaccagtctaccggttaccgaacggaacccgacccctagtacctcctctacttcgagtacgaactaaagtaactaacggccgaacttacccgaagtacgttaccttaccgtacggtaaccttacgttcgtccgttacggtacccttaacgtacggttccgtacgggtacctacccgtcgtaaccgaccccgtaccggtccgtacccgtacgtaccggttaccccggaaccttacccggaagggtaccggtaacgggggaccgtaaccggtaccggttaaagttttaccgtaccggtcggaaccgggtaactcgggtacgggtacttaccgacgttaccggtacggttagggtacggttcgaacgggttcggtagggtcggggaccgggacggtaccgacggtctaccggttaccgtaccggtacgaccgtacgtccgtacggtccgtaccggcccgttcggtacctcgttaccgttacccgtcccgtcccttaccgtctccgtaccgtacgtccgg

SEQ ID NO: 77807 - DNA, 907 bp, Homo sapiens
  misc_feature: GYAE6OF02JEBCT.49.81.H04.1.454.CMB.1.raw
  modified_base (151)..(151): a, c, t, g, unknown or other
  misc_feature (151)..(151): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctnagtgtctgccggcccaggacagaagtcaccatctctgctctaggaagcagctaccaactagttaggggaataattatgtaagttcggtaggtacccagcgtacgttaccccgaacgggaacccggtcccccaagtaaccttcctactaactttaccacgttacgaaacctaaacgttaaaaccgtaacggaccggtaaccggttaacccccgaaggtaccgtaaccgttttccccgtaacggtaccccgttaaccgtttcccgttaccgttaccggggtacccttaaccgtaaaccggtttcccgtacgggtacccctaacccgttacccaaaccgggttcccccaaccccggttaccggaccccggtaaacctttaccccggaaaccccggggtaccctaaccccggtaaccggtaaccggggttaccgggggggaaccggtaacccggggtaccgttaaacgtttttaaccggttacgtaaccggggtaaccgtaaaccgttagggtaccgggttaaccgttccgtaacggtccgtttcggaacgggtttcgggtacggttacgggtaacggggtttccgggtaccgggggtaccggggaacgggtaaccggtaacgtccggtaccggtacccgttaccggtacggtacgacccgtacccggacggaccggtcccggaaccccggttcggcctaccgtcccgtttacccgtccccctacccggttccttacgtccccgttacctccgttaccgg

SEQ ID NO: 77808 - DNA, 643 bp, Homo sapiens
  misc_feature: GYAE6OF02F44JQ.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtcctccatccctccctgtctgcatctggtaggagacagaatcaccatccacttgccgaggcgactcgaggacattacgactaaacttatttaaattggtatcagcaacgaaaccgagggaaaccgacccccctaacctccgtaaagacttaccgtacgactgacctacttacctaaagtttaggaaacgttaccggggtaccctaagtaccgtaaggttcaaggtaggtaaggtggtagtacggtagggttactttaacttttaccttacctacctacttacctacgtacctacctgacacggtcctaggagtattacgtagaacctaacattattactacgtacaaataatatataactaactacctacctacttacgtacgtttaccgggaggtaaccgggtaccacgggtaggactaactaaccgaaacgtacgttcgggtacgtcctagaccgtactagttacctagttaccttacgtaccc

SEQ ID NO: 77809 - DNA, 768 bp, Homo sapiens
  misc_feature: GYAE6OF02JLEPS.49.81.H04.1.454.CMB.1.raw
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgcggcccaggacagaagtcaccatctcctgctctggaagcagctcaacntaggaanaattatgtatcgtgtaccagcagttacccaggaacccggccccagactcctcattcatgaacaataacaacgcgacgtaccaagagtacttcctacgaccgtattcctacgtcggtcctaccgtaaggttccttagggcctacctacgaccgtcccaccgtcggaccacgtccgaccggtacctccgacggtacgtcggggacgtcgggaaccttatttaacgtacgttacggaccgggtaaactaggttacgggtacctttacccgacggtaccggttaggttacgggttcgggttacgttacgggtacggggttaccggggttacggggaccggggtaaccgggtaacccgaacgggttccgttaccccggggttaacccgtttcccgggtaaagggtttacccggaaaccgggtcccccggttaaacgggtcccgggtttaccccggggtacccccgggttacgggttaccccttacccggtttaccgttcccccggtttacccccgtccctttaccccgtccctttcccgttcccggtaccttacccgg

SEQ ID NO: 77810 - DNA, 661 bp, Homo sapiens
  misc_feature: GYAE6OF02JQBBS.49.81.H04.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (291)..(291): a, c, t, g, unknown or other
  misc_feature (291)..(291): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgcctcagtgtctgccggaccccaggacagaaacgtcaccatcctcctgctctggaancagctccaacngttagggaanaattatgtatcgtggtaccagctagtccaggaccgccccagacctctcattcatgacaataacaagtnacgtccagagacttccagaccgtattcctcgtacggctaccctaagtcctcggacctaccgtccacgccccacccgttcggacccacgtccgaacccggtcctacccgaggtaccgtacgggggactacgggacccgtatttaacgtacgtacggtacggaacgtaagtggggtaccttcggaactccgtaaggtgtcgtcgttgtagggtcggttacgggccggtacgggaccgaagggtcctcggtaacccggtcgttaacggccgacggtacccgaggtcccggtaccggtcccccggtagttacccgacgtttacccgttccgttccccgcccgttccctacgttccccttcgtacccgttacccg

SEQ ID NO: 77811 - DNA, 729 bp, Homo sapiens
  misc_feature: GYAE6OF02HWF2P.49.81.H04.1.454.CMB.1.raw
  modified_base (199)..(199): a, c, t, g, unknown or other
  misc_feature (199)..(199): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaancagcctaccaaacattgggaaagaaattatagtatcgtagtaccagcacgttaccaggaaccgccccagacctcctacgattcatagaacaaataacaaagcgacgtacccaagacgacttcctacgaccgattctcgtagctaccgagtcncggcacctnacgcctacctggaccaactccgaccggactaccgaggtacgtcgggggacgtacggacgaatttacgttaacgtggacggtaaactacgtacgggtacttacccgagtacctaggtaggtcgggttacggttacgtaagggggtttaccggttcgggtaaccggggaacggggtaacccgtaaaggtccgttacgggtacccgggtttaaccgtaacgggtaccgaaccggtaccccgtaaaggggtcccggttaccgggtcccccggtttaaccgggtacctaacccgtttacccggtttacccggtttcccccccggtacccctttccccgttaacccgtttcccgtttaccgtaccgtttaaccgg

SEQ ID NO: 77812 - DNA, 629 bp, Homo sapiens
  misc_feature: GYAE6OF02JGOHH.49.81.H04.1.454.CMB.1.raw
  modified_base (136)..(136): a, c, t, g, unknown or other
  misc_feature (136)..(136): n is a, c, g, or t
  modified_base (461)..(461): a, c, t, g, unknown or other
  misc_feature (461)..(461): n is a, c, g, or t
  modified_base (477)..(477): a, c, t, g, unknown or other
  misc_feature (477)..(477): n is a, c, g, or t
  modified_base (606)..(606): a, c, t, g, unknown or other
  misc_feature (606)..(606): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagntgtgacatccggatgacccagtcctccatccctccctgtctgcatctagtaggagacagaatcaccatcacgttgccaggctactcagactatagctaattaatttaaagtgtactcaagacaagaaaccgagggaaacctaccccctaaccgtcctagactcgtaacgatcgacactacctaagtttaggaaagttcgggtaccctatacgtaaggttcgaggttaggacgtggattcgtagggtactttacttttaccttcacctatatactaccacgtgcgtacgtccttaaggacgttattacgttacgacctaaacgttntttaacgttacgttanaaaccgtaaatagtaatcgtaactaactaccgtactaaccttcggtaacgtttcggggaaccgttaacggaccgtagggtaagacttaagaaccggtaacggtagtcgggtactcgaccgttacgactnttacgtacgttctaccgttaccg

SEQ ID NO: 77813 - DNA, 712 bp, Homo sapiens
  misc_feature: GYAE6OF02F0J60.49.81.H04.1.454.CMB.1.raw
  modified_base (327)..(327): a, c, t, g, unknown or other
  misc_feature (327)..(327): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctgcggccccaggacagaaagtcaccatctcctgctctggaagcagctccaactagttagggaaagaattatgtatcgtggtaccagcagttcccaggaaccggccccagacctcctcattcatcgacaaataacaagcgagtcccagagtacttccgtgaccgtattcnctggcctaccaagtctgcacctcacgcccacccgtggcccacgtccaacccggcctaccgagacgtcggggacgacggccgtattacttacgtcggacggaactagtacgggtacttaccgacgtccgttcggaggttcggttcggtcgtaggggttcggtttaccggggacggggtaacgggaccgtaacggtccgtaccgggttaccccggttaccgtacgggttaccgaaccgggtacccggaacgggtccccgttacccggggtccccccgttcccgggttaccccgtacccgtttacccggtttaccccgtttacccccccgttacccccgtttacccccgtttcccgtacccctttcccccggttacccgttaccccgg

SEQ ID NO: 77814 - DNA, 821 bp, Homo sapiens
  misc_feature: GYAE6OF02IEY82.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgcctcagtgtctggccggccccaggacagaaacgtcaccatctctgctctgaagcagctaccaacgagttaggaacgtaattagtgttactacggtacggtacccagcgtagttacccgaacgggaaccgccccgaaagtcctaccgtactaacgtttaccacgtacgaacctaaagtaaccaaggccgtaacgttacccaaggtaacgtacttttcccgaggtaaccgttactttaccgtcgtacggtaccttacccgtaaggttaccgtcgggtaaccctaaccgttaccgaaccggttacccgtaaccccggtacggtacccctaaacgttcccgaacccgggtaaccttacccggaaaggtaacccgggttacggggaccgtaacggtaccgttaacgtttaacgttacgtacgggaacggtaaaccgtacggtcgggttaacttacccgtacggtccgttaacggacgtttggaaccgttacgggacggtttacgggtccgggacgggtaaccgggaaccgtaacgtaccgttacggaacccgtttacaacggggttcccaacgggtacccgtacggtcccggtacgtccccgggttaacgtcccgtaccttccggtttaccgtacccccttaccgtacccgttaccgtaccgttacccgtacgttacccg

SEQ ID NO: 77815 - DNA, 633 bp, Homo sapiens
  misc_feature: GYAE6OF02G462I.49.81.H04.1.454.CMB.1.raw
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttccaggaccgccccagactcctcattcatgacaataacaagcgagtcccagacgattcctgaccgattctctggctccaagtctcggcacctcacgccaccgtgccatccgaccgtactccagacgtcggggacgaggccgatttacttacgtggaccggaaactagtcggggtacttaccgacggtcctagggtacggttggtcgtaccggtagggttccggttcggggacgggtaacgggaccgtaagggtccgtacggtacccgtccgtacgggtacctaccggacccgagggtcccgtaccgggtcccccgttacgggtaccaccgtttccgtcccggtttaccccaccccgtttccctacccgttcccttccgtacccgtaccg

SEQ ID NO: 77816 - DNA, 689 bp, Homo sapiens
  misc_feature: GYAE6OF02JHVJQ.49.81.H04.1.454.CMB.1.raw
  modified_base (123)..(123): a, c, t, g, unknown or other
  misc_feature (123)..(123): n is a, c, g, or t
  modified_base (134)..(134): a, c, t, g, unknown or other
  misc_feature (134)..(134): n is a, c, g, or t
  modified_base (156)..(156): a, c, t, g, unknown or other
  misc_feature (156)..(156): n is a, c, g, or t
  modified_base (167)..(167): a, c, t, g, unknown or other
  misc_feature (167)..(167): n is a, c, g, or t
  modified_base (187)..(187): a, c, t, g, unknown or other
  misc_feature (187)..(187): n is a, c, g, or t
  modified_base (210)..(210): a, c, t, g, unknown or other
  misc_feature (210)..(210): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
tcagagtcgagagacacgaccggtgctcgatttagtagtgtagattcgcggggagtcccaaccaggacacagcatggacatgagggtccctgctcagctcctggggctctgctgctctggctntcagtgccagntgtgacagtccggatcgacccngtctcactccncctgtctgctatctgtaggnactagatcacatcgacttcgccnggcacgtggactagttacgctaactattaactaggtatacagacgaaaccngggaaaccnccggtaaactcccctaagtccctacgaacctctacggactagacctaagttccgaaagtttcgggaacctacgggtaccctaaggttccaagggtttcgaacggttggaacttacggtacggtaccgttaggtttaaccgtttcgtttaaccgttactaccgtacttaccgtaacgtccgaaccgtcggacctacggtaccgtagtacgtagttaacgtacgtactaaacgttacttacggttactaacgtaacgttacgtaacgtacttaacgtaacttaacgtacgtaccgtacgttaccggacggttacgggaaccgtacgggtacgtaggtacgttacgaacgttaaccgtaacggtacgtacgtcgtaacgtaccggtactaccgttacgtaccgttacgtacgttaccgtacg

SEQ ID NO: 77817 - DNA, 784 bp, Homo sapiens
  misc_feature: GYAE6OF02HTOGH.49.81.H04.1.454.CMB.1.raw
tcagagtcgagagacacgaccggtgctcgatttagtagtgtagattcgcgggggggggacaatcttcatcatgacctgctcccctctcctactcacccttctcattcactgcacagggtcctgggcccagtctgtgttgacgcagccgccctcagtgtctgccggccccaggacagaacgtcaccatctcctgctctaggaagcagcctaccaaactagttaggggaaagtaaatttatgtaatcggtaggtaccagctacgttcccgaggaaccggcccccagtacctcctactattcactgaacaataacagcgacgtaccagagtacttcctagaacctattcctacgtcgggtaccttaccgtaacgttccgtcggacctaacctccgacgtacccgaacccgttcgggaccctaacgttacccgaacccggttaccctaacccgaaacgggtacccgggtaacggggggaccgtaaccgggtaccgtaagtttaaacgtttaccgtcgggtaacccgggtaaacttacgggttacgggtaactttacccggacggtccgttagggtacgggttcgggttacgtacgggtaggggttcggttacggggacgggtaacgggacccgtaaggtcgtacgacgtttacccgggtaccgtaacgggtacccgacggacccgtaagggtccccggtccgggtccccgtacgggttaccctaccgttcccgttaccggttacccccaccccggtttccctacccgttacccgacccggttacccgg

SEQ ID NO: 77818 - DNA, 715 bp, Homo sapiens
  misc_feature: GYAE6OF02ILCRP.49.81.H04.1.454.CMB.1.raw
  modified_base (153)..(153): a, c, t, g, unknown or other
  misc_feature (153)..(153): n is a, c, g, or t
tcagagtcgagagacacgaccggtgctcgatttagtagtgtagattcgcgggggggggacaatcttcatcatgacctgctcccctctcctcctcacccttctcattcactgcacagggtcctgggcccagtctgtgttgacgcagccgccctnagtgtctgccggccccaggacagaaagtcaccatctcctgctcgtggaagcagctaccaactagttagggaaagtaagttatagttatcggttacggtaaccgagtctacgttccccgaagggaaccccggcccccgagacctccctcattcaatcgaactaataacgaagtacgacgtaccgaggtacgtacttccgtacggaccgtattctacgtcggtacctaccgtaacgtccgtacgacctacctaccgtaccgcccctacccgtcggacccacgtacccgaacccggtacctaaccgacggtaccggtacgggggaccgtacgggtaccgttatttaacttacggacggaacggtaataggtacggtacttcccgagtccgttaggacgttcgggtcgttcgggttagggtcgggtacggggccggggaacggtaccgaagtcgtcggtaccgttacggacggtccgacgtcccggaggccggtccggtcccgttcggacctaccggtccttcccggtaccccctcccgttaccgttccctcgttacccgagtccg

SEQ ID NO: 77819 - DNA, 699 bp, Homo sapiens
  misc_feature: GYAE6OF02IOT9M.49.81.H04.1.454.CMB.1.raw
tcagagtcgagagacacgaccggtgctcgatttagtagtgtagattcgcgggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcacatcacttgccaggcactcaggacattagacaacttaatttaaattggtatcagcaagaaaccgaagggaaaccgacccctaacctcctagaactactaacgtatcgacaactacctaaatttacggaaagttacggggtaccctaagtacgtaaaggttacgtaggtagggaaaggtaggtacgttacggttacggggtaacgttttaacgtttttaaccttttaccgtaacctaattacctaacttaccgtaaacctggtaccgaacgtccgtaggaacggtaattagttaacgaacctaaactaacttaactttaacgttacgtaactaaaactaaatataagttaacttaacttacctaacctactaccgtacgtttaccggaccgggtaacgggaccgtaacgggtacggtacggtaacgtaaccgtaaaacggtaacgtcggtaacggtccgtagaccgtaaccgttattccgttacgtttaccttaccgtaccg

SEQ ID NO: 77820 - DNA, 710 bp, Homo sapiens
  misc_feature: GYAE6OF02ILQ0V.49.81.H04.1.454.CMB.1.raw
  modified_base (388)..(388): a, c, t, g, unknown or other
  misc_feature (388)..(388): n is a, c, g, or t
tcagagtcgagagacacgaccggtgctcgatttagtagtgtagattcgcggggggggacaatcttcatcatgacctgcctcccctctcctcctcaccccttctcattcactgcacaggtcctgggcccagtctgtgttgacgcagcccgccctcgagtgtctggccggaccccaggacaagaaacgtccaccacttcctccgtgcctcgtagggaagccgacgcctaccgaaacgtaggttaggggaaataattagtggttaacgtcggtacggtaccagacgtacgttacccgaagggaacccgcccctagtacctcctactacttcagtagaaactaaactaacgaacgccgtacgtaccgagtacgtacttcccgacgaaccgtnttcctcgtacggacctacgtaagtccgtcggacctaccgtcgacgtacccaccgtcgacctactaccgacccggtactaccgaaggtccggtaggggaccgacgtaccgttatttaacgtcgtcggaacgtacgtaggtacggtaccttacgacgtccgttaggtacggtcgggtcgtacggtaggggttcggtacgggacgggaggtaaccaggtctaccggccgtaccgtagaccgacggacccgagggtccctccggggcccttacggtcctaccgttccgtccttaccccgccttccgttacctccgtactccgtacg

SEQ ID NO: 77821 - DNA, 658 bp, Homo sapiens
  misc_feature: GYAE6OF02G70T8.49.81.H04.1.454.CMB.1.raw
  modified_base (567)..(567): a, c, t, g, unknown or other
  misc_feature (567)..(567): n is a, c, g, or t
  modified_base (620)..(620): a, c, t, g, unknown or other
  misc_feature (620)..(620): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgctatctgtaggagacagaactcacatcacttgccaggccactcgaggactagttacgactaactttaatttaaagttggtacttacgagcaaacgaaaaccgacgggaaaacgtacccccttaaacccgttccgtagacttccgtaacgtacgtacgtcctaacttaccgtaaagttttaacggaaaggtttaccggggtaccctagtaccgtaaacgggtttcgtaaggttagggaaacgttcgggaacgtttacggtacgggttaaacgttttacgtttttaaccgtttaccctaacgttaacttacctaacgtaacctaaccggttcgacctaacgtccgtagtacggtattacgttagactaacgtactattacgactacaataatntataatatacctacactctacgttcgacggacgactaggcgatacgacgtaanacggtgtcgtctcgacacgtctgtcgttacctgtaccc

SEQ ID NO: 77822 - DNA, 797 bp, Homo sapiens
  misc_feature: GYAE6OF02H4WGI.49.81.H04.1.454.CMB.1.raw
  modified_base (153)..(153): a, c, t, g, unknown or other
  misc_feature (153)..(153): n is a, c, g, or t
tcagagtcgagagacacgaccggtgctcgatttagtagtgtagattcgcgggggggacaatcttcatcatgacctgctccctctcctcctcacccttctcattcactgcacaggtcctgggcccagtctgtgttgacgcagccgccctcagtntctgccggccccaggacagaagtcaccatcctctgctcgtaggaagcacgcctaccgaacagttaggggaaataatttagtcgttaagtcgtcggtaacctagactaccggttaccgacggaacccggccccctaagtccgtcctctacttcacgttagaacaactaacgaagacgacgtaccccgaagtacgtacttccgtacgaaccgtatttcctcgtcggccttacgtaacgtccgtacggactacccgtcctacgccctaaccgtccggaccttaacgaccgtacccggaacctccgaacgtacgggtacgggacggaacggccgttaatttacgtacgtcgggtaccgtaaagcggtacggttaactccgaaccgtccggtaggtcgttagggtaccggttaggtacggggttcgggtaaccggggtccgggtaaaccgggaccctaacggggtcccgtaaccgggttacccttaccggggtaaacgtacccggacccggtaacccggaacccggttcggttacccccgggtaccccgggttttccgacccgttaacccgttttcccgtacccccggtttcccccttccccggtttccccgtttacccttcccggtttaacccctcggttacccccgg

SEQ ID NO: 77823 - DNA, 691 bp, Homo sapiens
  misc_feature: GYAE6OF02FHP1I.49.81.H04.1.454.CMB.1.raw
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
tcagagtcgagagacacgaccggtgctcgatttagtagtgtagattcgcgggggagtcccaaccaggacacagcatggacatgaggggtccctgctcagctcctgggggctcctgctgctctggctctcaggtgccagatgtgacatccggatgacccagtctccatcctccctgtctgcatctgtaggagacagaatcaccatcacttgccagcgactcaggacattagcaactattaaattggtatcagcagaaaccagggaaancccctaaccncctagatactacgaattcgacacgtcctaaaactttggggaaaaattacgggggtcccctaattacgtaaacgggtttacctaggtagggtaacgtgggtaactttccggagggggttaaccggttaactttttaccttttaccgaaccctattaccgattaccaaaccttcgtcacgtccgtaggaggtattaacgttcggtacaaacctagtttaacttactacggttacaaaccgtaattaacttagtaaattaaactaccttaaaccctaactttcctaacggtttttacccgggacggtaacggggtaacccgtaacgggttagggtagtaacgtaccgaaaaaccggtacgtacgggttcgcgttacggacctaccgtaacttacgtccggtttctttaccgtaaccg

SEQ ID NO: 77824 - DNA, 599 bp, Homo sapiens
  misc_feature: GYAE6OF02I922E.49.81.H04.1.454.CMB.1.raw
  modified_base (132)..(132): a, c, t, g, unknown or other
  misc_feature (132)..(132): n is a, c, g, or t
tcagagtcgagagacacgaccggtgctcgatttagtagtgtagattcgcgggggagtcccaaccaggacacagcatggacatgagggtccctgctcagctcctggggctcctgctgctctggctctcaggtnccagatgtgacatccggatgacccagtctcatcctcctgtctgcatctgtaggagacagaatcacatcacttcgccaggcactcaggacattagacaacttaatttaaattggtatcgaagtacaagaaaccgagggaaaccgacccctaacctcctagacgtctaacgtctagaccactaccgtaaagtttaggaaattacggggtccctaagttacctaaagggttcaacggtagggaagtcggaagttcggtagggttaacgttattttacgttacacctatctactactaacctgctacgtcctggagtatacgtagacactattagtacttagactaacattaatacgtaataacttactaacctacttctaccggtttcggaccgggacgtaccggacgtggatacgtaacaaacggtaacgtggtacgcgtacgacacctattcgtcgttactcgttacc

SEQ ID NO: 77825 - DNA, 688 bp, Homo sapiens
  misc_feature: GYAE6OF02JQBAL.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggccactcaggacattagactaacttatttaaattggtaatcagacaagaaaccgagggaaacgacccctaacctcctagtactacttacgatcgactactacctaagtttaaggaaagtacgggtcctaagtacgtaaggttacgtacggtaggtaacggtggaacgttcgtagggttaactttaacgttttaccttacgtaaccacgttactacctacgtaaccgtcgtactacgacgttacggtaagtacttacgttagaactaacgtaactttaagttaacttacggtaaactaaaccgttaaattacgtagtaaacttaaccttaccgtaaccctaacgttcgttaaccggttcgggaccggtaaacgggtacccggaagggttacggaagtaccgttaaccgaaacggtaacggttacggtccggtaaccgtcgaacccgtactaccgttcgtacttaccgttacttacccg

SEQ ID NO: 77826 - DNA, 610 bp, Homo sapiens
  misc_feature: GYAE6OF02H384Q.49.81.H04.1.454.CMB.1.raw
tcagagtcgagagacacgaccggtgctcgatttagtagtgtagattcgcgggggagtcccaaccagggacacagcatggacatgaggggtccctgctcagctcctgggggctcctgctgctctggctctcaggtgccagatggtgacatccggatgacccagtctccatcctccctgtctgcatctgtaggagacagaatcaccatccacttgccagggaccgactcaggactattagactaacttaattttaaattaggtatacagacaacgaaaccgagggaaacctcccctaaacctcctacgtatactacgactgactactacctaagtttaggtaaacgtacggggtaccaatacgaaggttcaggtagggtaagtggaactcgtagggaactttattttacttacacctatacatacactagcacgtcctaggtagtattatagacaactattaacttactacgtacaaactaataatgaataacttacctaccctacttactacgtttacgggaccgggtaacggaccggacgggtagacgtactaccggaaacgtacgtaggtgacgtacgaccacgtacttcgttcgttaccttacgtacc

SEQ ID NO: 77827 - DNA, 886 bp, Homo sapiens
  misc_feature: GYAE6OF02IO1DU.49.81.H04.1.454.CMB.1.raw
tcagagtcgagagacacgaccggtgctcgattttagtagtgtagattcgcgggggggagtcccaacaggaccacagcgatggactatgacgggtccctgcctcagctcctggggcctcctcgtctgcgtctggcctctcacggtcgtccgaaggatcgtggactacgtccgggatcgaaccccagtcctccacctcctccgtgtctacgctacgtacttggtacggtacgtacacgtaactccacctattctacgttggccggtagggtcgtaccgtcgacggtactacgttaccggacctaaaacgttaacgtttaaacgtttaggtaacttaccggacgtaccgaaaccgtaaaacccggaacgggtaaacccgtttacccccgtaaaccgttaccgttaagtaacgtttaccgtaaacggtacgtccggtaacctaaaccgttaccgtttaaacggtttaacgggaaaacggttttaccggggtaacccctaaaggttaacccggttaaacgggttaccgtaacggttaacggtaaacgggttcggaacggttaccgggtttaacggggtaaccttttaaaccggtttttaacccgttaaacgtaaacccgttacgttaccgtaaccaacctttttttttaacgacgtacgtacgtacgtacggtacgtacgttactacgactaactaacttaacttacgttacgtaactaactaactactacgtaacgttaacttacgttacctactaccgttacgttaccgggttaaccggtacggtaccgtacggttacggtacgtaaccgtaaccggtaaccggtaaccggtacggtaccggtacgtacgtaccgtaccgtaccgttcctacgttccctacgttacccg

SEQ ID NO: 77828 - DNA, 835 bp, Homo sapiens
  misc_feature: GYAE6OF02JAWNB.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacagttgggaataattagtgtatcggtaggtaccagcagttccccgaggaaccggcccctagacctcctctacttacatacgaactaataaacgaagacgacgtaccccaagtacgtaacttaccgtacgaaccgttatttccgtaccgttacgggtccttacccgtaaaggttccgttacggacctaaccccgtttccgaaccgtccccctaaacccgtcgggtacccctaacggtacccgaacccgggtaacccttaccccgaacgggtaacccggttacgggggggaacccgtaaccggggacccggttaaacgttttaacgtttaaccggttaccgggaaccgggtaaacgtaggtaccggggtaactttacccggacggtcccgttaaggtacgggttacgggttcgtacggtacggggtttggttaccgggaccggggtacggtaacccggtaaacggtccggttaccgggtacccgttaccggttaacgggtaccgtaacccgggtacccgtaacgggtccgtaccggggtaccccgttaccgggtcctaacccggttccgtttaccggttaccccctacccgtttacccgttaccgttcccttaccgtccgttaacccgg

SEQ ID NO: 77829 - DNA, 662 bp, Homo sapiens
  misc_feature: GYAE6OF02FHKYG.49.81.H04.1.454.CMB.1.raw
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggagcagctccaacnttgggaanattatgtatcgttggtaccngcagttcccaggaaccggccccagacctcctcacttcatgaacaataacagcggactcccaagatacttcctagaccgtattctcgtcggctaccgaagtctcggacctcccgtacgtacgcccacccgttcggccacgtaccgaaccgtacctaccgacggacggtacggggacgacgggtaccgtaagtttaacttacggtacggtaccgggaaactaagtcggggtaaccttccgaaggtcccgtaggtaggttagggttcggtacgttagggggtcggttacggggacgggagggaacccgtaggcgtacgtaccggtccgtaggccgtacgaaccccgaggtccgtccggtcccggttacggtccgtacctcccgttccgtaccccgtacccttcccgtacctccgtaccgtccgtaccg

SEQ ID NO: 77830 - DNA, 731 bp, Homo sapiens
  misc_feature: GYAE6OF02IBDGM.49.81.H04.1.454.CMB.1.raw
  modified_base (191)..(191): a, c, t, g, unknown or other
  misc_feature (191)..(191): n is a, c, g, or t
  modified_base (234)..(234): a, c, t, g, unknown or other
  misc_feature (234)..(234): n is a, c, g, or t
  modified_base (359)..(359): a, c, t, g, unknown or other
  misc_feature (359)..(359): n is a, c, g, or t
  modified_base (600)..(600): a, c, t, g, unknown or other
  misc_feature (600)..(600): n is a, c, g, or t
tcagagtcgagagacacgaccggtgctcgatttagtagtgtagattcgcgggggggacaatcttcatcatgacctgctcccctctcctcctccacccttctcattcactgcacagggtcctgggcccagtctgtcgttgacgcagccgccctcagtgtctgccggcccaggacagaaagtcaccatctccngctctggaagcagcctaccaacatttacggggaaataactttntgtaagtccgtcggtacagtcacgtttccgacggaaccggcccccagacctcctacgtacttccattcgaacaaacgttaaacaacgtccgaagtcccaaggacgtacttaccgtcgaaccggtnttacctccgtggcccttaccaaacgttcgttaccggctaccttaccgaacgtcccctacccgttccggaccctaattcccgaccggtaccctaccgacggaacgttccgggggaacgacgggaccgttaacgttaagttaaccgttcgaaccggtaacgtaacggtcggaacttcccggtagtaccgttggaccggttgggtcgtacggttgggttaccggtcgggaggggtccgggaacncgtaccggtacgccggttacgtacgtacgtaccgaaccgtagacccgttccgggacccgttcggttaccctaggttccttacccgggttcccctccccgtttcctacccgtcgtttccgtaccctacccgg

SEQ ID NO: 77831 - DNA, 799 bp, Homo sapiens
  misc_feature: GYAE6OF02IKLSR.49.81.H04.1.454.CMB.1.raw
  modified_base (165)..(165): a, c, t, g, unknown or other
  misc_feature (165)..(165): n is a, c, g, or t
tcagagtcgagagacacgaccggtgctcgatttagtagtgtagattcgcgggggggacaatcttcatcatgacctgcctcccctctcctcctcacccttctcattcactgcacgagggtccgtcgggcccagtctgttgttgacgcacgcccgccctcagtgtcnggccggcccgaggacaaggaaacgtccaaccactcctccgtgctcgtaggaacgcgacgcctaccaaacgtaggttagggaaagtaaatttagtagttaacgtcggtacggtaccgacgtacgtaaccggtacccgaacgggaaccccggtacccccgaagtacccttcctacgtaaccttacaacgttaacgaaaccaaaactaaacgaaccggtaaccgtaccgtaacccgaaaggtaccgtacgttacccgtacgaacccgttagtttccgtacgtcggtaacctcgtaacgttcgtacgaccaccgtaccaccgtacccgaccgtcgaccctacgtcccgtaaccgaccgaccgtacggtacgggacggggaaccgcgggtaccgttaacgtttacgtaacgacgggtaaccgaacgtagggttacgttaaccgttcccggaccgtacggtacggtacggttaggttcggacgggtagggtccgggtacgggacgggacgtacgaacgtccgtaccgtacgtccggtagacccgtcgaaccggtcgtacgcccggtaccccgttgtacccgtaccgtaccgttcccggttacccctacccggtccttaccgttccgtaccgtaccggtcg

SEQ ID NO: 77832 - DNA, 810 bp, Homo sapiens
  misc_feature: GYAE6OF02H8ZNZ.49.81.H04.1.454.CMB.1.raw
tcagagtcgagagacacgaccggtgctcgatttagtagtgtagattcgcgggggggggacaatcttcatcatgacctgctcccctctcctcctcacccttctcattcactgcacagggtctgggcccagtctgtgttgacgcagccgccctcagtgtctggccggacccccaggacaagaaagtcaccatctcctgctctaggaagcagcctaccaactagttacggggaaagtaatttacgtgtaagttcggtacggtaccagtacctacggtttaccccgaacggggaccccggacccccaacgtacccttccctacctacttacaacttgaaaccaataaaccgaaagtaccggaaccgtaccccgaaggtaacgttaacgtttcccgaggtaacccgttactttcgtaccgttcggtacccttacccgaaacggttccgttacgggccctaccccgttaccgaccgtacccctacccgttacggacccgaacttacccggaccccggtaccacccgtacggtaccgggtacggggaaccggagggtaccgtaacgttttacttaacggtacggtaccgggaaatacggtacggggtacttcccgtaacgtcctaggtggttagggttacgtcgggtagggttcgggttacgggacgggtaccggggaacctacggtccgtaccgtaccggtacgtacggtaccgaccggccgtaacggcccggtacgggtccccttacggtaccttcccgttccgttacccgttccctaccccgttccctccgttaccgttaccgtccgttacccg

SEQ ID NO: 77833 - DNA, 688 bp, Homo sapiens
  misc_feature: GYAE6OF02GMP3T.49.81.H04.1.454.CMB.1.raw
  modified_base (228)..(228): a, c, t, g, unknown or other
  misc_feature (228)..(228): n is a, c, g, or t
  modified_base (558)..(558): a, c, t, g, unknown or other
  misc_feature (558)..(558): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcagggtcgccagatgtgacagtccggatcgacccagtctccactcctcccgttgtctgctatcgtggtaggagacagaactcaccatcgactgccagcgactnaggactattagactaactatttaagtgtatactagacaacgaacgaacggaaccgtccccctaaccgtacctagtacttacctaacgtatacgtacctaacgttaccttaaggtttaacggtaaaacggttaacggggtaccctaacgttagttaaccgggttacgtaaggtaggtaaacggtggtaacgttaccggttaggtaaccgttttacgttttactttcctaacgtactacgtactaacgtacctacgacgtaaccgtccgtaaggtgtaacttactacgtaacaacttacgttaacttacgtattaaacgtaaactagttaanacgtaacttaacctactaacccgttaacttccggttaccgttcgggtaaccgggaccggttagaaccggtggactacgaaaccgtaagtaacgtggacgtcgagcaccgtctacgtcttacttatacccg

SEQ ID NO: 77834 - DNA, 759 bp, Homo sapiens
  misc_feature: GYAE6OF02JWP7K.49.81.H04.1.454.CMB.1.raw
tcagagtcgagagacacgaccggtgctcgatttagtagtgtagattcgcgggggagtcccaaccaggacacagcatggacatgagggtccctgctcagctcctggggcttcctgctgctctggctctcgaggtgccgagatgtgactatccggatacgacccagtcctccatccctccgtgtctgcatctgtaggacacagactcacatcactgcaggcactcgagactagtacgactaacttagtttaaagttcggtaactacgagacctaaacgggaaaacccgtaacgggaacctaaccccgttaaccgtaccgttacgtacgttacccgtaacgtactacgaccgtaacttaccgtaaacggtttacggtaaacggttaccggggtaccctagtacgtaacggttacgtacggtagggtaacggtaggtacgttaccgggttagggtaacctttacgttttaccttaactaaccgtattacaaccgtttacctaaccgttacgaccgtacgtaccgttaacggaagttaccgttagttaccgaacgttaacttagtaaccgtttaacgtacgtaacgtaactaaattagtaaacgtacttaccgtaacttactacgtttaacgtccgttaaggggtccggtaacggtaacgtacgggtaacgaagttaaccgtaacgtaacgggaaacttcggtaaccggtccgttaacgaccgttaaccgtaacgtttccgtacgttaccctttagtaaccccg

SEQ ID NO: 77835 - DNA, 880 bp, Homo sapiens
  misc_feature: GYAE6OF02FN9ZX.49.81.H04.1.454.CMB.1.raw
  modified_base (192)..(192): a, c, t, g, unknown or other
  misc_feature (192)..(192): n is a, c, g, or t
tcagagtcgagagacacgaccggtgctcgatttagtagtgtagattcgcgggggagtcccaaccaggacacagcatggacatgagggtccctgctcagctcctggggctcctgctgctctggctctcaggtgccagatgtgacatccggatcgacccagtctccatcctcctgtctgcatctggtaggaganagaactcaccatcacttgccgaggccgactcgacggaactacttacgactaaacgttaatttaaaacttggtaactctaagaccaaacggaaacccgaaacggggaaacctaccccccgttaaactcccgttagaacttccgtaacgtactcggtactaacgttacccgttaaaagttttaacgggaaaaccggttacccgggggttaccctaaagttaccgtaaaacgggttttccgaaggggtttacgggtaaaacggggttcgggtaagtttacccggggttaagggggtttaaaccgtttttaactttttaaccccggtttaccaacccggtttaattaaccctaaccggtttaacccctaaacgttccgtaaacggtccggttaccgtaggtaaacgggttacttaaggtactaaaccgtaaacgttacgtttaaacgttaaccgttacgttaacctaaagttaaccgtttaagttaacgtaaacttaaaccttcctttaaaccgtaacccttaccggtaacccgggttttaccgggaaaccggggtaccgggttaaaccggtaccggggtaacgggtaaccgtaacgttaaaccgaaaaccgggtaaccgttagggttacccggtacgtaacccgtacgttaacccgtagttcccgttaccggtttaccttaccgttacccg

SEQ ID NO: 77836 - DNA, 679 bp, Homo sapiens
  misc_feature: GYAE6OF02I2853.49.81.H04.1.454.CMB.1.raw
tcagagtcgagagacacgaccggtgctcgatttagtagtgtagattcgcgggggagtcccaaccaggacacagcatggacatgagggtccctgctcagctcctggggctcctgctgctctggctctcaggtgccagatgtgacatccggatcgacccagtctccatccctcctgtctgcatctgtaggagacagaactcacatctacttcgaccgaggcactacgaggactattagactaacttaatttaaagttaggtatacacgtacaaacgaaaccgaagggaaacctaccccctaacctacctagtacttactacggatacgctactacctaagtttaaggaaacggttacgggtcctaatcgtaaggttcaggtaggagtgacgtgtacggtacgtttattttaccgtctactactactacttaccactagtcgaaccgtcgtaggacgtattagtacgactaacgtaattacgtttaacgtacttaactaaactaacgtaatttacgtaaacttaacctttacgtaaccctacgtttaacccgttaccgggttacccgggtaacggggaccgggtaccgtaagggtaccggtaagtaacgtaacgtaaccggttaacgtggtaaccgtgtaacgtccctacgttacttccgttaccgtttcctacgtttaccg

SEQ ID NO: 77837 - DNA, 728 bp, Homo sapiens
  misc_feature: GYAE6OF02H9SRQ.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctggcccagtctgtgttgacgcagccgccctcagtgtctgccggccccaggacagaaagtcaccatcctcctgctcgtggaagcagctccaacagttgggaagaattatgtatcgtaggtaccagcacgttcccaggaccgccccagacctcctcatcatgacaataacaagcgacgtcccaagagtacttccgtacggaccgtattcctaccgtggtcctaccgtaagtccgtcggaccacccttcaacggtcccaaccccggttcggaccctaagtacccgaacccggaaccttcccgaaggaccggtacggggggaaccgaacgggtaccgtaattttaactttaaccggtacggaccggaaagtacgtacggggtaaccttacccgaacgtccgttaggaagttcgggttacgtaccgtaggggttccggttcgggacgggtaacggggaaccctaaaggccgttacggaaccccgtttacgtaacggtccgaaccgacccgaagggtcccgtacccgggtccccgttaccggtaccgtaactcccggtttacccgttcccccgttacccccgttcgtaccctttcccggttccgtaccgttaccg

SEQ ID NO: 77838 - DNA, 695 bp, Homo sapiens
  misc_feature: GYAE6OF02HYK3O.49.81.H04.1.454.CMB.1.raw
  modified_base (247)..(247): a, c, t, g, unknown or other
  misc_feature (247)..(247): n is a, c, g, or t
  modified_base (355)..(355): a, c, t, g, unknown or other
  misc_feature (355)..(355): n is a, c, g, or t
  modified_base (402)..(402): a, c, t, g, unknown or other
  misc_feature (402)..(402): n is a, c, g, or t
  modified_base (553)..(553): a, c, t, g, unknown or other
  misc_feature (553)..(553): n is a, c, g, or t
  modified_base (681)..(681): a, c, t, g, unknown or other
  misc_feature (681)..(681): n is a, c, g, or t
tcagagtcgagagacacgaccggtgctcgatttagtagtgtagattcgcgggggggacaatcttcatcatgacctgctccctctcctcctcacccttctcattcactgcacagggtcctgggcccagtctgtgttgacgcagccgccctcagtcgtctgccggcccaggacagaaagtcaccatcctctgctcgtaggaagcagcctaccaatagttgggaataattagtgtattcggtacggtacngactacgttccgaagggaacccggccccagtacctcctctacttcatagaaactaaacgtaaacaacggccgacgttacccgaagtaagtacttcccgtcgaaccgtnttcctcgtcggtacctaccgtaacgtcgtacggacctacctacgccncccctaccgtaccggacctacaccgacccgtacctaccgacggtacggcgggaacgacggtacgtatttacgtaacgtcggacaacgtagtacggtacctaccgtgtaccgtggtaggttcggttacgtcgggttagggtcggttacgggngggtaacgaccgtaggtaccgtacgtacccgttcgacgtaccgtacgaacccgtacggtcccgtcgggtcccgaccggttcctccgttcccgttacccgtttccccgaccttcccgttacccgttccncccgttacccgcgg

SEQ ID NO: 77839 - DNA, 868 bp, Homo sapiens
  misc_feature: GYAE6OF02HMZTA.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagcccgccctcagtgtctgccggccccaggacagaaacgtcaccatctcctgtcctcgtggaacgcgaacgcctaccaaacgtagttaggggaaataaatttagtaggttagttaccggtggtaaccacggtacgtaccggttacccgaacgggaacccccggtcccccaaagtaccccttccctactacttcgtaactagaaactaactaaacgaacggaccgtaccgtacccgaaggtaacgtacttcccgtacgaaccgtactttccgtacgtcggtaccttaccgtaacgtcgtaccggcctacccgactaccgtacccgtacccgttacggaccctacgtaccgaccccgtaaccgtaccgaacggtaccgggtaacggggacccgacgggttaaccgttatttttaaaccggtacggccgggtaaaccgtaacgttacggggtttaacgggtccctttaaccggacgttaccggtagggtttacgggtaccgggttacgggtcgggtttacggggggttaccgttaccggggggacgggggtaaacccgaaccggtacgggtacccggtacgggttaaccccgttaacgggtcggaaccttaaccgggcccgggttacggtcccgtccccggttcccgggtaacctacccgtcccggtttacgtaccccgtttccccgtacccctaccggttcccgtacccgttcccgtaccgttacccgg

SEQ ID NO: 77840 - DNA, 768 bp, Homo sapiens
  misc_feature: GYAE6OF02I4BCQ.49.81.H04.1.454.CMB.1.raw
tcagagtcgagagacacgaccggtgctcgatttagtagtgtagattcgcgggggggacaatcttcatcatgacctgctcccctctcctcctcaccttctcattcactgcacagggtcctgggcccagtctgtgttgacgcagccgcctcagtgtctgcggcccaggacagaaagtcaacatctcctgctctaggaagcagcctaccaaacgtagttacggggaaataaatttagtagttagtcggtaggtaccagtctacgtaccgaacggaacccgccccagacctaccgtactacgttacagtacgaaactaaactaacgaacggccgaacgtacccaaggtaccgtacttcccgtacggtaaccgtactttcgtaccgtcggtaccttaccgaacggttccgtcggtaacctacccgtaccgaaccgtacccctacccgtacgggtaccctaacgtacccgaaccgggtacctaacccggaacggtaacgggtaccgggggaacgtaacggaccgtttaaagttttaccgtaacggtaccgggaacggttaaacgtacgggtacgggttaaccttccgacgttaccgttaggtacggttcggtaggtaccgtaggggttcgttacgggacggtaacgggactaacggtccgtacgtaccggttcgtaacgcgtaacgcccgtacggtccgtccggtcccgtacggtactacccgttaccgttacccgtccccgtacccttccgtaccgtcttcccgttacgtacg

SEQ ID NO: 77841 - DNA, 756 bp, Homo sapiens
  misc_feature: GYAE6OF02G6R3K.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagcctccaacagttagggaaagtaattatgtatcggtggtaccagcagttcccgaggaaccggccccagtacctcctacacttcatcgaacaaactaacaagcgacgtacccgagtagacttccgtgaccgtattctctcggcctaccgtaagtcgttggacctaccgtacgacgcccaaccgtcggaccctaacgtcccggacccggaccttacccgaaggacggtaccgggggtaacggacgggtacccgtaattttaaccgttaacggtcggtaaccgggtaaactaggtaacggggttaacctttaacccggacggtacccttagggaacggtttcgggttacgttacggggtacggggttacgggtttccggggacggggtaacgggaccgtaaacggtcgtaccggtaccgttaccgtaaggtccgaacccgtaccggacggtccgtacccgggttaccccgtaccgggttcctaacccgtttcggttacccctttaccccccgaccccggttttcccttacccgtccctttccccgggtacttccccgg

SEQ ID NO: 77842 - DNA, 802 bp, Homo sapiens
  misc_feature: GYAE6OF02H0UZE.49.81.H04.1.454.CMB.1.raw
  modified_base (98)..(98): a, c, t, g, unknown or other
  misc_feature (98)..(98): n is a, c, g, or t
  modified_base (181)..(181): a, c, t, g, unknown or other
  misc_feature (181)..(181): n is a, c, g, or t
tcagagtcgagagacacgaccggtgctcgatttagtagtgtagattcgcgggggggacaatcttcatcatgacctgctccctctcctcctcacccttntcattcactgcacaggtcctgggcccagtctgtgttgacgcagccgccctcagtgtctgcggcccagacagaagtcaccatcncctgctcgtggaagcagcctaccaaactgttagggaaactaattatagtaagtccgtaggtaaccagtcgaaccgttacccgaacggaacccggtccccccaaggacccttcctactaacgttccagtacgaacaaacgtaaacgaagacgaaccgtccccgaagtacgtaaccgttcctacggtaaccgtacgttccgttaccgacgggtcctaacccgtaacggttcgtacggacctaccctacgtaccgacccctacggttaccggaccctacgttacccgaaccgggtacctacccgaacgggtaccggtagggggtacccgaacgggtccggttaacgtttacggtttaacgtacgggtaacccgggtaaacgtaaggtaccgggtaactttaccggaacgttccggtaaggtaacggttcggtaccgtaagggtacggttcgggttccgggaacgggggtaaccgaccgtaacggtccgttacggtacccgtaccggtaacggtaccgtacggacccgtaacggtccgtacccgggtcccgtacggtaccgtccgtaccgttcccgttaccccctacccgtcccgttaccgtccgttcccgtacctttaacccgg

SEQ ID NO: 77843 - DNA, 924 bp, Homo sapiens
  misc_feature: GYAE6OF02HKIIV.49.81.H04.1.454.CMB.1.raw
  modified_base (150)..(150): a, c, t, g, unknown or other
  misc_feature (150)..(150): n is a, c, g, or t
  modified_base (763)..(763): a, c, t, g, unknown or other
  misc_feature (763)..(763): n is a, c, g, or t
tcagagtcgagagacacgaccggtgctcgatttagtagtgtagattcgcggggggacaatcttcatcatgacctgctcccctctcctacctcacccttctcattcactgcacaggtcctgggcccagtctgtgttagacgcagccgcctnagtgtctgccggccccaggaccaggaacgtccacctagtcctaccgtgaccttcgtaggtacgcgaacgtccttaacccgaatacgttcggggtaaataacttagtacgtagttaccggtaggttacccaggtaccgtacgtttaccccgaaaggggtaaccccggtaccccccgtaagtcccgttaccccgtacgttaacgtaccgacgtttacgtaaactaaaccgttaaacgaaccggttaaccgtaccgtaccccgaacgttaggtacctttacccgtacggtaccggtacttttccgtccggtaacggtcccttaaccggaattcccggtacgacccgttaacttcccggacgttaccccgtaaccggttcgaccccgttaattcccggacccggtttacgtaccccgtaaagggttccggaacccgggggtcgtaaccggtaccggttaacgttttaacgtacccggttacgggaccgttaaaacgggttcggttaaccgggtaaccgttcccggtacgtacccggttaacggtacgggttacggtacggtttcgggtaacgggtttccggggtaccggtttaacccggtaaggggttaaaccccgnggtttaaccccgggacggtttaaaccccgtaggtttaccggttaacccggaagggtacccccgtacgggttacggttccccggccggtttacccggtaacttcccgtaccgttacccggttccccgttaccctaccggtccttccgtaccgcggttaaccc

SEQ ID NO: 77844 - DNA, 837 bp, Homo sapiens
  misc_feature: GYAE6OF02JOK71.49.81.H04.1.454.CMB.1.raw
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagccgcctcagtgtctgcgcccaggacagaagtcaccatctcctgctctggagcagcctaccaacagttagggaagtaattacgttgtaatccggtaggttaacccagacctacggttaccccgaacgggaaccccggcccccaaggtaacccttcctactaacttacacgtacgaaacgtaaattaaaccggaagccgtaacgtcccgaagacgtacttaccgtcgtaaccgtactttccgttacgtcgggtaccttaaccgtaagttccgtacggacctaccctcgaaccgtcccctaacccgggttcgaccctaaccggtcccgtaaaccccgttaccgtacccgtaggaacccgggttacggggggaaacccgtcgggtaaccgttaagttttaacccgtagttaccgggaaccggtaactacgggtacgggttaacttaccgtacggttacccgttagggtagtttaccggggtcgtaacggtacggggttcggtttccggggaacggggtaccggaacgtacggccggttaccggtaccgttaccggtaacggtccgaaccgggtacccgtacgggtccgttacccgggtccccggttaccgtaccgtacccggtttacccgttccccggttaaccccctccccgttacccgttcccgtttaacccggttccgttacccggttacccgg

SEQ ID NO: 77845 - DNA, 871 bp, Homo sapiens
  misc_feature: GYAE6OF02IWNHI.49.81.H04.1.454.CMB.1.raw
tcagagtcgagagacacgaccggtgctcgatttagtagtgtagattcgcggggagtcccaaccaggacacagcatggacatgagggtccctgcctcagctccgtggggcctcctgctgctcgtggctctcgagggtcgaccgaagtagttggtacgaactacggtacccggagtacccggtaaccctagttcccttaccctaccttccccttcccgttgtcgtcgactacttcggtaggtaaggaacgaacgtaagtaacctacctaacctacttaccgttacgttccggaccggacggtaccgtaaccgtacggaacggtaacttaagttaaccgtaaccttaaacgttttaaattttaaagttacggtaactacgaaagaaccgtaaaaccggaaaaccggtaaaccggggtaaacccccttaacccccttaacccgttaccgtacgttaaccgtaaccgtacgtacgtaccgacctaacgttaaacgtttaaggttaaccgggtaaacggtacccggttacctaaggttaacgtaacggttacgtaaggttaggtaacgttggtaccgttacgggttacgggttaaactttttaccgtttaacctacctaacgttacgttacgtaccttacgtacgtcgacctacggtagtaacggtacgtaattcgtaacgtataacgttaattaccttaacgtactaaacgtaaactagtaacgtaacttactaactaccctaaccttaccgttaggttaccggtaccgggtacgggtaacccggtaagtacggtacgactaacggtaacgtaaacggtcggtaggtacccgtagtaccaccgttactaccttacggttccttaccgtgtaccccg

SEQ ID NO: 77846 - DNA, 1147 bp, Homo sapiens
  misc_feature: GYAE6OF02JOUZ4.49.81.H04.1.454.CMB.1.raw
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagcccgcctcagtgtctgccggcccaggacagaaacgtcaccatctccngctctagggaancagcctaccaaactgttacggggaaataattttacgtagggttaacttccgggtacgggttaacccaggtaccgttaaacggtttcccccggaaaagggggaaacccccgggtcccccctaaaggggttaaccccgtttccgttttaccgtaaacttttacccggtaaaagtaccggtaaaaacccttaaaaacgttaaaaccggaaaacgggtaccccggggttaaaacccggttaaccccggaaaccgggtaaaaggtttaaacccgtttccccggttaaaccgggaaccccgggttaacttttttcccggtaccgttaaccgggggttacccctaaccccggttaaacggggtttcccggtaaccgggacccctaacccgtttacgaaaccccggggtccccttaaacccccggggttgggtaaccccccaacggttacccggtacccccgggtaacctttaacccgggacgggttaaaacccggggtccggggggtaaacccggtaacccggggtacccctttaaaggtttaacggtttaaccccgggaacggtttaaccccggggaaaacggttaccgggtacggggggttaaccctttacccccggaacgggttaacccggttacgggtaaccgggttttcggggaaccgggttttacgggtaacggggggttttcccgggggtttaccggggtaaaccgggggggaaacccgggttaaacccgtacggggttaaccccggttacggggtaacccccggtttacgggttaaaacgggttcccgggaacccgtaaccggtaaggggttccccggtacccgggtttacccccggtaaccggggtttccctaaacccgttccccggttttaacccccgttaacccccggccccggttttaaccctcccgggtttacccggtaccccttacccggttcccgg

SEQ ID NO: 77847 - DNA, 744 bp, Homo sapiens
  misc_feature: GYAE6OF02G3Z3B.49.81.H04.1.454.CMB.1.raw
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgcctcagtgtctgcggccccaggacagaacgtcaccatcgtcctgctcgtggaagcagcctccaaacagtttacgggaaagtaattagtagttacgttcggtacggttaacccaggcctaacgttaccccgaaggggaaaccccggtccccccagtaacccttccgtacttacttccgtaatacgaaccaaagttaaaccaaaggccgtaacggtccccaagtacgttaccgttccgtaccggaaccgttactttccgtacgtcggtaccttaccgtaaagtccgttccggacctaccgtccgaaccggtcccaaccccggttagccccatacccggtaacccggaacccttccgaaaccggtcggggtacggggtaacgaaccgggtaccgtaaacgtttaccgttaacgtcgggtaaacggacgtaggtacgggtacttaccgcggcgttggtacggtcgtggtcgtaggtttcgggcgggacgggacgacgtacgaccgtcggtaaccgtccgtaggccgacgccgacggtccgtccggccgttctaccgtccgttacgtcccgtcccgtcccgttccgtcctcgtccgactaccg

SEQ ID NO: 77848 - DNA, 681 bp, Homo sapiens
  misc_feature: GYAE6OF02HL9GL.49.81.H04.1.454.CMB.1.raw
  modified_base (137)..(137): a, c, t, g, unknown or other
  misc_feature (137)..(137): n is a, c, g, or t
tcagagtcgagagacacgaccggtgctcgatttagtagtgtagattcgcgggggagtcccaaccaggacacagcatggacatgagggtccctgctcagctcctggggctcctgctgctctggctctcaggtgccagntgtgacatccggatcgacccagtcctccactccctccctgtctgctatctgtaggagacagaactcaccatctacttcgccgaggccgactacgaggactattaacgactaaacttaatttaaagtggtatcgagtacaacgaaaccgaagggaaacctcccctaacctctgaactctacgatcgactactacctaagtttaggaacgtacgggtacctagtacggtaacgttggaacgtggtaagtggaattcggtaaggttactttattttacctcaacctatactaataccaaccgtgacccacgtacccgtaggtaacggtacttacgtagaacctaaagtacttaacttaacgttacgaaaacttaacaattataacgtaaattaaccgtaacctacctacgttacgttaaccgggtttaccgggaacgggtaacggtaccgtaaggtacgggaacgtaacctaaaccgggtaaactcggtttacgaccggttccaagtccccttaaaggtcctttacggtcttaccttacgtaccccg

SEQ ID NO: 77849 - DNA, 904 bp, Homo sapiens
  misc_feature: GYAE6OF02JNMB6.49.81.H04.1.454.CMB.1.raw
  modified_base (154)..(154): a, c, t, g, unknown or other
  misc_feature (154)..(154): n is a, c, g, or t
  modified_base (179)..(179): a, c, t, g, unknown or other
  misc_feature (179)..(179): n is a, c, g, or t
  modified_base (200)..(200): a, c, t, g, unknown or other
  misc_feature (200)..(200): n is a, c, g, or t
tcagagtcgagagacacgaccggtgctcgatttagtagtgtagattcgcggggcagtcccaaccaggacacagcatggacatgagggtccctgctcagctccgtggggctcctgctgctctgctctcaggtcgcctagatgtgactagtccggnttacgacccagtctctactcctccngtactgacatctagtacgganaacagtaactcacctatcctacgtgaccaggcgtactcgaggtactagttacgactaacttaacttaagttcgtaactcaacgtacaaaggtaaccaacgggtaaaccgcccctaaaacctcccgttagactaccgtaacggtactacggacctaacgtaccttaaacgtttacgggtaaaaccgttacggggttacccctaagttaaccgtaaggttacgtaacggggtaggtaaacggttcggtaagttaccgggtaacgggtttaacgtttaaccgtttttaaccttaaccgaacccgttattaaccgtaacgttaaccctaacgtttacgaaccgttcgtaaccccgtaaggtaacggttaaacgttacggttaacgtaacccgtaaattaacgtttaaacccgtttaacttacccgtaaacgtaaacccgttaaagttaacttaaccggttaaacttaaccgttaacccgttaacctaaacccgttaccggttttaacccggttaacggggaaacccccggtttaacgggggaaacccggtttaccggggttaacccgggtaacgttaaacccgggttaaccccgaaaaacgggttaacccggttacgggtaaccggggttcccgttaacccgggggaaaccctttaccgttaaaccccgggtttcccgtttaaacggttttccccgttaaaacccggg

SEQ ID NO: 77850 - DNA, 854 bp, Homo sapiens
  misc_feature: GYAE6OF02GND1M.49.81.H04.1.454.CMB.1.raw
  modified_base (770)..(770): a, c, t, g, unknown or other
  misc_feature (770)..(770): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatcgacccagtcctccatccctccctgtctgctactcgtacggtaggacgaacgtaagaacctacaacctacttccgtaacgttccggaccggacgggaccgtaccgtacggaacggtaaccttaagttaaccgaacttaaaacgttttaaagttttaaaacggtttaggttaacttacgaaccggtaaccgaaaaccggaaaacccgggtaaaccggggaaaccccgtaaccccccttaacccgtacccgttacgaacgttacccgtaacgtacgtacgaaccttaactaaccgtttaaggtttaacgggtaaacgggttaccggggtacccctaagtaaccggttaacggttacggtacggtaagggtaacggtacggtacgttacgggtacgggtttaacttttacgttttaccgttaccaacttactactaaccgtaccgtaacgtcgtaccgacggttctaaggtaacggttaattagtacgtaactaactaacgttacgtttaaccgtacgtaaactaaactaagttaacgttaagtaacttaaccgttaccctaaccctaccgttaccgttaacggttacccggggaaccgggtaacggtaccggtacgggtaanacggttaactaacgtaaacgtacggttgtacggtaccttaacggacccttaccgttgtacccgtttacgttacctacttacccg

SEQ ID NO: 77851 - DNA, 521 bp, Homo sapiens
  misc_feature: GYAE6OF02G35MX.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacatagactaactatttaaattgtatcagcaagaaacaggaacacccctaactctagatcacgatgcatactaagttagaaacgtaggtccatactagtcgagtgaagtgatcgtaggtacttatttcgtactactatctatactaactgcagtcctagaggtatagtacacaactaattattactagtaacaataattatataataatactacctactctacgttacggccggaggtacccgaggtgatagtaacgaaacgtagtggtacgactcgactacctatcctctacttctacc

SEQ ID NO: 77852 - DNA, 792 bp, Homo sapiens
  misc_feature: GYAE6OF02HNTQ9.49.81.H04.1.454.CMB.1.raw
  modified_base (772)..(772): a, c, t, g, unknown or other
  misc_feature (772)..(772): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtagacagtccggatcgacccagtcctccactcctccctgtctgctatctggtaggagacagaactcaccatctacttcgccgaggcgaactcgaggacattacgactaacttaagtttaaattggtactacaacgacgtaaacgtaaaacccgaagggtaaaccgtacccccttaaaccgtaccgtaggtaaaccgttacctaaaccggtaagttccggacctaacgttaaccgtttaaaacggttttaaacgggggaaaacgtttaaccgggggttaccccaaagtttaacccggttaaacgttaccggtaaggtagggtaaaccggttggtaacgtacggttcgggttaaacgtttacctttttaacgtacctaactacgtacaacgttacctaaccgtgtacccgtaaggtaccgtaacggtaacgtaggttaactacgacgttaaaactcgtttaaacgttaacgttacggttaacctaaaaacttaagttaacgtaagttaaaaccttaactaaccctttaccgtaaccttttaccggttaacgttaccgggtacggggtaaacggtacgtaacgggtacgtacgtaacttaaacggaacgttaccgtaggtactcgtcgactaacctntaccgtgtaccgtactccgg

SEQ ID NO: 77853 - DNA, 722 bp, Homo sapiens
  misc_feature: GYAE6OF02JNYNV.49.81.H04.1.454.CMB.1.raw
  modified_base (426)..(426): a, c, t, g, unknown or other
  misc_feature (426)..(426): n is a, c, g, or t
tcagagtcgagagacacgaccggtgctcgatttagtagtgtagattcgcggggggggacaatcttcatcatgacctgctcccctctcctcctcacccttctcattcactgcacgagggtccgtgggaccagtctgtgttgacgcagcccgccctcagtgtctcggccggaccccaggacaagaacgtccaccatctccgtagtctcgtagggaacgcaacggtcctaccgaaattagttaagggtaaataactttagtgtaacgttcggtaggtaccagcgtacgttaccggacggaacccgccccaagtacctccctatacttacgatacggaacctaataaacgacgaccgacgtccacgaagtacttccgtacgaaccgtcttctacgtcgtactaccgtacgtcgtacgacctacctcaccnccgtaccgacgccctacgtaccaccgggtacctaccggaacggtaccggtaggggaaccgtcggtaacccggttaatttaccggtacggtcggaaacggtagttacggtaccggtactacgtcggtaaccgttagggtacgttcgggtagttaccgggtacgggttcgggttaccgggacgggtaacggaccgtacgtacgcggtaacccgtcgtacgtccgacgtaccgacgtccggccgtccggtctacgccgttccgtccgtacccgtcctccttaggtccttccgtacgtcg

SEQ ID NO: 77854 - DNA, 804 bp, Homo sapiens
  misc_feature: GYAE6OF02F09GH.49.81.H04.1.454.CMB.1.raw
tcagagtcgagagacacgaccggtgctcgatttagtagtgtagattcgcggggagtcccaaccaggacacagcatggacatgagggtccctgctcagctcctggggctcctgctgctctggctctcgaggtgccagatgtgacagtccggatcgacccagtcctccatccctccctgtctgctattcgtaggtaaggagaacaagaactaccaacctatacctacgttacgaccgtaacggccgaaccgtacgaacggtaacctaagttaacggaaccttaaatttaaagttttaaaagttaggttaacttacgaacgaaccgaaaacggtaaaaacccggaaacggggaaaaccctaccccccgttaaacctccgtaacggtaactaccgtaaacggtattacgaccgtaattaaccgttaaagtttacgggtaaaacgtaccggggttaccctaagtaaccgtaaggttaccgtaggtaaggtaggtgtaacgtacggttagggtaaacttttacgttttaaccttaccgaaccttaacgtactaaccttaaccaaccgttcgactacggtaccgtaggaaggttacttagttacgaaactaaagtacttaacttaacgtacgtaacctaaaattagtaagtaacgttaaattaacgtaaccttaacctaacgttaccgtaacggtttacgggaccggtaacgggtacgaacggggtcgaagtaacgtaaacggtaaacgacgtttacggacgtaccgttaaggacctaacggtacgttcgttaccgttaccttcttacccg

SEQ ID NO: 77855 - DNA, 836 bp, Homo sapiens
  misc_feature: GYAE6OF02GG66M.49.81.H04.1.454.CMB.1.raw
  modified_base (151)..(151): a, c, t, g, unknown or other
  misc_feature (151)..(151): n is a, c, g, or t
tcagagtcgagagacacgaccggtgctcgatttagtagtgtagattcgcgggggggacaatcttcatcatgacctgctcccctctcctcctcacccttctcattcactgcacagggtcctgggcccagtctgtgttgacgcagccgccctnagtgtctgccggccccaggacagaaagtcaccatctcctgctctaggaagcagcctaccaacagttagggaagtaattagttagttacgtcgttcggtaccaggcctaacgttccccgaaggggaacccggacccccaacggaccttccctactactttacacgttacgaactaaaataaacgaaaggaccgaacgtaccccaaggtagtactttcccgtacggaacccgtaatttccgtacgttcgggtacctacccgtaacgttcgttacgggccctaacccgtcgaccggtaccccctaccccgttacggacccaccgtaccgaacccggtaccctacccgaacggtacgggttaccggggggaacgtacgggtaccgttaactttaacggtttaaccgtcggggtaccggtaaacgtacggttaccggggttaacttacccggaccggtccggttaggtacgggtttacggggtcgggttacggtacggggggttcgggttacggggtaccggggtaacgggaacccggaaaggtccgttacgggggtaacccttccgggtaacgtaccgacggacccgtaacgggtccggtacccgggtcccgttaccggccgttacccgtccgtttcccggttcccccgttcccgttcccttcccgttaccttccgttcccgttacccg

SEQ ID NO: 77856 - DNA, 704 bp, Homo sapiens
  misc_feature: GYAE6OF02GUEQ0.49.81.H04.1.454.CMB.1.raw
  modified_base (258)..(258): a, c, t, g, unknown or other
  misc_feature (258)..(258): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatcgacccagtctccatcctcctgtctgcatctgtaggagacagaatcaccatcacttgaccaggcgactcaggacattagactaacttaatttaaagttggtatacganacaacgaaaccgagggaaacacccctaactcctaggactactacgatcgacactacctaaagtttacgggtaaaacgtaccggggttaccctaagttaccgtaaagggttaccggtaggttaggggtaacggtttcgggaaacgttccgggttaggggttaacgttttaacttttttaccgttactaacctacgtacctaactacccgtaaccgtcggacctacgtacccgtaggtaagggtacttaggttacacgtaataacttaagttaccgttagaaccgtaaattaagttaactagtaaactaactttacccaactacctttaccgtaccggtttaacgggccgggtaaccgggtaccgtacgggttacggagtacgtaacccgtaaacggtaccgtggtacgtcgtacggacctacgtaccttcgttctacgttccctacg

SEQ ID NO: 77857 - DNA, 667 bp, Homo sapiens
  misc_feature: GYAE6OF02HXVUJ.49.81.H04.1.454.CMB.1.raw
  modified_base (177)..(177): a, c, t, g, unknown or other
  misc_feature (177)..(177): n is a, c, g, or t
  modified_base (191)..(191): a, c, t, g, unknown or other
  misc_feature (191)..(191): n is a, c, g, or t
  modified_base (491)..(491): a, c, t, g, unknown or other
  misc_feature (491)..(491): n is a, c, g, or t
tcagagtcgagagacacgaccggtgctcgatttagtagtgtagattcgcggggaggtcccaaccaggacacagcatggacatgagggtccctgctcagctcctggggctcctgctgctctggctctcaggtgccagatgtgacatccggatcgaccagtctccactcctccctgtcngcatcgtgtagganacagaatcacatctactgaccaggcactcgaggactattacgactaaacttaatttaaattggtatacagacaaacgaaacgaagggtaaacctacccccttaaaccgtcctaagtacttacaacgtaagtcgactaactaccgtaaagtttacggaaaacgtcgggtaccatacgaacggttgagtaggagtggtactcgtagggtactttacttttacgtaccactactacactaccgtaactgtaccatccgtagagtactagtcgaactaatatattactagacaaactatagtanaattaactacgtaacctacgtaaccgttaccggtttaacgggaccgggtaaaggaccccgttaagggggtacaacgggttaacctaaaccgtaaaccgggttacggttcgtaacggggtaaccacggttaaccccaacgttaccctttggttaacgttcccctttaggtaaacccc

SEQ ID NO: 77858 - DNA, 633 bp, Homo sapiens
  misc_feature: GYAE6OF02IG1R1.49.81.H04.1.454.CMB.1.raw
  modified_base (190)..(190): a, c, t, g, unknown or other
  misc_feature (190)..(190): n is a, c, g, or t
  modified_base (276)..(276): a, c, t, g, unknown or other
  misc_feature (276)..(276): n is a, c, g, or t
tcagagtcgagagacacgaccggtgctcgatttagtagtgtagattcgcggggcagtcccaaccaggacacagcatggacatgagggtccctgctcagctcctggggctcctgctgctctggctctcaggtgccagatgtgacatccggatcgacccagtcctccatccctcctgtctgcatctgtaganacagactcacatcattgacacggcactcgagacatagactaattaattaaacgttgtaatcagacaaggaaaaccgagggaaaccnccccttaaactcctagactctaacggatcgactactaccgtaagtttaggaacgttacgggtacccagtacgtaacggtcgtaaggtagtaaggtggtactggttaacgggttactttaacgtttaccttacgactactacgtaactacctaaccgtcgaccgtacgtcgtaacggattaactagtacgactaattaagttaaccttacgtactaacaaactatacgtataacgtaactacctaaccgtaccttcgtaccgttcggaaccggttaggacctagggtggaatacggtaacaaccggtacgtaggtacgacctacggaccttacggtaccttagttcccgttattaccg

SEQ ID NO: 77859 - DNA, 858 bp, Homo sapiens
  misc_feature: GYAE6OF02F7AJ4.49.81.H04.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
tcagagtcgagagacacgaccggtgctcgatttagtagtgtagattcgcgggggggggacaatcttcatcatgacctgctcccctctcctcctcacccgttctcattcactgcacagggtcctgggcccagtctgtgttgacgcagccgccctnagtgtctgccggcccaggacagaacgtcacatctcctgctcgtggaacncgagcgtaccaactaggttagggaanaatttagtcgtacgtcggtacggtaccagtccgtaacggttaccccgaaggggtaacccggcccccgtaagtacctccgttactacgttaccgtacgtacgaacctaaataaaccggtaacggtccggtaaccggttaccccgaagggtaccgttaacccgtttacccggaccgggttaacccgttaacgtttccgttaccgggttaccggtaccccgttaaccgtaacggttcccggtacgggtacccctacccgttaccggacccgacccccgtaacccggtaccgggaccctaccggtaaccggaacccggtactacccggtacggtaccgggtacggggtaccggacggttacccgttaagtttaacgtaccggtacgggtaaccggtaacgttacggtaaccgggttaacctaccgaacggttccgggttaacggcggggttttacgggtcggttacggggtacggggtttcggtaaccggggacgggtaacgtaccggacgttcgtaccggtacccgtcgtacggaccgccggtacgacggtccgtacccggtcccggtacggttcctacccggttctccccgtaccccgtaccttccctaccgtccgttaccgtacggtccc

SEQ ID NO: 77860 - DNA, 928 bp, Homo sapiens
  misc_feature: GYAE6OF02I3FBG.49.81.H04.1.454.CMB.1.raw
  modified_base (130)..(130): a, c, t, g, unknown or other
  misc_feature (130)..(130): n is a, c, g, or t
  modified_base (135)..(135): a, c, t, g, unknown or other
  misc_feature (135)..(135): n is a, c, g, or t
tcagagtcgagagacacgaccggtgctcgatttagtagtgtagattcgcgggaagtcccaaccaggacacagcatggacatgaggtccctgctcagctcctggggctcctgctgctctgctctcaggtcnccagntgtgacagtccggattcgaccctagtcctccactccctccctgtactgacctatccgtaggtaaggacacaagtaactccacctatcctacgttcgaccagggtccaacgtacgaaggtaacctagtttaaccgacttaaacgtttaagtttttaaaacgttcgggttaactccgaacggtaccgtaaaacgggaaaacccgtaacgggggtaaaccccttaccccccgttaaaccgtcccgttaagtaccttaccggtaaccgtagttaccgtacctacttaaccgttaacgtttaacgggaaaccggttaccgggttaccgaacttcgggtaaacggttcgaaggttagggtaaggtacggtacgttacggtttagggttaaccttttacgttttaacttcccgaaaccttacgttacctaacgttaccgaacccgtttcggaactaccggttaccgtaaggtaaccgtacgtttaactacccgtaaacgtaacctttaaacgtttaaccgtttaacgttcgttaaaaccctaaaacttaacgttaaacccgttaaggttaaaacctttaaccgtaccccgtttaaaccgttacccgttttaccgggtttaacccgggttaccgggacgggggtaacccggttaaaccgggtacgggttaaccgggtaacggttaccgtaaacccggtaaacgggttaccggtttacgggtaccccgttacgggttaaccctacccgtaccgttttaaccggttacggtttccctttaacccggtaaccccggtttcccgg

SEQ ID NO: 77861 - DNA, 820 bp, Homo sapiens
  misc_feature: GYAE6OF02IZDBV.49.81.H04.1.454.CMB.1.raw
  modified_base (639)..(639): a, c, t, g, unknown or other
  misc_feature (639)..(639): n is a, c, g, or t
  modified_base (725)..(725): a, c, t, g, unknown or other
  misc_feature (725)..(725): n is a, c, g, or t
tcagagtcgagagacacgaccggtgctcgatttagtagtgtagattcgcggggggggacaatcttcatcatgacctgctcccctctcctcctcacccttctcattcactgcacaggtcctggcccagtctgtgttgacgcagccgcctgagtgtctgcggcccaggactagaaacgtcaccatcctctgtctcgtaggaacgctagcctaccaaacgtagttaagggaaataaacgtttatagttaacgtccggttaacgggttaacccaacgtacctacggtttaccccgaacgggggaacccggtacccccaaggtacccttccctactaacttacgtactaacggaaacctaaaagtaaaaccgaacggtccggtaacggtaccccaaaggtaccgttaacctttcccgtaaggaaaccgttcgtacgtttaaccgtcggttcgtaccgttactaaacggtccgtacggtacctaacctacgaccggaccctaccccgggttacgaacccttacgaaccccggaaccgggtacctaacccgggaacggtacccggtagggggtaccgtaaccgggacccgtttaattaaccgtaacggtcggtaaaccgtaacggaacgttcgggtaacttaccgngttaccgtatggggtaccgtggtaccggtacgggttcggtaccggaggtacggaccctaaggtcgtaccgacgttcgaaccggtanacccggtacgacggtccgaccggtaccctcgtaccgacctttcccgttacccgtaccccgttcccgttacctttcccgtccgttaccgttcccgg

SEQ ID NO: 77862 - DNA, 736 bp, Homo sapiens
  misc_feature: GYAE6OF02I8W9I.49.81.H04.1.454.CMB.1.raw
  modified_base (118)..(118): a, c, t, g, unknown or other
  misc_feature (118)..(118): n is a, c, g, or t
  modified_base (194)..(194): a, c, t, g, unknown or other
  misc_feature (194)..(194): n is a, c, g, or t
  modified_base (289)..(289): a, c, t, g, unknown or other
  misc_feature (289)..(289): n is a, c, g, or t
  modified_base (324)..(324): a, c, t, g, unknown or other
  misc_feature (324)..(324): n is a, c, g, or t
  modified_base (403)..(403): a, c, t, g, unknown or other
  misc_feature (403)..(403): n is a, c, g, or t
  modified_base (568)..(568): a, c, t, g, unknown or other
  misc_feature (568)..(568): n is a, c, g, or t
tcagagtcgagagacacgaccggtgctcgatttagtagtgtagattcgcgggggggggacaatcttcatcatggacctgcctcccctctcctcctcacccttctcattcactgcacgngggtccctggccctagtcctgtgtgacgcgacgcccgcctgagtctctcgccggcccaggactaagaagtcaaccngtcctctgctacgtagactcagcctaccatggttacggaataattgtgtactcggtcgaccacggtcgtaacgtcccgaaggaaccgcccgtaanacccgtctacgtattacatacggaactaacgtaanacgcgtacgtaaccgagtactaccgttacctacggtaaccttacttcgtacgtcgttaacccgtaccggtaacgttccngggtaaccccttaccgacgtaccgtaccccgtaacgtcccggactaacggtaccggaccgtaccttaaaccggccgggtacggtacgggtaccgaacgtccgttaagtccgtacggtagaaccgtagagtaccgtacctacgccgttcgtagggtacttcgggtntaacgggtttcggaacgggtcggaccggtacggacgacgtccgtaacggccttaacggtcgtaccaccgggacctacggtaaccggtcccgtaccggttaaccctaggtccccgttaccgtaccggttcccgtacccgtcccttaccgcggttaccgtccttacccgg

SEQ ID NO: 77863 - DNA, 718 bp, Homo sapiens
  misc_feature: GYAE6OF02HAR7M.49.81.H04.1.454.CMB.1.raw
  modified_base (518)..(518): a, c, t, g, unknown or other
  misc_feature (518)..(518): n is a, c, g, or t
  modified_base (538)..(538): a, c, t, g, unknown or other
  misc_feature (538)..(538): n is a, c, g, or t
  modified_base (677)..(677): a, c, t, g, unknown or other
  misc_feature (677)..(677): n is a, c, g, or t
  modified_base (685)..(685): a, c, t, g, unknown or other
  misc_feature (685)..(685): n is a, c, g, or t
tcagagtcgagagacacgaccggtgctcgatttagtagtgtagattcgcggggagtcccaaccaggacacagcatggacatgagggtccctgctcagctccgtggggctctgctgctctggctctcgaggtgccagacgtgtacgacacgtccggatcgaacctcgtcctccacttccctccgtgtctcgactacttacgtaggtaacggaacgtaacgaacgtaacgtaccacctaactaccgtaacgttccgacggaacggaaccaccgtacgaacggtaaactacggtaactaaccttaaaacgtttaaagttaacgttaggtaactacgtaacgaacctaaacggaaacggtaaccggaaccctaccccgttaactaccgtacgtacttacgtacgactcgactaaccgtacgtaacgttacgaacggtacgtacctacgtacgtacgtagaggtagtacgtgtacgtagtacgtacgttactttacgtacctaagtctaccgtatacggtacncgtcgactacgtagtacgtntacgacgacttactatacgttacacgtaaactattacgtatagtaacttagtaacctactaccgttacggtacgtacgggtaaccgtagtaccgtaccgggaatacgaacgtaacggaactgggttactcgtaacccgngttaaccncttaaccggttaccgtcgtaccttaccctacgg

SEQ ID NO: 77864 - DNA, 761 bp, Homo sapiens
  misc_feature: GYAE6OF02H5YI7.49.81.H04.1.454.CMB.1.raw
tcagagtcgagagacacgaccggtgctcgatttagtagtgtagattcgcggggggacaatcttcatcatgacctgcctccctctcctcctcacccttctcattcactgcacagggtcctgggcccagtctgtgttgacgcacgccgccctcagtcgtctcggccggccccaggacagaacgtcaccatcctctgctcgtaggaagcacgcctaccaacgtagttagggaagtaatttagtagtaacgtcggtacggtaccacgtacgtacgttcccgaacggacccgaccccaaggtcctacctacgtacttcgaatacgaaactaacgtaacgaaacgtcgaccgtaccgaagtaacgtacgttcctacgaaccgtcttacctacgtcgaccgttaccaacgtcgtacggacctacccgtccgtacgcccctaaccgtcggaccctacgtacccgacccggtacctaccgaccggtacggtacggggtaaccgtacggtaaccgtacgtttaacgtaaccgtcggaaaccggtaacgtagggtaccggtacctgaacgttccggaggtaacggtgtcggtagggcggggtttacggacgggccgggtaacgggaccgtaacgtccggttaccgggaacctttccggtaggacccgacgggccccgtagggcccgtaccgggtcccccgttaggtacctccgtttaacccgtccgttaccccacccggttaccttcccggtaacctcccgtaacgttcccg

SEQ ID NO: 77865 - DNA, 846 bp, Homo sapiens
  misc_feature: GYAE6OF02IBZBG.49.81.H04.1.454.CMB.1.raw
  modified_base (132)..(132): a, c, t, g, unknown or other
  misc_feature (132)..(132): n is a, c, g, or t
tcagagtcgagagacacgaccggtgctcgatttagtagtgtagattcgcgggggagtcccaaccaggacacagcatggacatgagggtccctgctcagctcctggggctcctgctgctctggctctcaggtnccagatgtacgacacgtccggatcgacccagtcctaccactcctcccttgtctcgctacgtctacggaggtacgaacacgactcaacccaatccacgttcgaccaggaccgactcaggaactacttacggaacctaagttaaacttttaaagtcggttactaccaagtaccgaaaacggaaaaccggacggggtaaacccgtccccccttaaaccttaccgacgtacttaacgttaaccggaacgtaggtctaacccttaacgttaaagggtttttaacgggaaaaccggtttaccgggggtaccccttaaaaggtacggttaaacgggttaccgtaacgggttaaggggtaacgggtaggggttaaacttcggggtttacgggtttaaaacgttttaccttttttacgttaaccaacccttaactcttaaaactacccggtaaacgttaccgtacggtaacgtccggtagtaacggttacttaacgtaccgtaacgtaactaagttaacgtttacctagttaactaactaaattactaagttacttaaacttaacctaacctaccgttaacgttacccggtttaacgggccggggtaaacccgtacggttacggggaacgttacggtaacgtaaccggtaaaaccgtacggttcggtacgggtacctaccggtaactcggtaacttcccgtacggtttccctaagttcccccg

SEQ ID NO: 77866 - DNA, 879 bp, Homo sapiens
  misc_feature: GYAE6OF02IOZ1Z.49.81.H04.1.454.CMB.1.raw
tcagagtcgagagacacgaccggtgctcgatttagtagtgtagattcgcggggggggacaatcttcatcatgacctgctccccctctcctcctcacccttctcattcactgcacagggtcctgggcccagtctgtgttgacgcacgcccgtcccctcgagttgtctggcccgggaccccagggactagaaacgtcaccatcctccgtgctcgtaggaagccagtcctaccaaatagtttaggggaaaattaattagttagttaagtccggttacggtaaccaggtcgtaccggtttaaccccgaacgggaaccccggaccccctaagtacccgttacccttactaacgtttaccacgttaacgaaacgttaaaacaaacggtaacgccggtaacccttaccgaaagtaccgtacttacccgtacgaacgttccttacgtaccgtccggtaccttaccggtaacgtcgttaaccggactacccctacggtaccaacccgttaccgtccggtacctaacggtaccgtaacccgggacctaccggaacggtcgggtacggggtaccgagttcccgtatttaaccgtacggtacggacgtaacgtcggttacgggtacctacggaacgttccgtaaggtggttcgggttaccgacggttacgggggttcgggttacggggaaccggggaaacccgggttaccaacgggttccggttacccgtaacccgggttccgggttaacggtaacccggtaaccgacccgggtacggtccccggtaccggggacccccttaccgggttctaaccccggttttccgtacccccggttcccccttaaccggttacccctttcccggtaaccgtttcccgttaccggtcccgg

SEQ ID NO: 77867 - DNA, 911 bp, Homo sapiens
  misc_feature: GYAE6OF02FXAUR.49.81.H04.1.454.CMB.1.raw
  modified_base (184)..(184): a, c, t, g, unknown or other
  misc_feature (184)..(184): n is a, c, g, or t
  modified_base (210)..(210): a, c, t, g, unknown or other
  misc_feature (210)..(210): n is a, c, g, or t
tcagagtcgagagacacgaccggtgctcgatttagtagtgtagattcgcggggagtcccaaccaggacacagcatggacatgagggtccctgctcagctcctggggctcctgctgctctggctctcaggtgcagatgtgacatccgatcgacccagttcctccacttcccgtacccttgttccngtcctaacttcgtaggtacgggtaanaccaaggtaacttccgaaccctattccgtaaccgtttcggacccgaagggtaccgttacgtacccggtaagggtaaccttaaggtttaccgaaccttaaacgttttaaaaggttttaaaacgtttccggggttaaacttcggaaacgtaaacccgttaacgggaaaaaaccccggttaacggggaaaaccccggttaacccccccttaaaacccggttccctaagggtaacccttaccgtaacgggttaactacgggtaaccctaacgttttaacccgttaaaggtttaaacgggtaaaacggttaccggggttaccctaacggtaccgttacggttaagtacggttacgggtaaacgttaggtaacgttacgggtaacgggtttaacttttaaacgttttcgtaaaccgtccgtaacgtacttaacgtaccgtaaccgttagaccgtaacgtaccgtaggtaacgtaagttacgtctaaactacgaactttacgttactacgttaacgtaaccttaagttaactaacgttacttaacgtacttaccgtactaaccggtttacgttacggaccgggaacggtccgaacggggtacgtagtaaccgttaaccggaaccgtaacggttcggtaacgttccggggtaacccttacgaacccggtttacttaccggtacgggtttaccttacggtttaacccccg

SEQ ID NO: 77868 - DNA, 246 bp, Homo sapiens
  misc_feature: GYAE6OF02G5MQE.49.81.H04.1.454.CMB.1.raw
  modified_base (205)..(205): a, c, t, g, unknown or other
  misc_feature (205)..(205): n is a, c, g, or t
  modified_base (219)..(246): a, c, t, g, unknown or other
  misc_feature (219)..(246): n is a, c, g, or t
tcagagtcgagagacacgaccggtgctcgatttagtagtgtagattcgcggggggggacaatcttcatcatgacctgctcccctctcctcctcacccttctcattcactgcacagggtcctgggcccagtctgtgttgacgcagcccgcctcagtgtctggccgcccaggacagaaacgtccaccatctcctgcctcgtggaacncagcctaccgaacnnnnnnnnnnnnnnnnnnnnnnnnnnnn

SEQ ID NO: 77869 - DNA, 506 bp, Homo sapiens
  misc_feature: GYAE6OF01D5GZW.49.28.C06.1.454.CMB.1.raw
  modified_base (501)..(501): a, c, t, g, unknown or other
  misc_feature (501)..(501): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaacctggccaggctccagctctcatctatggtgcatccaccagggccactggtactcccagccaggttcagtggcaggtgggtctgggacagagttcactctcaccatcagcacgcctgcagtctgaagtattttgctagttttattactgtacagtctagtaattaattactggtcttcggttttggccgtaggggaccaagcgtaggagtatacaagcgaactgtagctgcaccntctcg

SEQ ID NO: 77870 - DNA, 556 bp, Homo sapiens
  misc_feature: GYAE6OF01BDVE4.49.28.C06.1.454.CMB.1.raw
  modified_base (300)..(300): a, c, t, g, unknown or other
  misc_feature (300)..(300): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctccaggctcctcatctatggtncatccaccgagggcccagtggtactcccagcctaggttcaggtcggcaggttgggtcgtgggacaggtacgttcactctcaccatcagcacgcctgcagtctagaagtattttgactaactttactattgtacagcacggacttaacgtacgtttacccgtacttacgtttacggaccgtacgggaccaacgtcgtagggaacgtactacgaaacggtacgtcggtggacgtcggaccacctactcgttcgttacc

SEQ ID NO: 77871 - DNA, 553 bp, Homo sapiens
  misc_feature: GYAE6OF01CHBG6.49.28.C06.1.454.CMB.1.raw
  modified_base (301)..(301): a, c, t, g, unknown or other
  misc_feature (301)..(301): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagacgccaccctctcctgcagggccagtcagagtgtagcagcaacttagcctggtaccagcagaaacctggccagactccaggctcctcatctatggtncatccacagggccacgtggtactcccagccaggttcaggtgcaggtgggtctgggacaggtacgttcgacttcctacaccgtatcacgcacgcctgctagtctagtagtatttgctagtttattactgtcagtactaagttaattaattacgtgttcgtttcgttttacggccgtacgggtacctaagtcgtaggagtagtacgaaggtccgtaaagttggtaggtccgttacgacctacctgtccgttacg

SEQ ID NO: 77872 - DNA, 582 bp, Homo sapiens
  misc_feature: GYAE6OF01DT8CF.49.28.C06.1.454.CMB.1.raw
  modified_base (302)..(302): a, c, t, g, unknown or other
  misc_feature (302)..(302): n is a, c, g, or t
tcagagtcgagagacacgaccggtgctcgatttagagctcacgtattgggtttggggggagggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaacctggccaggctcccaggctcctcatctatggtncatccacagggccactggtactcccagccaggttcaggtggcaggtgggtctgggacagacgttcactctcacctatcagcacgcctgcagtctagaagtatttgtctagtttattactgtacagtctagttaattaatttacgttcggttccgttttcggtttttacgggacccggtaacgggggtaaccctaaggtaccgttagggtaagtaacgttacgaaaggtccggtaaacgttgggtacgggtacgttacggacctaacccgtattccgttcg

SEQ ID NO: 77873 - DNA, 523 bp, Homo sapiens
  misc_feature: GYAE6OF01AJZ2W.49.28.C06.1.454.CMB.1.raw
  modified_base (203)..(203): a, c, t, g, unknown or other
  misc_feature (203)..(203): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatcccaccagggcccacgtggtactcccagccaggttcagtggcaggtgggtctgggacaggacgttcactctcaccatcagcacgcctgctagtctgtaagtatttgcttagtttattactgtcagctagtattaattacgtgtcttcgttttcggaccgtagggtaccagcgtaggagtacgtacgaagcgtacgtgtcggtctcgacacctgtcgtcg

SEQ ID NO: 77874 - DNA, 514 bp, Homo sapiens
  misc_feature: GYAE6OF01DLHDR.49.28.C06.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
  modified_base (508)..(508): a, c, t, g, unknown or other
  misc_feature (508)..(508): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaangccaccctctcctgcagggccagtcagagtgttagcagcaacttagcctggtaccagcagaaacctggccaggctcccaggctcctcatctatggtncatccacgagggccactggtactccccagccaggttcaggtggcaggtgggtctgggacaggngttcactctcaccntcagcagcctgctagtctagaagtatttgcttagtttattactgtcagctaagttataattacgtggtctttcggttttggccgtagggacctagcgtggagatagaagcgaacgtggtgtctcgcactntcgtcg

SEQ ID NO: 77875 - DNA, 528 bp, Homo sapiens
  misc_feature: GYAE6OF01B13G3.49.28.C06.1.454.CMB.1.raw
  modified_base (203)..(203): a, c, t, g, unknown or other
  misc_feature (203)..(203): n is a, c, g, or t
  modified_base (399)..(399): a, c, t, g, unknown or other
  misc_feature (399)..(399): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaangccaccctctcctgcagggccagtcagagtgttagcagcaacttagcctggtaccagcagaaacctggccaggctcccaggcctcctcatctatggtgcatcccaccagggccactggtactcccagccaggttcagtggcagtgggtctgggacagagttcactctcaccatcagcagcctgcagtctagaagtntttgctagtttattactgtcagtcagttataattactggtctttcggttttcggaccgtaggggtaccaagtcgtaggagtatacgaacggtcgtaacgttggtcggtcgtacgaccactagtcgttcg

SEQ ID NO: 77876 - DNA, 756 bp, Homo sapiens
  misc_feature: GYAE6OF01A7QPA.49.28.C06.1.454.CMB.1.raw
  modified_base (204)..(204): a, c, t, g, unknown or other
  misc_feature (204)..(204): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaangccaccctctcctgcagggccagtcagagtgttagcagcaacttagcctggtaccagcagaacctggccaggctccaggctcctcatctatggtgcatccaccgagggccactgggtactccccgagtacccgtacggttacgtaaggtcgggacgtaacgggttcgggggttaccgtcggggaacgaacgggtaacggtttcccgaaccgtttcctacccgtaacccgtaatacccggtaacggacccgtaacgggtcccgtacggtacctaacgggttaccgttaacggtaaacggtttaacgtttttacggtaccgtttaacggttttttaacgtttaaccgtttacggtacttaacggtaccgttaagttaacgtttaacgtttaaccgttcgggtttaccgtttacgggttttttaccggtaccggtaacggggtacccgtaaacgggtcggttacgggtaacggttacgtaaccgtaaacgggtaccgttaacggttggttaccgggtaccttacgggtaaccctaccgtacgttcggttaccggg

SEQ ID NO: 77877 - DNA, 546 bp, Homo sapiens
  misc_feature: GYAE6OF01B29HF.49.28.C06.1.454.CMB.1.raw
  modified_base (204)..(204): a, c, t, g, unknown or other
  misc_feature (204)..(204): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaangccacctctcctgcagggccagtcagagtgttagcagcaacttagcctggtaccagcagaaacctggccaggctccaggctcctcatctatggtgcatccaccagggcccactggtactccccaggcctaggttcagtcggactaggtgggtcctggggacaggtacgtttcacgttcctcaaccatcagcagcctgcagtctagtaagtatttgctagtttattacgtgtcagtctagttaattaattacgtggtactttcggttttaggccgtagggacctaggtcgtaggagtacgtagaaggtcgaacgtggtaggtcctgaccactagttcgttacg

SEQ ID NO: 77878 - DNA, 538 bp, Homo sapiens
  misc_feature: GYAE6OF01CM6IA.49.28.C06.1.454.CMB.1.raw
  modified_base (302)..(302): a, c, t, g, unknown or other
  misc_feature (302)..(302): n is a, c, g, or t
tcagagtcgagagacacgaccggtgctcgatttagagctcacgtattggggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagagccaccctctcctgcagggccagtcagagtgttagcagcaacttagcctggtaccagcagaaacctggccaggctcccaggctctcatctatggtncatccacagggccactggtactccagccaggttcagtggcagtgggtctgggacagtagtcactctcacatcagcagcctgcagtcgtagaagtattttgctaagttttattatgttacagactaagtaacttaattacgtggtctttggttttcggaccgtaggggaccaagtcgtaggaagtactacgaaggcgtaaacgtgggtacggtccgtagaccacctagttcgttacg

SEQ ID NO: 77879 - DNA, 572 bp, Homo sapiens
  misc_feature: GYAE6OF01BZBED.49.28.C06.1.454.CMB.1.raw
  modified_base (204)..(204): a, c, t, g, unknown or other
  misc_feature (204)..(204): n is a, c, g, or t
  modified_base (567)..(567): a, c, t, g, unknown or other
  misc_feature (567)..(567): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaanagcccaccctctcctgcagggccagtcagagtgttagcagcaacttagcctggtaccagcaagaaacctggccaggcctcccaggcctcctcatctatggtgcatcccacgacgggccacgtgtactccagcctaggttcaggtggctaggtcgggtctggggactaggtacgttccacttctaccacctatcacgcacgccgtgctagtctaggaagttagttttcgacttagtttactttacgtagtactagtctaagttaattaacgtttacgtgggttacctttcggttttacggaccgtaacggggtactaggtccgtaggagacgtagacgtcgaacgttggcgtctacgactactntgtcg

SEQ ID NO: 77880 - DNA, 552 bp, Homo sapiens
  misc_feature: GYAE6OF01A6VS1.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagagccaccatctcctgcagggccagtcagagtgttagcagcaacttagcctggtaccagcagaaacctggccaggctccaggctcctcatctatggtgcatccaccagggccactggtactcccagccaggttcagtggcaggtgggtctgggacagagttcactctcacatcagcagcctgcagtctagaagtattttgacttagtttattacttgtacagtctaagtacttaagttacctggtactttcggtttggacccgtaggggtaacccaaggtccgtagggacgtatacgaaaggaccggtaacttgggttacgggccttaggaccgtaccgtcgttacccg

SEQ ID NO: 77881 - DNA, 553 bp, Homo sapiens
  misc_feature: GYAE6OF01DFNYQ.49.28.C06.1.454.CMB.1.raw
  modified_base (235)..(235): a, c, t, g, unknown or other
  misc_feature (235)..(235): n is a, c, g, or t
  modified_base (546)..(546): a, c, t, g, unknown or other
  misc_feature (546)..(546): n is a, c, g, or t
tcagagtcgagagacacgaccggtgctcgatttagagctcacgtattggggtttggggggaggaactgctcagttaggacccagacggaaccatggaagccccagcgcagcttctcttcctcctgctactctggctcccagagaccactggagaaatagcgatgacgcagtctccagcccaccctgtctgtgtctccgaggggaaagagcccaccctctccggggggggggggtncgacgggccagtcagagtgttagcagcaacttagcctggtaccagcagaaacctggccaggctcccaggctcctcatctatggtgcatccaccagggccactggtactcccagccaggttcagtggcaggtgggtctgggacagagttcactctcaccatcagcagcctgcagtctagaagtattttgctagtttattacgtgttcagtctaagtataagtcggtccgggtctaccggactacgtttcgggacggtagggaccgaagggtgggaacgatacgaaacgtaactggaggtctaggaccaccgnttcgtcg

SEQ ID NO: 77882 - DNA, 521 bp, Homo sapiens
  misc_feature: GYAE6OF01EA38A.49.28.C06.1.454.CMB.1.raw
  modified_base (515)..(515): a, c, t, g, unknown or other
  misc_feature (515)..(515): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccacgtggtatccccgagccaggttcagtggcaggtgggtctgggacaggagttcactctcaccatcagcagcctgcagtctagaagtatttgctagtttattactgtcagtctaagtataattactggtcttcgttttggaccgtagggtaccaagtcgtaggagagtacgaagtcgaacgtggtcggtctcgacaccgtntcgtcg

SEQ ID NO: 77883 - DNA, 549 bp, Homo sapiens
  misc_feature: GYAE6OF01E04YV.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagagccaccctctcctgcagggccagtcagagtgtagcagcaacttagcctggtaccagcaagaaacctggccaggctccaggctcctcatctatggtgcatcccaccgagggccacgtggtactcccagccaggttcaggtggcaggtgggtctgggacagtagttcactctcaccatcagcagcctgcagtctagaagtatttgctagtttattactgtcagtctagtaattaattacgtggtctttcggttttacggaccgtaaggggtaccaacggtcgtagggtaagtacgtacgaaacggtcgtaacgttggtacggtctacggaccaccgtagtcgttcg

SEQ ID NO: 77884 - DNA, 544 bp, Homo sapiens
  misc_feature: GYAE6OF01EOPMK.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccacgtggtactcccagccaggtcagtggcaggtgggtctgggacagtagttcactctcaccatcagcagcctgcagtctagaagtattttgctagttttattactgttcagactaagttaattaattacgtggtctttcggttttggaccgtaggggaacctaaggtcgtagggtaagtacgtagaacggtacgtaacgttggtacggtctacgacacctagtcgttacg

SEQ ID NO: 77885 - DNA, 587 bp, Homo sapiens
  misc_feature: GYAE6OF01DV8Q1.49.28.C06.1.454.CMB.1.raw
  modified_base (204)..(204): a, c, t, g, unknown or other
  misc_feature (204)..(204): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagcccaccctgtctgtgtctccgaggggaangccaccctctcctgcagggccagtcagagtgttagcagcaacttagcctggtaccagcaagaaacctggccaggcctcccgaggcctcctcatctagtggtgcactccaccgagggccctacgtcggtactccccgagccgaggttcaggtcggcaggtcgggtcgtaggggactaggtacgttcactcctacaccatcgacgcacgcctgactagtcgtagaagtattttgacttagtttattacgtgtacagtctaagtaattaattacgtggttctttacggttttacgggacccgtaaggggacctaaggtcgtaggaacggtacgtaacgaacggtcggtaacgttggtacggtctacggacctacctagttcgttcg

SEQ ID NO: 77886 - DNA, 527 bp, Homo sapiens
  misc_feature: GYAE6OF01D9IVY.49.28.C06.1.454.CMB.1.raw
  modified_base (485)..(485): a, c, t, g, unknown or other
  misc_feature (485)..(485): n is a, c, g, or t
  modified_base (519)..(519): a, c, t, g, unknown or other
  misc_feature (519)..(519): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaagagccaccctctcctgcagggccagtcagagtgttagcagcaacttagcctggtaccagcagaaacctggccaggctccaggctcctcatctatggtgcatccaccagggccactggtactccccgagccaggttcagtggcaggtgggtctggggacaggagttcactcgtcaccatcagcagcctgcagtctagaagtatttgctagtttattactgtcagtcagtaatattacgttggtctttcggttttcggaccgtagggacctaagcgtaggaagtntacgaaggtcgaacgtggtggctcgaccaccgtntcgttacg

SEQ ID NO: 77887 - DNA, 568 bp, Homo sapiens
  misc_feature: GYAE6OF01EN8BB.49.28.C06.1.454.CMB.1.raw
  modified_base (204)..(204): a, c, t, g, unknown or other
  misc_feature (204)..(204): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaangccaccctctcctgcgagggccagtcagagtgtagcagcaacttagcctggtaccagaccaagaaacctggccaggcctcccgaggcctcctcatctagtggtgcactcccaccgagggccacgtggtactcccgagcctaggttcaggtcggcgtaggtgggtcgtgggacaggtcgttcactctacaccatcagcacgctcgctagtcgtagtaacgtattttacgctttaagtttattacgtgtacagtactagttaactagttacgtggttccgtttcgttttcggaccgtagggtacctaggtcgtaggacgtacgtagacggtcgtacgtggtacggtctcgaccacctagtcgttcg

SEQ ID NO: 77888 - DNA, 577 bp, Homo sapiens
  misc_feature: GYAE6OF01CHGVF.49.28.C06.1.454.CMB.1.raw
  modified_base (204)..(204): a, c, t, g, unknown or other
  misc_feature (204)..(204): n is a, c, g, or t
  modified_base (427)..(427): a, c, t, g, unknown or other
  misc_feature (427)..(427): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaangcccaccctctcctgcagggccagtcagagtgttagcagcaacttagcctggtaccagcagaaacctggccaggcctcccgaggcctccctcatctagtcggtgccatcccaccgagggcccacgtggtactccccgagcctaggttcaggtggcgaggttgggtctggggactaggtcgttccactcgtcacctatcagcacgcctgctagtctagtaagtntttgtacttagtttacttactgtcagtactagttaattaacttacgttggttccgtttcggttttacgggaccgtaacggggtacctaaggtcgtagggagtacgtacgaaggcgtaacgtggtacggtctacgaccacctgttcgtacg

SEQ ID NO: 77889 - DNA, 550 bp, Homo sapiens
  misc_feature: GYAE6OF01A2NYK.49.28.C06.1.454.CMB.1.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaanacgccaccctctcctgcagggccagtcagagtgttagcagctaacttagcctggtaccagcagaacctggccaggctccaggcctccncatctagtggtgcatcccaccgagggccacgtggtactcccgagcctaggttcaggtggcaggtcggggtctggggacaggtacgttcacctctacaccatcagcagcctgcagtctagtaagtatttgacttagtttatactgtcagtctaagtattaagttcgtggttcttcggtttacggaccgtacgggtacctagtcgtagggagtacgtacgaggtacgtacgtgtcggtcgtacgaccacctgtccttacg

SEQ ID NO: 77890 - DNA, 562 bp, Homo sapiens
  misc_feature: GYAE6OF01A1EDX.49.28.C06.1.454.CMB.1.raw
  modified_base (204)..(204): a, c, t, g, unknown or other
  misc_feature (204)..(204): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (398)..(398): a, c, t, g, unknown or other
  misc_feature (398)..(398): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagngccaccctctcctgcagggccagtcagagtgttagcagcaacttagcctggtaccagcagaacctggccaggctccaggctcctcatctatgtgcatccacagggccactggtactcccagccaggttcaggtggcaggtgggtcngggacnggagttcactctcaccatcagcagcctgcagtctagtaagtntttgcttagtttacttactgtacagtactagttattaagtttacgttacggttctttcggttttcggaccggtacgggggtaacctacggtacgtagggaacgtaagttccgaaaggtaccgtaacgtggttacggtacgtacggacctaacctgttccgttcg

SEQ ID NO: 77891 - DNA, 739 bp, Homo sapiens
  misc_feature: GYAE6OF01CIJ5G.49.28.C06.1.454.CMB.1.raw
  modified_base (206)..(206): a, c, t, g, unknown or other
  misc_feature (206)..(206): n is a, c, g, or t
  modified_base (308)..(308): a, c, t, g, unknown or other
  misc_feature (308)..(308): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagcccacctgtctgtgtcctaccgaggggaaancgcccaccctctccgtgcgagggccagtcagtagtgttagcagctaacgttagcctaggtaccagacaagaaacctggccaggccctaccgaggtcctcctnatcgtagtcggtcgaccactcccgaacgacgggccctacgtcggtaacctcccgaagcccgtaagggttcagggtcgacctagggttcgggtcgtacggggaactagggtacgtttacccaccgttacctaccaacctataccgacgccctaacggtcccttggaccgttaacggtcgttaaggttaagtttacgttttaacggtacctttaaagtttttacgttaaccgttggtaacctaagtaacgttaaagtttaacttaaacggtttccggtacggtttaccgttttttaccgggtttaacgggacccggttaaacgggggtaccctaaacgggtcgttaacgggaacgttaacgtaccggtaaaacgggtcccgtaaggttacgggtaccggtacgtaccgtaccaaccgttcgttccgtttaccg

SEQ ID NO: 77892 - DNA, 766 bp, Homo sapiens
  misc_feature: GYAE6OF01DCPKU.49.28.C06.1.454.CMB.1.raw
  modified_base (303)..(303): a, c, t, g, unknown or other
  misc_feature (303)..(303): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagcgcccaccctctcctgcgagggccagtcagagtgttagcagcaacttgcctggtaccagcaagaacctggccaggctcccaggctcctcatctatggtncactcccaccgacgggccctacgtggtactccccgagtccgaggttcaggtcggctagggttcgggtcgtggggacctaggtacgtttacaccttcctaccgacctacgtaccacgccgaacgtcccgtacggacccgtacggttacgttacggtaaacggtttactttttacggtaaccgtttaacgttttttaaccgttttaacgtttcgggttaaccgtacgggtaaccgtttaaaggtttaacgttttaaaacggtttttaccgttacggggtttaccggttttttacccggggttttttttacggggtaccccggggttaacggggggtaaaccccgtaaacgggttccgggttaagggtaacggtaacgttaaccggtaaacgggtaccggtaaaccggtttgggtaccgggttaccgttaaccggtaccgtaaccctaacgtttccgtttacccgg

SEQ ID NO: 77893 - DNA, 543 bp, Homo sapiens
  misc_feature: GYAE6OF01BIHNC.49.28.C06.1.454.CMB.1.raw
  modified_base (204)..(204): a, c, t, g, unknown or other
  misc_feature (204)..(204): n is a, c, g, or t
  modified_base (367)..(367): a, c, t, g, unknown or other
  misc_feature (367)..(367): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaangccaccctctcctgcagggccagtcagagtgttagcagcaacttagcctggtaccagcaagaacctggccaggctcccaggctcctcatctagtggtgcatccaccgagggccacgtggtactccccgagccaggttcagtggctaggtgggtcgtggggacngtagttcactctcacatcagcacgcctgcagtctagtaagtatttgctagtttatactgtcagtctaagttattaattacgttggtctttcggttttcggaccgtagggtacctaggtcgtaggacgtacgtacgaaggcgtaacgtggtacggtctacgacctactgtcgttacg

SEQ ID NO: 77894 - DNA, 518 bp, Homo sapiens
  misc_feature: GYAE6OF01AV4QT.49.28.C06.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (511)..(511): a, c, t, g, unknown or other
  misc_feature (511)..(511): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaanagccaccctctcctgcagggccagtcagagtgttagcagcaacttagcctggtaccagcagaaacctggccaggctcccaggcctcctcatctatggtncatccaccagggcccactggtactcccagcctaggttcagtggcaggtgggtctgggacagagttcactctcaccatcagcacgcctgcagtctagaagtattttgctagtttattactgtctagctagtaatattactggtcttcgttttcggccgtagggtaccaagtcgtaggacgtatacgaagcgaacgtgtcggctgacactntcgtacg

SEQ ID NO: 77895 - DNA, 576 bp, Homo sapiens
  misc_feature: GYAE6OF01A9W69.49.28.C06.1.454.CMB.1.raw
  modified_base (203)..(203): a, c, t, g, unknown or other
  misc_feature (203)..(203): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaangccaccctctcctgcagggccagtcagagtgttagtagctttcttagcctggtaccaacagaaacctggccaggctcccaggctcctcatctatgatgcatccaacgagggccacgtggcactccccagcctaggttccaggtggctaggtgggtctggtgacagtacttcactctcaccatcagcacgcctagacgtcctagaagtacttcgtgtacctagttttaactttacgtacgttacgacgctacggtcggttacgacctaacgtcggtaccctccgtacgtaccgtttccgggacgggaacgggtaaccgagggtggaacgtacgtaccgaaacgtacgttcggacggtcgtacgccgaacgtacg

SEQ ID NO: 77896 - DNA, 612 bp, Homo sapiens
  misc_feature: GYAE6OF01DC1OE.49.28.C06.1.454.CMB.1.raw
  modified_base (321)..(321): a, c, t, g, unknown or other
  misc_feature (321)..(321): n is a, c, g, or t
tcagagtcgagagacacgaccggtgctcgatttagagctcacgtattggggtttgggggaggaactgctcagttaggacccagacggaaccatggaagccccagcgcagcttctcttcctcctgctactctggctcccagagaccactggagaaatagcgatgacgcagtctccagcccaccctgtctgtgtctccgaggggaaagcgcccaccctctcctgcgacgggccagtcagagtgttagcagacaacttagcctacggtaccagcgaagaaacccgtggaccaggcctcccgaggtcctcctcatctagtcggtncactccaccgacgggcctacgtcggtactccccgagccgtaggttcaggtcggcgtaggttcgggtcgtagggacaggtacgttcacttctaccaccatacacgcacgtcctcgctagtcgtagtaagtttatttcgtactttagtttacttacgttgtacgtagtactaagttattaacgtttacgtcggttacgtttcggttttacggaccggtaacgggtacctaagtccgtaggagtaacgtacgaacggtacgtacgttggtcgtctacgacctactgttcgttcg

SEQ ID NO: 77897 - DNA, 735 bp, Homo sapiens
  misc_feature: GYAE6OF01C8ROZ.49.28.C06.1.454.CMB.1.raw
  modified_base (328)..(328): a, c, t, g, unknown or other
  misc_feature (328)..(328): n is a, c, g, or t
tcagagtcgagagacacgaccggtgctcgatttagagctcacgtattgggtttgggggaggaactgctcagttaggacccagacggaaccagtggaagccccagcgcagcttctcttcctcctgctactctggctcccagagaccactggagaaatagcgatgacgcagtctccagccaccctgtctgtgtctccgagggaaagcgcccaccctctcctgcacgggccagtcagagtgttagcagctaacgttacgccgttggtacccagtaccaagtaaacccgtggacccacgggtcctccccgaggcctcctcatctagtggtcnctactacccacgacgggaccacgtggtacctaccccgagcccgtaggttcgaggttcggacgtacgggttcggggtacgtagggggaactacggtacggtttaccaacccgtttccgtaccaacccgtaacgttaccgaaccgtaccgaacggtcccctaggtacccgtaacggttaccgttaaaggtaaccggtttagtttacgtacgtttaagttttaacgttacgtttacgtaccgtaagtacgttaaagtttaacttaaaccggttttacgtacgggttaccgttttccgggttttacgaccggtaacgggtaccctaaggtccgtaaggacgtaacgtacgtaaacgggtccgtaaacgttggtaccggtacttacggacctaaccgttagttcgttaccgg

SEQ ID NO: 77898 - DNA, 724 bp, Homo sapiens
  misc_feature: GYAE6OF01BIBUN.49.28.C06.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
tcagagtcgagagacacgaccggtgctcgatttagagctcacgtattgggtttgggggagaactgctcagttaggacccagacggaaccatggaagccccagcgcagcttctcttcctcctgctactctggctcccagagaccatggagaaatgcgatgacgcagtctccagccacctgtctgtgtctccgaggggaaancgcccacctntcctgcagggccagtcagtgtgtagcagcaacttgcctgtaccagcaagaacctggccaggcctccgaggtcctccgtcacgtcctagtcggttcacctactcccgaccgtacgggtccctacgttagggtacctccccgagtcccgtaggtttcacggttcggctaagggttcggtcgtacgggacctaggttacgttacctaaccgttccgtaccgaaccgttacgtaccgtaacggtacctacgtcccgttacggaccgttacggtaccgtaaggtaacgttacgttttacggacgtttaacgttttacgttacgtacgttacgtacgttacgtaacgttaacgttaaccgttaccgttcggttaccgtttaccggttttacgggacccgttaacgggtaaccgtacggttccggtacggtacggtacgtacccggaacggttccggttaaccgttcgggttaccggtaccgtaccgtaacccgttaccgttaacgttcccggttaaccgg

SEQ ID NO: 77899 - DNA, 540 bp, Homo sapiens
  misc_feature: GYAE6OF01BJJNE.49.28.C06.1.454.CMB.1.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (409)..(409): a, c, t, g, unknown or other
  misc_feature (409)..(409): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagngccaccctctcctgcagggccagtcagagtgttagcagcaacttagcctggtaccagcaagaaacctggccaggctcccaggctcctnatctatggtncatcccacagggcccagtggtactcccgagcccaggttcaggtggcaggtgggtctgggacaggtacgttcactctacaccatcagcacgcctgcagtctagaagtntttgctagtttacttactgtacagtctagtattattacgtgtcgtttcgttttcggaccgtaacggggtacaacgtcgtagggacgtagtacgaaggtcgaactggtacggtctagaccactgttcgttcg

SEQ ID NO: 77900 - DNA, 875 bp, Homo sapiens
  misc_feature: GYAE6OF01B8YXA.49.28.C06.1.454.CMB.1.raw
  modified_base (202)..(202): a, c, t, g, unknown or other
  misc_feature (202)..(202): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccacctgtctgtgtctccgaggggaanacgccacccgtctcctgcacgggcagtcagagtgttagcagctaacgttagccgtcggtaaccaggacaacggtaaacctgggaccacggcctaccgacgggtccccttccgtactaacgttccgttaagttcggtacgtacctaactttaaccgttaccccgacggtacccgttaacggggtttacccgtaagggtcgggtaccggttaacgggttccgggggggtttaccgtaacggggggaaaccttaacggggtaacggttttacccctaaccggtttaccctttaaacccggaaccctaaacgtttcccgaacggttacccgaacggttccccgtacggtacccgttaacgggtttccgttaaggttaaacggtttcgttttacgtacgtttaaacgttttacgtttaacgtcgttacgtaacgtaccgttaagtttaacttaaacgtttacggtacggtttccgtttttaggggtttttaccgaaccggggttaacggggtaacccctaaagggttacgtaacgggtaactaaccggttaaccgaaagggtaccggtaaacggttcgggttaccgggtaccttacggtacccgttaaccgtttaacgtttccgtttaaccgggttaccttttaccctaaccccggtttcccgtttcccccgtaaccg

SEQ ID NO: 77901 - DNA, 567 bp, Homo sapiens
  misc_feature: GYAE6OF01AYNX5.49.28.C06.1.454.CMB.1.raw
  modified_base (204)..(204): a, c, t, g, unknown or other
  misc_feature (204)..(204): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaangcccaccctctcctgcagggccagtcagagtgttagcagcaacttgcctggtaccagcagaaacctggaccaggcctccaggcctcctcatctatggtgcactcccaccgagggccacgtggtactcccgagcctaggttcaggtcggcaggtgggtctgggacagtacgttcactcacaccatcagcacgcctgctagtctagtaagtatttgcttagtttattacgtgtctagtactagttaattaacgttacgttcggttcgtttcggttttcggaccgtacggggtacctaacggtcgtaggagtacgtacgaacggtccggtaacgttggtcgggtctacgacctacctgtcgttacg

SEQ ID NO: 77902 - DNA, 741 bp, Homo sapiens
  misc_feature: GYAE6OF01BF02R.49.28.C06.1.454.CMB.1.raw
  modified_base (204)..(204): a, c, t, g, unknown or other
  misc_feature (204)..(204): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaanagccaccctctcctgcagggccagtcagagtgttagcagctaacttagcctggtaccagcaagaaacctggaccaggcctcccgaggcctcctcatctagtggtgcactccgaccgacgggtcccacgtggtactccccgagtcccgtaggttcaggtggacgtaggtcggggtacgtagggactaggtacgttccacttcctaccaacctacgttccgacggtacctaaccgcccttacggaccgtaacgttaccgtaaggtaacgttatttttacggactttaaggtttttaacttacgttacgttacgtacgtacttaagtttaaacgtttaacgtttaccggttacgggtttacctttttacggggtttttccgggaaccccgggttaacgggggtaaaccctaacggggttaccgttaacggggtaacgttaaaccgttacccgggaaagggttacccgggtaaacgtttaccggggtacgggttacccggtttacggaccccgttaaccgttccgttccggtttaccccgg

SEQ ID NO: 77903 - DNA, 699 bp, Homo sapiens
  misc_feature: GYAE6OF01BB1RS.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatgcgatgacgcagtctccagccaccctgtctgtgtctccgaaggggaaacgcgccaccctctcctgcgacgggcagtcagagtgttagcagactaattacgcctaggtacagacaacgaaaccgtggacccacggcctacccgacggtcctccgtctactcgtagtggcactactcccgacgacggcctacgtcggtacaccgagtcctaagggttcagggttcggacgtaagggtttcgggtacgtcggggtaaaccgtaggttaccggttacctaacccgttaccgttacctaaccgtaacttacggaacggtaccacggtacccgtacgacgttagggtacctaaggtaaacggtttagttttacgtacgttttaagtttaactttacgtcggtacgtaacgtacgttaagttaacgtttaacgttaccgttacggtttaccgtttacgggttttacgggacgtaacgggggtacctaaaggtccgtaggaagtacgttagaacggtacgtagtggtacgctacgacctactcgttcgttac

SEQ ID NO: 77904 - DNA, 840 bp, Homo sapiens
  misc_feature: GYAE6OF01ENGS8.49.28.C06.1.454.CMB.1.raw
  modified_base (204)..(204): a, c, t, g, unknown or other
  misc_feature (204)..(204): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaanagccaccctctcctgcagggccagtcagagtgttagcagcaacttagcctggtaccagcaagaaacctggccaggcctcccgaggcctcctcatcctagtggtcgcactcccaccgacgggcccacgttacgggtactccccgacggtacccgtaggtttaccgaggttcgggacgtagggttcggggtcgtacggggaactagggtaacggtttcctaacccgttaccgttaccctaacccgtactttaccgaaccggtacccgtaaccgtcccccgttaggtacccgtaacggttaccgttaagggtaaaacggttttacgttttttaccggtaccgttttaaggttttttaaacgtttaaccgttttacggttaccgtaaacggttacccgttaaaggttttaaacgttttaaacgttttaaccggtttaccggggtttaccgttttttacccggggtttttttacggggaccccggggttaaacggggggtaaaccccgttaaacgggttaccggttaacggggtaacggtaacggtttaccgggaaacgggttacccggtaaaccggtttgggtacccgggttacgttaccgggtaacccgtaacccggttaccgtttcgtttaccccggg

SEQ ID NO: 77905 - DNA, 804 bp, Homo sapiens
  misc_feature: GYAE6OF01D7QL7.49.28.C06.1.454.CMB.1.raw
  modified_base (213)..(213): a, c, t, g, unknown or other
  misc_feature (213)..(213): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggcctcccagagaccacgtggaagaaatagcgatgacgcagtcctccagccctacctgtctgtcgtcctcggaaggggaaacncgccctaccctctccgtggccgagggccagtcgaaggtagttagttagcgaagcctaaacttcgccgttacggtaccacgaccgaaacggaaacctcggacccgtaacggcccgttaccccgaggtccccttcctacctaacgtttcgtaaggttcgggtacgaccgtaacctaccccgaacccgggacgggtaccccgtaacgtttacgggtacccttaccccggaacggtacccggttacgggttaccgacggggttcgggaccggttacgggttcgggggttacggtaacgggggtaactacgggttacggttcctaaccggttccctaccgaactacgtacgacggtaccgacgtccgtagtacgtacgtacgtaacggttaagttcgttttacggtactttaagttttacgttacgttagtaccgtagttacgtaagtttaacgtacgggttccgggtcccgggtaccgtaccgtaaccggttacggtccgggaacgggaccgggtaacgtaagggtacgggtaaacgtacgtaaacggaaacggtccgtagggtacgtacgtaccgactaccgtgttcgttaccg

SEQ ID NO: 77906 - DNA, 639 bp, Homo sapiens
  misc_feature: GYAE6OF01C086X.49.28.C06.1.454.CMB.1.raw
  modified_base (189)..(189): a, c, t, g, unknown or other
  misc_feature (189)..(189): n is a, c, g, or t
  modified_base (204)..(204): a, c, t, g, unknown or other
  misc_feature (204)..(204): n is a, c, g, or t
  modified_base (322)..(322): a, c, t, g, unknown or other
  misc_feature (322)..(322): n is a, c, g, or t
  modified_base (502)..(502): a, c, t, g, unknown or other
  misc_feature (502)..(502): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtntctccgaggggaaanacgcccaccctctccgtgcacgggccagtcgaagagttgtaagcagacaacttagcctaggtaccaagcaagaaacctggccaaggctacccgaggcctcctctatactagtcggtancaactccgaaccgacgggtccacgtaggtactaccccgacgtaccgaagggtttccaaggttcggacgtaggttcgggtcgtacgggtacgtaagtacgtttcgactttacaccacctagtcgaacgacgacgtactgacctagtacgtaagaagttattgtacttagtttacttacgtntacgtagcgaagtcgtaagtccgtaagtcggtaccttccgtacgttaccggttacggggacccggaagggtaaccgtaagggtacgaagtacgaaaccgtaaacgtacgtagtcggactaggaccaacgtcgttacg

SEQ ID NO: 77907 - DNA, 639 bp, Homo sapiens
  misc_feature: GYAE6OF01EM073.49.28.C06.1.454.CMB.1.raw
  modified_base (630)..(630): a, c, t, g, unknown or other
  misc_feature (630)..(630): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagcccaccctgtctgtgtctccgaggggaaagcgcccaccctctcctgcgagggccagtcagagtgtagcagctaacttagcctggtaccagacaacgaaacctggaccaggcctacccgaggcctcctcatcgtagtcggtgacctacgtcccgaaccgacgggcccacgtcggtacctaccccgagcccgtaggttccgaaggtcgggaccgtagggtcgggtcgtagggacaggtacgttccactctaccgacctagtccgagccgacgtcccgtgcgtaacgtctaggtaaagttcttttacggactttagttttacttaccgtgtacagtataagttaattaacgttacggtggtttccgtttcggtttacgggacccggtaagggtacctaagggtcgtaagggacgtacgtaacgaacggtaccgtaagtggacggtactcgactacctnttccgttcg

SEQ ID NO: 77908 - DNA, 562 bp, Homo sapiens
  misc_feature: GYAE6OF01AUC4X.49.28.C06.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaanagccaccctctcctgcagggccagtcagagtgttagcagcaacttagcctggtaccagcagaaacctggccaggctcccaggctcctcatctatggtncatcccacgagggccacgtggtactcccagccaggttcagtgcaggttgggctgggacaggagttcactctacaccatcagcagcctgctacgtcgtagaagttattttgacgttagttttaattacgtgttacagtactaaggtaattaagttacgttaggtctttcggttttacggaccgtaaggggactaaggtcgtggaaggtataccgaaggtaccgtaaacgtggtacggtactcgtaccacctgttccttacg

SEQ ID NO: 77909 - DNA, 649 bp, Homo sapiens
  misc_feature: GYAE6OF01CZPM8.49.28.C06.1.454.CMB.1.raw
  modified_base (204)..(204): a, c, t, g, unknown or other
  misc_feature (204)..(204): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaanagccaccctctcctgcagggccagtcagagtgttagcagcaacttagcctaggtaccagcagaaacctggccaggcctcccaggctcctcatctatggtgcactccaccgagggcccacgtggtactcccgagcctaggttcagtcggctaggtcgggtcgtagggactaggtacgtttacaccgttcctacaaccctataccgagtccacggtcctggcctagttctaaggtaacgttattttcgacttaggtttacttacgttgtacaggtactaagttaacttaagtttcgtcggttccgttttacggtttttaccgggaccggtaacgggggtaaccctaacgggtaccgttaggggaacgtaacgttaccgaaacggtaaccggtaaccgttgggttaccgggtcgttacggcccttaaacccgtgttccgtttaccggg

SEQ ID NO: 77910 - DNA, 776 bp, Homo sapiens
  misc_feature: GYAE6OF01DKP5L.49.28.C06.1.454.CMB.1.raw
  modified_base (199)..(199): a, c, t, g, unknown or other
  misc_feature (199)..(199): n is a, c, g, or t
  modified_base (364)..(364): a, c, t, g, unknown or other
  misc_feature (364)..(364): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctccagagaccactggagaaatagcgatgacgcagtctccagccacctgtctgtgtctcgagggaancgccacctctccgtgcgagggccagtcagagttgtacgcagctaacgttacgccttacggaaccagacgaacgaaaccgtggaccaggcctacccgaggtcctcctcaacgtctagttcggtacactaccgtccgaaccggacgggtacctaacgtcggttaccncccgtaacggtaccgtaacgggtttcagggttcggacgttacggggttcgggtaccggtagggaactagggtaccgttcctacgttcctaccaaccgtatacgacgtacgaaccgtccgtcgaccgtacggttacgtaagtaacggtttattttacgggacttttaacggttttaactttacgtacggtttacgaacggttaacgtttaacggttaaatttaacgtttaccggtttacggtttacccgtttttaacgggtttttacccggggaaccgggtaaccggggtaacccgttaagggtaccggttaaggggtaacgttaacgttaaccggaacgggttaccggtaaacggtttcggtaaccgggttaccgtaaccggtacccggttaaccttccgttcgtttacccg

SEQ ID NO: 77911 - DNA, 770 bp, Homo sapiens
  misc_feature: GYAE6OF01D2EO0.49.28.C06.1.454.CMB.1.raw
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
tcagagtcgagagacacgaccggtgctcgatttagagctcacgtattggggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgagggaaagagccaccctctcctgccagggccagtcagagtgttagcagcaacttgcctggaccagcaagaacctgccagctccagctccnatctagtggtcnctactccaccgagggtccccacgttcggtactccccgagtccgtaggttcaaggtcggctaggttcggggtctcggggaacaggtagtttccaacgttccgtacctaacccgagtccgtaacggaccgtaacggtcccgtacggtacccgtaacggttaccgttaagggtaaacgtttacgtttttacggtaccgttaaaggtttttaacgtttaacgtttacggttaccgtaacggtacgtttaaaggtttaaactttaacgtttaaccggttcgggtttacccgttttacggggttttttaccggggaacccgggttaaacgggggtaacccgttaaacggggtaccggttaacggggtaaacggtaacggttaaccgggtaaacgggtaacccgggttaaaccgttaggggttaccgggttaccggttaccggtaacccgtaacccgttaagtttcccggtttaccggg

SEQ ID NO: 77912 - DNA, 747 bp, Homo sapiens
  misc_feature: GYAE6OF01CSLIQ.49.28.C06.1.454.CMB.1.raw
  modified_base (727)..(727): a, c, t, g, unknown or other
  misc_feature (727)..(727): n is a, c, g, or t
  modified_base (736)..(736): a, c, t, g, unknown or other
  misc_feature (736)..(736): n is a, c, g, or t
tcagagtcgagagacacgaccggtgctcgatttagagctcacgtattggggtttgggggaggaactgctcagttaggacccagacggaaccatggaagccccagcgcagcttctcttcctcctgctactctggcctcccagagaccactggaagaaatagcgatgacgcagtctccagcccaccctgtctgtgtctaccgaaggggaagacgcccaccctctcctgaccgacgggcctagtcaggagttcgttaagcagtaccaacgtttacgccgttacgggtaacccaagaccaaacggaaaacccgttggacccgaggtcccgtaccccgtaggtcccttcccctcgaattcgtagttcgggtcaccactacccgaaccgacgggccctaacggttcggtacctccccgacggtccctaagggttcaacggtggtaccgtagggttcggggtacgtaacggggactaaggtaccgtttaccaacgttccctccgaaccgtagtaccaggccgtacgccgttacggacttacggttaccgtaaggttaagtttacttttaagggcttttaaagttttacgttacgttaaggtcctaaggtacttaagttttaactaacgttttaccgttagggttaccgtttttcggtttacgggacccgggtaagggtacccaggtaccggtaggactacggaacacggtacgtaacgtgttacggccgttacncgtaaaccngttccgttacg

SEQ ID NO: 77913 - DNA, 709 bp, Homo sapiens
  misc_feature: GYAE6OF01BW81J.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaagagccaccctctcctgcagggccagtcagtagtgttagcagctaaacgttacgcctaggtaacccaggaccaacggtaaaccctgggacccaggtccctaccccgacggcctccctcagttcctagttcggtcgacctactcccgaccgacgggcccacgtcggtactccccgaggtcccgtaaggtttcaaggttcggacgtagggttgggtcgtacggggacgtaggtacgtttaccaacgttcctaccgtaaccacgtaccgacggacgacgtcccgtacgaccgtacgttacgtaggtaaacgtttagttttcggactttaacggtttttaacttacgtttgtaactagtaccgtaagttaattaacgtttacgttcggttaccgttttcggtttacgggaccggtaggggtaaccctaggtccgtagggtacgtaacgttaccgaaggttacccggtaagttcgggtacggtaccgtacggacctacttgttcctttaccgg

SEQ ID NO: 77914 - DNA, 655 bp, Homo sapiens
  misc_feature: GYAE6OF01BV6NU.49.28.C06.1.454.CMB.1.raw
  modified_base (205)..(205): a, c, t, g, unknown or other
  misc_feature (205)..(205): n is a, c, g, or t
  modified_base (311)..(311): a, c, t, g, unknown or other
  misc_feature (311)..(311): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagcccaccctgtctgtgtctccgaggggaaangccaccctctcctgcagggccagtcagagtgttagcagcaacgttagcctggtaccagcaagaaaccgtggccaggcctcccgaggcctcctcatcctatgggtcnctactccaaccgaggggccctagtcgggtactccccgaagcccgtaaggtttcaggttcgggcaggttgggtccgtggggaacctaggtacgtttccaacgttcctaccgacctactcgacgacacgtccctcgctacgtcttaggtaacgttagttttcgtacttaagttttactttacgttagttcctaagtacttaagttaatttaacgtttaacgttcggttacttttacggtttttacgggaccgtaacggggtacctaaaggtcgtaggtacgtaacgttacgaaggtacccgtaaacgttcggtcgggtaccttacgaccaccgtacgttcgttacg

SEQ ID NO: 77915 - DNA, 768 bp, Homo sapiens
  misc_feature: GYAE6OF01AVBT7.49.28.C06.1.454.CMB.1.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (327)..(327): a, c, t, g, unknown or other
  misc_feature (327)..(327): n is a, c, g, or t
tcagagtcgagagacacgaccggtgctcgatttagagctcacgtattggggtttgggggaggaactgctcagttaggacccagacggaaccatggaagccccagcgcagcttctcttcctcctgctactctggcctcccagagaccactggaagaaatagcgatgacgcagtctccagcccaccctgtctgtgtctccgaggggaaancgccaccctctccngcagggccagtcagagtgttagcagcaagttagcctaggtaccagcaacgaaaccgtggaccgacgggccctacccgaggtcctcctcacttcgtagttcgggtncctactacccgaaccggacggggaccccacgttcgggtaacctcccccgaggcccgttaggttaccgaaggttcgggaccgtagggttcggggtccggttacggggaactacggttaacgtttccgtaaaccttccgttaacccaaccgtacgttaccgaacggtaccgaacggcccgttacgcccgttaacgtccttaagggtaaccgtttagtttttacggtactttaaggtttttaactttaaccgtttggttacctaacggttaacgttaacgttaaacgtttaaacgtttacgttacgggttaccgtttttaccgggtttttacgggtacccggtacgggggtaacctaacgggtcggtaagggtaacgtagttacggaaacggtaccgtaacgttcgggtacggtaccgtacgtacctaccgtgtttacgttcgg

SEQ ID NO: 77916 - DNA, 593 bp, Homo sapiens
  misc_feature: GYAE6OF01CDCON.49.28.C06.1.454.CMB.1.raw
  modified_base (205)..(205): a, c, t, g, unknown or other
  misc_feature (205)..(205): n is a, c, g, or t
  modified_base (309)..(309): a, c, t, g, unknown or other
  misc_feature (309)..(309): n is a, c, g, or t
  modified_base (336)..(336): a, c, t, g, unknown or other
  misc_feature (336)..(336): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaaancgccacctctcctgcagggccagtcagagtgtagcagcaacttagcctggtaccagacagaaacctggccaggtcctacccgaggcctcctcaatctagtggtnccaatccgacagggccctactggtacncccgaagccaggttcaggtgcaggttcgggctggggacaggtacgttccactcctacgaacctatacacgcacgtcctagtcagtctagtaagttattttagacttagttttattacgtgtacagacgtagtaattaacgttagtcggttcgtttcgttttacggaccgttaacggggaaccgtaaggccgtaagggtacgaactacgtaacggccgtaacgtcggtaggtcctaggacctaccgtattccgttacg

SEQ ID NO: 77917 - DNA, 625 bp, Homo sapiens
  misc_feature: GYAE6OF01C68XB.49.28.C06.1.454.CMB.1.raw
  modified_base (173)..(173): a, c, t, g, unknown or other
  misc_feature (173)..(173): n is a, c, g, or t
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
  modified_base (383)..(383): a, c, t, g, unknown or other
  misc_feature (383)..(383): n is a, c, g, or t
  modified_base (402)..(402): a, c, t, g, unknown or other
  misc_feature (402)..(402): n is a, c, g, or t
  modified_base (576)..(576): a, c, t, g, unknown or other
  misc_feature (576)..(576): n is a, c, g, or t
tcagagtcgagagacacgaccggtgctcgatttagagctcacgtattggggtttgggggaggaactgctcagttaggacccagacggaaccatggaagccccagcgcagcttctcttcctcctgctactctggctcccagagacccatggagaaatagcgtatgacgcagtcnccagccacctgtctgtgtctccgaggggaaancgcccacctctccgtgcagggccagtcagngtgtagcagcaacttagcctaggtacagacaagaacctggaccaggtcctaccgaggcctcctcaatctagtggtcactacgtccacggacgggcctacgtggtactcccacgcgtaacggttcaggtggaccgaggttcggggtacnggggacaaggtcgtttacncgttctaccaccattcgaacgtccgaacggtcccttagacctaacggttactaaggtaacggttttatttacgtacgtttaagtttagtttaaccgttggtacaacgtacttaagttaacttaagtttacgtcggttcgttttcggtttacggcggtaacggtaaccaggtcgngtacaacggtagaacggtcacgtgtcgtacaggacctactgttcttacg

SEQ ID NO: 77918 - DNA, 567 bp, Homo sapiens
  misc_feature: GYAE6OF01CR3CJ.49.28.C06.1.454.CMB.1.raw
  modified_base (205)..(205): a, c, t, g, unknown or other
  misc_feature (205)..(205): n is a, c, g, or t
  modified_base (366)..(366): a, c, t, g, unknown or other
  misc_feature (366)..(366): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagngccaccctctcctgcagggccagtcagagtgttagcagcaacttagcctggtaccagcagaaacctggccaggctcccgaggctcctcatctatggtgcactccaccgagggcccacgtggtactccgagccaggttcagtggcagtgggtctgggacagngttacactctcaccatcagcacgcctcgctagtctagtaagtatttacgctagttttatacttcgtctagtactaagttaattaacgtttacgtggttcgtttcggtttttcggaccgtaaggggtacctaaggtcgtagggagtacgtacgaaggtaccgtaacgttggtacggtacgtacgacctaccgtattcgttcg

SEQ ID NO: 77919 - DNA, 697 bp, Homo sapiens
  misc_feature: GYAE6OF01EW6LZ.49.28.C06.1.454.CMB.1.raw
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
  modified_base (688)..(688): a, c, t, g, unknown or other
  misc_feature (688)..(688): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccacctgtctgtgtctccgaggggaaagcgccaccctctcctgcgagggccagtcagagtgtagcagcaacttagcctggaccagacaagaacctggaccaggcctaccgaggcctcctcatctacgtggtcncacgtcccacgacgggtcctacgtcggtacncccgagccgtaggttcaggttcggacgtaggttcgggtacgtacggggaactaggtacgttcctaacctccgtaccaaccgtagtaccgaacggtaccaacggtccgttagtaccgtacggtaccgttaagggtaaacgtttacgtttttacggacgtttaaacgtttttaacttaccgttacgttaaccgacgttacgttaaagtttaaacttaacgtttaacggttcggtttacccgtttttacgggttttacgggacccgggtaacgggtaaaccgtaacggttccggtaaggtaacgtacttaccggaagtacgtaacgtgggtcgtaccgtacgaactaccgtnttgttaccg

SEQ ID NO: 77920 - DNA, 610 bp, Homo sapiens
  misc_feature: GYAE6OF01BGDXJ.49.28.C06.1.454.CMB.1.raw
  modified_base (309)..(309): a, c, t, g, unknown or other
  misc_feature (309)..(309): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaagacgcccaccctctcctgcagggccagtcagagtgttagcagcaactacgcctaggtaccagcaacgaaacctggaccaggcctccaggcctcctcatctatggtcncactcccgaccgacgggccctacgtggtactcccgagccgtaggttcagtggcgtaggtgggtcgtgggacagtacgttcactctcaccatcacgtcactccgtagactagtacctaagtaagttacgttttagtactttaagttttaacttacgttcgttacagtactaagttaacttaacgttacgttcgttcgttttcggtttacggaccggtacggggtaacctaacggtcggtacggaagtacgttacgaaacggtacgtacgtggtcggactacggacctacgtacgttcgttcg

SEQ ID NO: 77921 - DNA, 663 bp, Homo sapiens
  misc_feature: GYAE6OF01BJY7E.49.28.C06.1.454.CMB.1.raw
  modified_base (310)..(310): a, c, t, g, unknown or other
  misc_feature (310)..(310): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagcgccaccctctcctgcagggccagtcagagtgttacgcagctaacttagcctggtacagcaagaaccgtggccagctacccaggtcctcctacactctagtggtcncactacccacgtacggcctacgtacggtacctcccgagtaccgtacggttacgaggtggccgtaggtcggggtcgtagggactacggtacgtactactaccgtaccaacctacgtccgacggacctacggtccgttaggactacggttactaaggtaaccggtttatttacggtagttaacgttttactacgtgtaccgagtactaagttattaacgttcgtcggttcttttacggttacggacccggtaagggtacccgtagggtacgtaacgggaagtacggtacgtaaacgggtccgtaagttcggtaccgggtaacttccggtaacctaccctacggttccgtttaccg

SEQ ID NO: 77922 - DNA, 796 bp, Homo sapiens
  misc_feature: GYAE6OF01C58JX.49.28.C06.1.454.CMB.1.raw
  modified_base (210)..(210): a, c, t, g, unknown or other
  misc_feature (210)..(210): n is a, c, g, or t
  modified_base (283)..(283): a, c, t, g, unknown or other
  misc_feature (283)..(283): n is a, c, g, or t
tcagagtcgagagacacgaccggtgctcgatttagagctcacgtattggggtttgggggaggaactgctcagttaggacccagacggaaccatggaagccccagcgcagcttctcttcctcctgctactctggcctccagagaccactaggaagaaatagcgatgacgcagtctccagccaccctgtctgtgtcctaccgaaggggaaanacgcccacctctctgcgacggccagtcagagtgtagcagacaacttacgctacgtaccagacaacgtaaccgnggacctaggccctaccgaggtcctcctacgacttaccgtagtggtaccacttaccgacccgaaccggacgggacctaacggtcgggttaaccctaccccgacggtaccgtacggggttaccgtaaggttacggggaccgaggggttacggggtaccgttagggggaactacggttaacgtacccttaacctccgtaacccgaacttacgtaccaacgaccgtaccgtccgtacgtacgttacggtactaaggtaacggttaacttttacggtacgtttaaacgtttacgttaacgtcggtaagtacgtaacgttaaatttaagtttaacttacccgggttacggttttccgggttttaaccggttttccgggaaccggggtaaccgggttaaaccgtaacgggtaccgtaaagggtaacgttaacccgggtaagaaaaccggttccccggtaaagtttcggggtacgtaacggttacccgaacccttaaccggtttcttcccgggtttaaccg

SEQ ID NO: 77923 - DNA, 689 bp, Homo sapiens
  misc_feature: GYAE6OF01BMJIV.49.28.C06.1.454.CMB.1.raw
  modified_base (201)..(201): a, c, t, g, unknown or other
  misc_feature (201)..(201): n is a, c, g, or t
  modified_base (460)..(460): a, c, t, g, unknown or other
  misc_feature (460)..(460): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccacctgtctgtgtctcgaggggaanacgccacctctcctgcgagggccagtcagagttgtagcagactaacgttacgcctggtaccagacaacgaaacctggaccacggccctccgacggtcctcctcagttccgtaggttcggtcgacctacgtacccgaaccggtacgggaccctacggttcgggtaaccctccccgaaggtcccgtaaggtttccgagggttcggacgtagggttcggggtacgtaggggacacggtacgttccaaccgtctaccactacncgagccacgtccgtgacgtacgttcgtaagtaatttcgtttacgatttaagttttactacgtcgtacgtaacgtacgttaattaacttacgtttaccggttcggttccgtttttacgggttccggtaccgggaacggggtaacctagggtcggtacgggtaagtaccgttaaggaacggttacggaacgttgggtacgtccttacggaaccttaccttcgttggtaccc

SEQ ID NO: 77924 - DNA, 698 bp, Homo sapiens
  misc_feature: GYAE6OF01DZIF6.49.28.C06.1.454.CMB.1.raw
  modified_base (333)..(333): a, c, t, g, unknown or other
  misc_feature (333)..(333): n is a, c, g, or t
tcagagtcgagagacacgaccggtgctcgatttagagctcacgtattggggtttgggggaggaactgctcagttaggacccagacggaaccatggaagccccagcgcagcttctcttcctcctgctactctggctcccagagaccactggagaaatagcgatgacgcagtctccagcccaccctgtctgtcgtctccgaggggaaacgacgcccaccctctcctgcgacgggccagtacagtagtgttagcagacaacttcgccgtggtaccagcaacgaacctggacccacgggcctaccccgaggtcctaccctccagtcctagtgggtcnctactcccgaccgacgggtcccacgtcggtactccccggagcccgtacgggttacaggtcggccgtagggttggggccgtaggggactaggtacggtttccaccgttcctacctaacgtctacgacgaccgacggtcctggactaggtactaggtaagtttagttttacgtacgtttaagttttacttacgtacgttacgtaaggtacttaagttaacttacgtttacgttcggtttaccgtttcgggttttacgggtccgggtaaacgggtaaccgtacgggtcgttaagggaagttacgtaaccggaaggtaccggtaaacggttcggacgggtaccttcggaaccctacttgttccttaccg

SEQ ID NO: 77925 - DNA, 650 bp, Homo sapiens
  misc_feature: GYAE6OF01AJZO0.49.28.C06.1.454.CMB.1.raw
  modified_base (97)..(97): a, c, t, g, unknown or other
  misc_feature (97)..(97): n is a, c, g, or t
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (259)..(259): a, c, t, g, unknown or other
  misc_feature (259)..(259): n is a, c, g, or t
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
  modified_base (337)..(337): a, c, t, g, unknown or other
  misc_feature (337)..(337): n is a, c, g, or t
  modified_base (364)..(364): a, c, t, g, unknown or other
  misc_feature (364)..(364): n is a, c, g, or t
tcagagtcgagagacacgaccggtgctcgatttagagctcacgtattgggtttgggggaggaactgctcagttaggacccagacggaaccatggaanccccagcgcagcttctcttcctcctgctactctggctcccagagaccactggagaaatagcgatgacgcagtctccagccaccctgtctgtgtctaccgaggggaaangcccacctntcctgcagggccagtcagagtgtagcagcaacttgcctggtaccngcaagaacctggcctaggctccgaggcctcncatcatgtgcatccacgnggccagtggactccgagccctaggttacnggtcggctagggtcggtcgtgggaacnggtacgttccgaactcgtacaccgtatcgacgcacgctacgctacgtcgtagtacgtacgtttacgtaccgttagttttacgtacgtacgttacaacggtacgtaacgttaacgttaacgttaccgtagggttcctttacgggttttaccgggacccggttaaccggggtaaccgtacggttacggtaaccgggaacggttaaccgtaggtaaaccggtaccggttaacccggttagggttaccgggtaccgtacggtacccctaacgttaccgttaccgttccgg

SEQ ID NO: 77926 - DNA, 654 bp, Homo sapiens
  misc_feature: GYAE6OF01AY9OW.49.28.C06.1.454.CMB.1.raw
  modified_base (205)..(205): a, c, t, g, unknown or other
  misc_feature (205)..(205): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggcctcccagagaccactggagaaatagcgatgacgcagtctcagccacctgtctgtgtctccgaaggggaaacncgccaccctctccgtgcgagggccagtcagagtgttagcagctaacgttcgcctggtaccagcaacgaaacctggccaggtcctccgaggcctcctcatcgtagtggtcgctactccgaccgacggcctacgtaggtacctacccgagtcccgtaggtacacggtcggacgtacgggtcgggtcgtacgggacgtacggtacgttccaccgtctaccgtacctactacgacgtcgacgtccgtcgacgtagtcgtaagtaagttacgtttacgactttagttttactacgtgttacgtagtacgttaagttaacttacgttacgttggttaccgttttcgggttttacgaccggtaacggtaccgtaaggtcgtaacggtacggtactaccggaacgtacgtaacgttggtaccggtacgtaccgtacctaccttggttcgtttaaccg

SEQ ID NO: 77927 - DNA, 546 bp, Homo sapiens
  misc_feature: GYAE6OF01BWQFQ.49.28.C06.1.454.CMB.1.raw
  modified_base (407)..(407): a, c, t, g, unknown or other
  misc_feature (407)..(407): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagagccaccctctcctgcagggccagtcagagtgttagcagcaacttagcctggtaccagcagaaacctggccaggctccaggctcctcatctatggtgcatccaccgagggccacgtggtactcccagccaggttcagtggcaggtgggtcgtgggacaggtacgttcactctccaccatcacgcagcctgctagtcagtagtntttgcttagtttattacgtgtcagtctagttaataattacgtggtcgtttcggttttcgggaccgtaggggtacccaggtcgtaggtacgtacgtacgaaggtcgaacgtggtcggtctcgaccacctagttccgttcg

SEQ ID NO: 77928 - DNA, 555 bp, Homo sapiens
  misc_feature: GYAE6OF01CMFWB.49.28.C06.1.454.CMB.1.raw
  modified_base (205)..(205): a, c, t, g, unknown or other
  misc_feature (205)..(205): n is a, c, g, or t
  modified_base (352)..(352): a, c, t, g, unknown or other
  misc_feature (352)..(352): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagcccaccctgtctgtgtctccgaggggaaancgccaccctctcctgcgagggccagtcagagtgttagcagcaacttgcctggtaccagcaagaacctggaccaggctcccgaggcctctcatctagtggtcgcactccacgcggcacgtgtacctccagccgtaggttcaggtcggntaggtgggtactgggactaggacgttcactctacacatcagcacgcgtgcagtctagagtntttgtnttagttattctgtctagtatagtaataagttacgtgttcgttacgtttcggacgtaacgggactacggcgtaggtacgagtacgtaacggaccgtaagtcggtacgtaccgtacgaccaccgttagttccgttacg

SEQ ID NO: 77929 - DNA, 739 bp, Homo sapiens
  misc_feature: GYAE6OF01B8KYG.49.28.C06.1.454.CMB.1.raw
  modified_base (209)..(209): a, c, t, g, unknown or other
  misc_feature (209)..(209): n is a, c, g, or t
  modified_base (224)..(224): a, c, t, g, unknown or other
  misc_feature (224)..(224): n is a, c, g, or t
  modified_base (481)..(481): a, c, t, g, unknown or other
  misc_feature (481)..(481): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggcctcccagagaccactggaagaaatagcgatgacgcagtcctccagcccaccgtgtctgtgtcctccgaaggggaancgcccaccctctccngcgacgggccagtcagtagttcgtagcagacctaacgttcgccgtacggtaccagtacaacgaaacccgtcggaccgacggccctacccgacggtccttaccactactcgtaacggttcggtcgactaccgtacccgaacccgggacggtccctacggttacgtaccgtacccgtacgtacccgtaacggttcgagggtcgacggtagggtcggtcggtacgggtataggtacttaccgtacttccaaccaccgtanccacgacctacgcctgaccgtagtaccgttaaggtacgtttagtttcaagtttacgttttaaagtccttacggttaacctacggttaataacgttttaaacgttacgtttaccggttacggttttaccggttttaccgggtttacggggaacccggttaacgggtaccgtaacggttcggaaaggttacgtaaacgtcggaacggtaaccggtacgttacggtcggtaacctcgtaacctaccgttgttacggtttcc

SEQ ID NO: 77930 - DNA, 771 bp, Homo sapiens
  misc_feature: GYAE6OF01EG2TU.49.28.C06.1.454.CMB.1.raw
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
tcagagtcgagagacacgaccggtgctcgatttagagctcacgtattgggtttggggggaggaactgctcagttaggacccagacggaaccatggaagccccagcgcagcttctcttcctcctgctactctggctcccagagaccactggagaaatgcgatgacgcagtctccagccaccctgtctgtgtctccgaaggggaaancgcccaccctctcctgcgagggccagtcagagtgttancagctaacgttgcctggtaccagacaagaaacctggaccaggtcctccgaggtcctacgtactcgtacttccgtagtcgggtacgacgtaaccttacccgaaccgacgggaccctacggttacgggtaacctccccgaacggtacccgttaagggttccgaacgggttcggggaccgtaagggttcgggtaccgttaggggaacctaggtaccgtttacaacccgttccgtaccgaacccctaagtccgaacggtaccaacgtcccgttaggacctaggttaccggttaagttaacggtttacgtttttcggaacttttaacgggttttactttaaccgttacggttaccgtaacgtaacgttaaacgggtttaatttaaaccgggtttaccggtttacgggtttaccgtttttcggttttacggggaccggtaacgggggtaactaacgggtacgtaggtaacggtataaccggtaacggtacggtaaacgtgggttaccggaacgtaccgacctaccgtcttaccg

SEQ ID NO: 77931 - DNA, 730 bp, Homo sapiens
  misc_feature: GYAE6OF01BLRXU.49.28.C06.1.454.CMB.1.raw
  modified_base (205)..(205): a, c, t, g, unknown or other
  misc_feature (205)..(205): n is a, c, g, or t
  modified_base (447)..(447): a, c, t, g, unknown or other
  misc_feature (447)..(447): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtcgtctccgaggggaaanacgccaccctctcctgcacgggccagtcagtagtgttagcagactaacttagccgtaggtaaccaacacgaaacccgtgggacccaacgggccacccgaggccttcctcacttcctagtgatcgacactacccgaacgacgggaccacgtaggacctaccgtacccgacgcccgtaggtttcgaggttcggacgtacgggtgggtaccgtgtacgtacgtacgtaccttcaccgttctaccnccgtactaccgacggacctacggacccttaacggaccgtacccgttaaggtaaacgttaccgttttaccggtcgttaaccgttttaaagtttttcgtttaaccgttccgttacgtaacgaccggtaacggtacggtacgtaacccgttacgtccggttaccccgttaccgttacgttacccggttaccggggacggggtaaccgggtaaaccggtagggtaccggacgttaaaccgtaaccggaaccggttaacgtcgggtacgtacgtccgacgtaaccccg

SEQ ID NO: 77932 - DNA, 677 bp, Homo sapiens
  misc_feature: GYAE6OF01CHWYR.49.28.C06.1.454.CMB.1.raw
  modified_base (173)..(173): a, c, t, g, unknown or other
  misc_feature (173)..(173): n is a, c, g, or t
  modified_base (208)..(208): a, c, t, g, unknown or other
  misc_feature (208)..(208): n is a, c, g, or t
tcagagtcgagagacacgaccggtgctcgatttagagctcacgtattggggttgggggagaactgctcagttaggacccagacggaaccatggaacgccccagcgcagcttctcttcctctgctactctggcctccagagacccatggaagtaaatcgcgaatgacgcagtcncagccctcctgctgccgtctaccgaaggggaaacncctccacctctcgagacgacggtctagtagagtaggtcgtacacgagacctaacgtcgacgtagacagataacgacgtcgacctacgccacgcgtcctactaccgtactcgtagcgtacgtacctaccgtaccgaaccgccgtacctacggtcggtacctccgagtacgtacgtcggtacgcggtacggtagggttcgaacggtacggtaactacgtacctactactccaccgtaatacgtacgacgtacgccgtctacgacgtaacgttacgtaacgtagtttacgtttagttaacgttagtttacgtaagttcgtaacgacgtaacttaacgttaacttacgttcgttacgttcggtttacggtaccgggtacggtaaccggtaactacggtacggttagtaaacgtacgtaacggaacgtaccggtagttacgtacggacctacgtacccgttaacttgtaccgtc

SEQ ID NO: 77933 - DNA, 593 bp, Homo sapiens
  misc_feature: GYAE6OF01CEDQR.49.28.C06.1.454.CMB.1.raw
  modified_base (205)..(205): a, c, t, g, unknown or other
  misc_feature (205)..(205): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagngccaccctctcctgcagggccagtcagagtgttagcagcaacttagcctggtaccagcagaaacctggccaggctcccaggcctcctcatctatggtgcactccaccagggccactggtactcccagccaggttcagtggcagtgggtctgggacagagttcactctcaccatcagtcagcctgctgtcgtagtaagtattttagactagtttattacgtgtcagtctaaggtaattaacgttacgttggttacgtttacggttttttacgggaccggttaacggggtaccgtaaacggcgttagggaacggtaacgttacgaaacggttcccggtaaacgtgggttacgggtacgtacggtaaccctaccgtaacttccgtttacgg

SEQ ID NO: 77934 - DNA, 791 bp, Homo sapiens
  misc_feature: GYAE6OF01CCUC8.49.28.C06.1.454.CMB.1.raw
  modified_base (202)..(202): a, c, t, g, unknown or other
  misc_feature (202)..(202): n is a, c, g, or t
  modified_base (341)..(341): a, c, t, g, unknown or other
  misc_feature (341)..(341): n is a, c, g, or t
tcagagtcgagagacacgaccggtgctcgatttagagctcacgtattgggtttgggggaggaactgctcagttaggacccagacggaaccatggaagccccagcgcagcttctcttctcctgctactctggctccagagaccactggagaaatagcgatgacgcagtctccagccacctgtctgtgtctccgaaggggaaancgccaccctctccgtgcgacgggccaggtcgagtagtgttacgcagtactaacgttacgctacggtaccacgtcaacggaaaccgtggacccgaggtcctaccccgaggtcccttcgtaccgtacttctaagtcggtanaccaccgtttacccgaaccggaccgggtaccctacggttacgggttaccctaccccggtaacggtacccggttaacgggttccgaagggtttaccgggcgtacggggtttcggggtaccggtaggggaaccttagggtaacgttcccaaccgttctaaccctaaccgtacgttaccgacggtccctaacggtcccgtaggtaccgtaacggttacgttaacggttaaacggttttacgttttacggtaccgttttaaagttttaaccgtttaacgttacgttaccggtaaacgttacggttaacgtttaaacgtttacggttaaccggttttacgggttaccggtttttaccggttttacgggaccggtaacgggtaccgtaacggtacggtagtaacgtacgtaacgacggtacgtaccgtaggttcacgtacacctactgttcttccg

SEQ ID NO: 77935 - DNA, 664 bp, Homo sapiens
  misc_feature: GYAE6OF01BRMGJ.49.28.C06.1.454.CMB.1.raw
  modified_base (151)..(151): a, c, t, g, unknown or other
  misc_feature (151)..(151): n is a, c, g, or t
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
  modified_base (389)..(389): a, c, t, g, unknown or other
  misc_feature (389)..(389): n is a, c, g, or t
  modified_base (475)..(475): a, c, t, g, unknown or other
  misc_feature (475)..(475): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactgganaaatagcgatgacgcagtctccagccacctgtctgtgtctccgagggaancgccaccgtctctgcaggccagtcagagtgttagcagctaacttagcctggtaccagcaacgaacctggccacggcctaccccgaggcctccctcacttccgtagttcgggtcnctacgtccaccggacggcctacgtcggtactcccgacgtcctagtcgagtcggacgtaggtcggtctagggacnggtactcactctacacgatacacgtacacgtccgtacgctagtcgtagtaacgttcgtttacgccgttaagttttaccgtacgttntacgaacgttcgtaacgtttaacttaacgttcgttacggttaccgtttttacgggttttaccgggaccggttaaccggggaaccgtaacggtttcggtaaacgggtacgtaaacgtaccgtaaacgggtcggtaaaccgttggtaccggtacccgttacggaaccgtaccccgttaagttccggttacc

SEQ ID NO: 77936 - DNA, 576 bp, Homo sapiens
  misc_feature: GYAE6OF01EQRAG.49.28.C06.1.454.CMB.1.raw
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
  modified_base (237)..(237): a, c, t, g, unknown or other
  misc_feature (237)..(237): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (372)..(372): a, c, t, g, unknown or other
  misc_feature (372)..(372): n is a, c, g, or t
tcagagtcgagagacacgaccggtgctcgatttagagctcacgtattgggtttgggggaggaactgctcagttaggacccaggacggaaccagtggaagccccagcgcagcttctctcctcctgctactctggctcccagagaccactggagaaatagcgatgacgcagtctccagccaccctgtctgtgtctccaggggaaangccacctncctgcagggccagtcagngtgttancagcaattgcctggtaccagcagaacctggccagctccaggctctcntctatggtnctactccaccagggccacgtcggtactccagccagtcaggtgcaggtggactcgggacagtagttcaacgtctacacancagcagcctgctagtctgaactagttttacgctaggtttattaccgtgttaccacgtacgtaacgttaacttaagttaccgttaggtccgtttcggttttacggacccggtaaggggtaaccctaaggtcctagggtaacgtacgttacgaaacgaccggttaagtgggtaccggtccgttagaacccgtaccctgtcgttcgg

SEQ ID NO: 77937 - DNA, 691 bp, Homo sapiens
  misc_feature: GYAE6OF01E18L8.49.28.C06.1.454.CMB.1.raw
  modified_base (205)..(205): a, c, t, g, unknown or other
  misc_feature (205)..(205): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagcccaccctgtctgtgtctccgaggggaaancgcccaccctctcctgcagggccagtcagagtgttagcagctaacttagcctggtacccagaccaacgaaacccgtggacccagggccctaccccgaggcctccctcattcgtatgggtcacctactcccaccgacgggcctacgtcggtacctccccgagtccctagggttccaggtcggctaggtggggtcgtaggggacctaggtacgttccacgttcctaccacctatacgacgccgacgtcctagacctagttcgtaggtaacgttattttacgacgtttagttttacgttacgttcgtacgtacgtacgttaaggtttaaattaacgtttaccggttacgggtttaccgttttacgggtttttaccgggacccgggtaacggggtaaccgtaacgggttacgtaagggtacgtacgtaacggaacggtaccgtaacgtgggtacggtacgtacgtacccgtacttaccgttcgtttaccg

SEQ ID NO: 77938 - DNA, 965 bp, Homo sapiens
  misc_feature: GYAE6OF01DQXQZ.49.28.C06.1.454.CMB.1.raw
  modified_base (205)..(205): a, c, t, g, unknown or other
  misc_feature (205)..(205): n is a, c, g, or t
  modified_base (338)..(338): a, c, t, g, unknown or other
  misc_feature (338)..(338): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccacgtggagaaatagcgatgacgcagtctccagccaccctgtctgtcgtctccgaggggaancgccacctcactgcacgggccagtacaggtagtgttagactacgactaacgttacggccttacggtaccaaggccaaacggtaaacccgtcgggacccgaggtacccttaccccggaggtcccttaccccttntaacgttcctaaggttcgggtacaccgtaccgttacccgaaccgggacgggttccccgtaaacgttggtaacccctaccccgaggtaccccgtaagggtttccgaggggttcggtaccggtagggggtttcggggtaccggttaacgggggaacctaagggttaccgtttacccgtaacccgtttacccgtaaccccgtaaaccggttactaccggaacccgggaccttaacccggttcgtacggtaacgttcggtttaaccgttaaaggtttacggttttacggttttcgttaaaccggtttttaacgtttttaacgtttacccgggtgttaacccgaggttaaccggtttaaaaggtttaacgtttttaaaacggtttcccgttttaggggtttaaccccggtttttttttacgggggtttaggggtaaacccccggggttaagggggtaaaacccccttttagggggtaaccgttaaacgggggttaaacggtttaaaccctaaaacggggggtaaacccggttttaaaccccgggaaacgggtttttccggggggaccccgttttacgttaaaaccccggggacccctttaaaaccgggtttccgttttacgggttaaccccg

SEQ ID NO: 77939 - DNA, 907 bp, Homo sapiens
  misc_feature: GYAE6OF01B5OVZ.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagcccaccctgtctgtgtctaccgaggggaaagacgcccaccctctccgtgcacgggccagtcaagagtgttacgcagacaacttagccgtggtaccagaccgaacggaaaccgtcggaccgacggcctaccccgacggtacccttccctctaacgttccgtaagttggggtacgtaccgtaaccgttaccccgaacccggaccggggtacccctaacgtacgggtaccctaccccgacggtacccgtaggttaccgaggtcggtacgtagggttcgggtacgtaggggacaggttacgtactactacgtaccaaccgtactacgacgaccgtacgtcccgtacgtacgaacgggtttaccgtaaggttaaacgtttcgtttttaaccggtaacgttttaacggtttttaaacgtttaccgtttaaggttaccgtaacgttaacgttaaacgtttaaacgttttaacggttttaacgggttttccgggttaaccggtttttttacggggttttttaacccggggaacccgggttaaaccgggggtaaaacccgtttaaaccgggttacggggttaaccggggttaaacggttaaacccggttaaacccggggtaaacgggttaaacccggttaaaccgggggtttaccgggtttaaccgggggtaccccggtttaaccccgggtaaaccccggtttaaccccgtttaaggttttaccccggtttttaaccccgg

SEQ ID NO: 77940 - DNA, 700 bp, Homo sapiens
  misc_feature: GYAE6OF01ECEYK.49.28.C06.1.454.CMB.1.raw
  modified_base (174)..(174): a, c, t, g, unknown or other
  misc_feature (174)..(174): n is a, c, g, or t
  modified_base (208)..(208): a, c, t, g, unknown or other
  misc_feature (208)..(208): n is a, c, g, or t
  modified_base (428)..(428): a, c, t, g, unknown or other
  misc_feature (428)..(428): n is a, c, g, or t
  modified_base (459)..(459): a, c, t, g, unknown or other
  misc_feature (459)..(459): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggcctcccagacgaccacgtggagaaatagcgatgacgcagtcnccacgcccaccctgtctgtgtcctcggagggaancgcccaccctctctgcgaggccagtcagagttgtagacagactaacttacgccgtagtaccacgacgaacgaaccgtcggaccgcggacctcccgacggtcctcctcacgttcgtacgtggtcacgaccctaccgacccggacggtaccctagtacggtaccctacccgagtacccgtaggttacgaggttcggacgtagggttcggacggtacgggtanacgtcgttaccgccttaccgaccaccgtacnccgacgtaccgacgtccgtcggacgttacgtacgttaaggtaagtttgttttacgttacgtttacgttttatccgttagtacgtaagtacttaattaagttacgtttacggtcggttttaccggttttacgggttaccgggtaccggtaacgggtaaccgtagggttacgtaaggtaccgtactaacgggacggtacggttcgtacggtacgtacgacgaccgttaacctgttcggttacc

SEQ ID NO: 77941 - DNA, 810 bp, Homo sapiens
  misc_feature: GYAE6OF01AJAB3.49.28.C06.1.454.CMB.1.raw
  modified_base (157)..(157): a, c, t, g, unknown or other
  misc_feature (157)..(157): n is a, c, g, or t
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (801)..(801): a, c, t, g, unknown or other
  misc_feature (801)..(801): n is a, c, g, or t
tcagagtcgagagacacgaccggtgctcgatttagagctcacgtattgggtttgggggaggaactgctcagttaggacccagacggaaccatggaacgccccagccgcagcttctcttcctcctgctactcgtggcctcccagagaccacgtggaanaaatagcgatgacgcagtctccagccaccctgtctgtcgtcncgaaggggaacncgccaccctcgtcctgccgaggggaccagtcgacggtgttgtacgacacggtacctaacgtttacggccgtacggtaaccgacgaccgtaacgtaaaccgtcggacccgaacggtcccgtacccgacgggtccctcctccgtaacgttcctaaggttcgggtcctaaccgtaaccgtacccggaaccggtaaccgggtccccgtaaccggttacgttaaccccgttaccccgacgggtacccggtaacgggtttaccgaaggggtccggacggtacgggttccgggttcggtacgggacgtaacggttacgttaccaaccgttcccaaccgtacccgtaacgttccgaacgttccgaccgtaccgttcgaacttacggtaccgtaaggttacgtttacgtttacggttaaccttaaggttttaccgtacgtttacgttacgtaacgttaacggttacgtttaacgttacgttacgggttccgggttacttttacgggtttaccgggacgtaacggggtaccgacgggttacggaaggtacgacgtaacggtacgtaccggacggttcgtaggtccttacggactccggtnttccgttcg

SEQ ID NO: 77942 - DNA, 735 bp, Homo sapiens
  misc_feature: GYAE6OF01EML7D.49.28.C06.1.454.CMB.1.raw
tcagagtcgagagacacgaccggtgctcgatttagagctcacgtattgggtttggggggaggaactgctcagttaggacccagacggaaccatggaagccccagcgcagcttctcttcctcctgctactctggcctcccagagaccactggagaaatagcgatgacgcagtctccagcccaccctgtctgtgtctccgaaggggaaagacgccaccctctcctgcgacgggccagtcagaggttcgttagcagactaacttacgcctacggtaccagacgaacgaaccgtggaccgacggcctccgacggcctcctactatcgtacgtggtcgacactaccgaccgacggacctacgtacggtacctccgacgtccgtaggttcgaggtcggacgtagggttgggtacggtacgggactaggtacgtactacttacctacctaacgtactcgaacgtccgaccgtacgtacgtactacggtacgttaggtaaacgtttcgttttacggactttaagtttttacgttaacgtcgtacgtacgtacgttaagtaacggttacggtccggggttacccgggttaccgttacccggtaaccgtttacccggggttacggggaacccggggtaacggggtaacccgtaagggggttacggaaacggttacggtaaaccgaaaccgggtacggttgggtaccggtacggtacgtaaccgtaaccgttgttcccggttaccg

SEQ ID NO: 77943 - DNA, 823 bp, Homo sapiens
  misc_feature: GYAE6OF01AOVT5.49.28.C06.1.454.CMB.1.raw
  modified_base (215)..(215): a, c, t, g, unknown or other
  misc_feature (215)..(215): n is a, c, g, or t
  modified_base (298)..(298): a, c, t, g, unknown or other
  misc_feature (298)..(298): n is a, c, g, or t
tcagagtcgagagacacgaccggtgctcgatttagagctcacgtattgggtttgggggaggaactgctcagttaggacccagacggaaccatggaacgccccagcgcagcttctcttcctcctgctactctggcctcccgagacgaccacgtggaagaaatgcgatggaacgctacgtctccagccctacctgtctgtcgtctccgaagggaacncgcccacctcgtctggacgaggccaggtcaggagtgtagcagctaacgtgccgtagaccaggtacaacgaaccgtcggaccgnggtaccctcccgaggtcccttacccgactacgtttaccgttacggttacggggtacctacctacccttaccccgaaccggaaccgggggttaccctaaccggtttaggggtaacccctaccccggaacgggtacccgttacggggtttaccggtcgggtaacgggtacccggttaaggggtccggggtaccggtaacggggtactacggggttacttacccggtactcccgtaacaaccgtataccgtacgtacgtaccgtcgtcggtaacgacggttcgtaacggtaaagtttcgtttagttaccggtttaaacgtttacgttacgtcgttaaccgacgttaacgttacgtttaaacgttacgtaccggtttaccggttacggttttaccggttttaaccggccgggttaaaccgggaacggttacggtacgttaaggaacgttaactaccggaaacggttccgttaaacgggtggttaccggtaccgttacggtaccctaaacgtcggtttaccgtttaccgg

SEQ ID NO: 77944 - DNA, 747 bp, Homo sapiens
  misc_feature: GYAE6OF01AZMCQ.49.28.C06.1.454.CMB.1.raw
  modified_base (318)..(318): a, c, t, g, unknown or other
  misc_feature (318)..(318): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagcccaccctgtctgtcgtctccgagggaaacgcgcccacctcctcctgcgagggccagtcagagtgttagcagctaacttcgcctggtaccagacaacgaacctggaccaggcctcccgaggcctcctcgactctagtcggtcnctactccgaaccgagggccctacggtcggtacctccccgaggacccgttaggttaccgaggtgggacgtaggggtcgggtacggtgggaactacggttacgttccctaacttccgtacccgaactacgtaccgaccgaccgtaaccgtccggtacgtaacccgtacgttacgtaacggttaaaggtttacgtttttacgtccgttttaaacgttttacttaccggtttagtactaacggttacgttaagttttaaacgtttaacgtttcgggtttacgggttttaccggttttacggttttaccggggaacccggtaaggggtaaccctagggtaccggttaagggtaaacgtcgtaaccggttaacggggtactaacgggttcgggtacgtacccgtacgaaccctcggttaccgtttgtttacccgg

SEQ ID NO: 77945 - DNA, 661 bp, Homo sapiens
  misc_feature: GYAE6OF01EECMD.49.28.C06.1.454.CMB.1.raw
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
tcagagtcgagagacacgaccggtgctcgatttagagctcacgtattgggtttggggggaggaactgctcagttaggacccagacggaaccatggaagccccagcgcagcttctcttcctcctgctactctggctcccagagaccactggagaaatagcgatgacgcagtctccagccacctgtctgtgtctccgaaggggaagcgcccaccctctcctcgcgacgggccagtcagngttgtancagactaacttacgccgtaggtaccagacgaacgaaaccgtggccacggcctacccgacggcctcctctactctagtggtcgactacctaccgaccggacggaccacgtggtacctccgacgtaccgtaggtacgaggtcggcgtagggtcggtacgtagggacacggtacgttccacgtcctaccacctactcacgaccgtacgtaccgtcgactacggtacgttagtaacgttagttttacgtacgtttaagttttacgttcgttacgttactacggtaattaagttaattaacgtttacggttacggtttaccgttttcgggtttacggaccggtaaccgggtactaggtacgtaggaacgtacgtaggaacggtacggtagttcggacgttctacgacctactgttcgttacg

SEQ ID NO: 77946 - DNA, 768 bp, Homo sapiens
  misc_feature: GYAE6OF01D6CQK.49.28.C06.1.454.CMB.1.raw
  modified_base (200)..(200): a, c, t, g, unknown or other
  misc_feature (200)..(200): n is a, c, g, or t
tcagagtcgagagacacgaccggtgctcgatttagagctcacgtattggggtttgggggaggaactgctcagttaggacccagacggaaccatggaagccccagcgcagcttctcttcctcctgctactctggctcccagagaccatggagaaatagcgatgacgcagtctccagccacctgtctgtgtctcgagggaanacgccacctctctgcagggccagtacaggtagtgtagcagctaacttcgccgtggtaaccagtcaacgtaaaccgtcggaccaacggtcctacccgaggtccttcccgtcgtaacttcgtagtcggttcacctacgtaccgaccgtacggggccctaacgtcgggttacctacccaaggtccgtagggttacgaggttcggacgtagggttgggtccgttagggaactaacggttattccctaacgttcctacctaccgtaacgtccgaacgcgtaaccgacgtcgtaactacggtacgttagtaacggtttatttaggtaactttaagttttaatttaccgtagtttacgtacgtaacgttaacgttaattaaccgtttacgggttacggttttaccgttttacccggggttttttaacgggacccggggttaaaagggtaaccccggtaaggtttaccggtaacggggtaaacgttacggttaaaaccggcggttaaaccggttacgggttacgggttacggtacccgttacggaaccctaaccggttgttacccgttttacccgg

SEQ ID NO: 77947 - DNA, 657 bp, Homo sapiens
  misc_feature: GYAE6OF01A60IE.49.28.C06.1.454.CMB.1.raw
  modified_base (203)..(203): a, c, t, g, unknown or other
  misc_feature (203)..(203): n is a, c, g, or t
  modified_base (360)..(360): a, c, t, g, unknown or other
  misc_feature (360)..(360): n is a, c, g, or t
  modified_base (629)..(629): a, c, t, g, unknown or other
  misc_feature (629)..(629): n is a, c, g, or t
  modified_base (645)..(645): a, c, t, g, unknown or other
  misc_feature (645)..(645): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaancgccaccctctcctgcagggccagtcagagtgttagcagactaacttagcctggtaccagacacgaacctggccaggcctacccgaggcctcctcattactagtcggtcgcactccaccgacgggcctacgtggtactcccgacggcctaggttacnggtcggcgtaggtacggggtctaggggactacgggtagttacctaccttcctaccaaccgtataccgaacgtccacggtacccgtgacctacgtacgtacggtaaagtttacgtttttagacgtttaagtttttaacgttacctttcggtaacgtacgtattaagttaagttaacgtttaacgttcggtttaccgttttcggtttacggaccggtaacgggtacccgtacggtaccggtaggacgtacgtaaggtaacggaccggttancggttaggctagaccnctagtccttacg

SEQ ID NO: 77948 - DNA, 871 bp, Homo sapiens
  misc_feature: GYAE6OF01D94F2.49.28.C06.1.454.CMB.1.raw
tcagagtcgagagacacgaccggtgctcgatttagagctcacgtattgggtttgggggaggaactgctcagttaggacccagacggaaccatggaacgccccagcgcagcttctcttcctcctgctactctggcctcccagacgaccacgtagggaagtaaaataggcgaagtcggaacggctaacggttccctacccgaacgcccctaaccccgttggttccgtggttacggtcccgtaccggaaagggggaaacaccgcccctacccgtctccgtgcggacgggacctaggtacgaaggtaggttgtacgacgtagtacctaacgttacgccgttacggaccgaacgacgtaaccggaaccgtcggaccgacggtcctacccggacggtcctacctacgtacgttccgtaggttcggacaccgtaacctacccgtacggaccgggaccttaacgtacgggttaccctacccggacgggtaccgtaacggttcgaacgggtcggggtacggttacggggttacgggtaccgggtaaccggggtaagtccggttaaccgtttaccccgtaaccggttcctaacccgtaaccccgttagtaacccgacgtaccgaccggtccgtacggtacgtacggttacgttaacgttaacggtttacgtttacgttaacgtttacgtttacgttacgtacgtttacgtacgttaacgtaacgtttaacgttaacggtttaccgggttacggtttaccggtttttaccgggttaccgggtacccgggtaaacgggtaccgttaggtaccgtaacggtacggttaccgtagaccggtaacgtacggtcggttcgtaccgtcgacgtccgttatccgttacg

SEQ ID NO: 77949 - DNA, 777 bp, Homo sapiens
  misc_feature: GYAE6OF01C7MT9.49.28.C06.1.454.CMB.1.raw
  modified_base (208)..(208): a, c, t, g, unknown or other
  misc_feature (208)..(208): n is a, c, g, or t
  modified_base (509)..(509): a, c, t, g, unknown or other
  misc_feature (509)..(509): n is a, c, g, or t
  modified_base (771)..(771): a, c, t, g, unknown or other
  misc_feature (771)..(771): n is a, c, g, or t
tcagagtcgagagacacgaccggtgctcgatttagagctcacgtattgggtttgggggaggaactgctcagttaggacccagacggaacatggaagcccagcgcagcttctcttcctcctgctactctggctcccagagaccacgtggagaaataggcgatgacgcagtctccagcccacctgtctgtcgtctaccggaagggaaacncgcccaccgtctccgtggccgacgggcctagtcgaggtacgttgttaacgcgaacgtaccgtaaacgttcgccgttacggaaccgagaccgtaaaaccggtaaccggtcggaccggaaccgtccccgtaccgacggtcccctaccgttactacttacgtcggttaggtaccgacctacccgacccggaccgggtaccgtcctacggttaccgtaccgaccgaccggttccggtacggtaacggtgggtccgaggggttacggtcgggtacgggtacgaacggttcgttccctaccgttacncccgacctaccgtacgtaaccggctaaccggtcgtaccggttacgtacggtaccgttaagttaacggttaagttttacgttacgtttaaggttttactttacgttacgtagtacgtagttaaacgttatttaaccggtagtttcccggttaccgttttcggtttaccggtacggaccgggtaaccgtagggtaccgtaggaacggtaacgccgttaaggacgttacgacggttggacgttccctagtacctacgttccgttnttcccg

SEQ ID NO: 77950 - DNA, 674 bp, Homo sapiens
  misc_feature: GYAE6OF01AVK2W.49.28.C06.1.454.CMB.1.raw
  modified_base (205)..(205): a, c, t, g, unknown or other
  misc_feature (205)..(205): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctggtctgtgtctccgaggggaaancgaccaccctctcctgacgagggccagtcagtagtgtagcagactaacttgccgtggtaccagcaacgaacctcggaccacggcctacccgacggtccttcccgtacacttacctagttcgggtcacctacgttacccgaaccgacggggtacccaacgttcgggtaaccttaccccgacggacccgtagggtttacaggggtcgacggtaggttcggggtaccggtgggacctaggttaccgttacgtaccttacgtaccacctactacacggacgtacgtccgtgtacgtacggtacgtagtaacgttgttttacggactttaacttttacttacgtacgtactaacggtattaagttaacttagttacgttggttcgtttcggttttcggacgtaacgggactacgcggtagtacgtacgtagacggtcgtaaccgtggacgtactacgacctactcgtcgttacg

SEQ ID NO: 77951 - DNA, 796 bp, Homo sapiens
  misc_feature: GYAE6OF01DHVCB.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggaagaaatagcgatgacgcagtctccagccaccctgtctgtgtctccgaggggaaagcgccaccctctcctgcgacgggccagtcaggtagttgttagcagacctaacgttacgccgtacggtaccacgacgaacgaaacccgtgggacccgacggcctacccgacggtcctccgtactacgttcttaggttcggtcgacctactcccgaaccggacgggaccctacggttacgggtaccctaccccgacggtaccgtacgggttcgagggtcgggtacgtacgggttcggggtacggtacggggaactacggtacgtttaccaccttcctaccgaacctataccgacgaccacgtcccgtacggacttacggttacgtaaaggttacgttttacgttttcgtaacgttttaacggtttactttacggttacgtactacggttaacgttaaagtttaacgtttaacggtttacgttcggttttaccgttttcggggttttaacccggggacccgggtaacggggttaaacccgtagggtacgggttaaggtaaaccggttaacgtaaccgggttaaacgggtacccggtttaacgggttggttaccgggttcctaacgggtaccctaacgttccgtttccgtttaccg

SEQ ID NO: 77952 - DNA, 819 bp, Homo sapiens
  misc_feature: GYAE6OF01BX84F.49.28.C06.1.454.CMB.1.raw
  modified_base (220)..(220): a, c, t, g, unknown or other
  misc_feature (220)..(220): n is a, c, g, or t
tcagagtcgagagacacgaccggtgctcgatttagagctcacgtattggggtttgggggaggaactgctcagttaggacccagacggaaccatggaacgccccagcgcagcttctcttcctctgctactctggcctcccagacgaccacgtaggaagaaataggacgatagacgacacgtcctaccacgccctacctgtctgtcgtcgacggaagggaanacgcctacctctcctggacgacggcagtcgagtagtgttagactagactaacttacggctaggtaacacgtacgaacgtacgtcggaccacggcctaccgacgcctaccgtacacttcgtagttcggtacaacctccgaccgaccggaccggtaccgtacgtcggttaaccacccggtacggaccgggttacggtacggtacggtcgggtacggtacggggttacgggtacggacggggttaccgaacgggttttaacgaccttaccggtctaaacccgtacgtacgtacggacgtacgtaccgcgtacgacgttacgtaacgtaagtttagtttaacgtttacgttaactttacggtttacgtacgttacgtacgtaacgtttaccggtaaagttaactttaaccgttacgggtttaccggttttaccggtttacccgggttaacgggtaaccgggttaaaccgggtaaggttaacgggtaccggtaaacgggtacgtttaacggaaccggttacggaacggttaaccggggttcgggttaacggtaaaccggtccggttaaaacccccgttacgttacccggtttcggtttaacccg

SEQ ID NO: 77953 - DNA, 817 bp, Homo sapiens
  misc_feature: GYAE6OF01EAZ8Q.49.28.C06.1.454.CMB.1.raw
  modified_base (202)..(202): a, c, t, g, unknown or other
  misc_feature (202)..(202): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctcgaggggaancgccaccctctccgtgcgagggccagtcagtagttgtagcagactaacgttagccgttacggtaaccagacaaacggtaaacccgtcggacccgaggccctccccgaaggtcccttaccgttaccactttaccgtagttacgggtccgaccgtacctacccgacccgtaacggggacccctaacgttcggtaaccttccccggaacggtacccgtaacgggtttaccgaaggttcggggcgtagggttcggggtaccgtaggggaactaggtaacgttcctaaccgtcgttacccgaaccctactaccgaacgtcccgtacgtcccgttcggaccgtacggtacgttaagggtaacgtttacgtttttcgtaacgtttaagttttacgttaacgttcgttaacgtacgtaacttaacgtttaaacgtttaacgtttacggttaccggtttacgttttacccggggttttaccgggacccgggttaacggggtaaccctaggggttaccgttaagggtaacgtaacggttaaccggtaaaccggttcggtaaaccggtttcgggtaaccgggttacttaacccgggacccttaaacccgttcgttcccgtttaccg

SEQ ID NO: 77954 - DNA, 835 bp, Homo sapiens
  misc_feature: GYAE6OF01A0LNB.49.28.C06.1.454.CMB.1.raw
  modified_base (212)..(212): a, c, t, g, unknown or other
  misc_feature (212)..(212): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggcctcccagagaccactggaagaaataggcgaatcgacgcagtcctccagcccaccctgtctgtgtctccgaaggggaaancgccctaccctctccgtgcgacgggccagtccaggtagtgtacgcacgtactaacgttacggccctaggtaacccaggaccaacggtaaacctcgggacccacggtccctacccgaggtccttccgtacgattcgtagtcgggtactaccgacctacccgaccggtacgggacccctacggttccggtaacctccccgagtcccggtaacgggttcgaacgggttcgggaccgtacggggtcgggttaccggacggggtaactaggttaccgttacctccgttaccaccgtaccctagacccgtaggaccctacggtccgtacggcgttacggtacgttaaggttaacggtttcgtttacggtaacctttacggttttacgtacgttcgttaacgtaccgttaagttaacggtttaaacgtttaacggtttacgggttaccggtttacccgttttttacggggggtttaccggaacccggggttaaccgggaaacctttacggggaccgtttaagggaaaccggttccgtaaacccgggttacggggaaacgtttacggggttaaacggtccgggttaacccgtacgggaaacccttcccgttaaggttttcccccggttacg

SEQ ID NO: 77955 - DNA, 818 bp, Homo sapiens
  misc_feature: GYAE6OF01DVP05.49.28.C06.1.454.CMB.1.raw
  modified_base (630)..(630): a, c, t, g, unknown or other
  misc_feature (630)..(630): n is a, c, g, or t
  modified_base (738)..(738): a, c, t, g, unknown or other
  misc_feature (738)..(738): n is a, c, g, or t
tcagagtcgagagacacgaccggtgctcgatttagagctcacgtattggggtttgggggaggaactgctcagttaggacccagacggaacatggaacgccccagcgcagcttctcttcctcctgccttactctcggcctcccgagacggaccctacgtagggaagtaaaatggcggaatcgaaccgctacgtcctccgacgcccctacccgttgttccgttggtcgttaccgaccgggaaagggggaaaacctccgaccccttacccttccttaccggcggaccggaaccggggtcccttaaggtaccgtaagggttacgtttacggttaacgaccaacggtaaccttaaccgtttaccggtaccggttaccggaaacctacggtaaccgaaaacggtaacccggtcggacccgtaccggtccctaccgacggtcccttcgtactaacgtcgtttaggcggtaccgacctaaccgtacccggacggtaccggaccgttcgtaacggttccaaccgacgtacggttacggttacggacgtgggcgtagggtcggtacggtcggaacgtcgttacctacgtaaccgttcaccgactgccgagcgcttcgatacgtagtagtaggtaactttntttacgtatttacgtttcgtacgtcgaacgtcgttaatacgttaactttaaccggtcgtttacggtttccgggttttacgacgggaccggttaaggaccgttaacggngggttaaacaaggttcgtaaccggtaacggaccgttggtacgggtccctagttaccccaatttcgttacggttcctaccg

SEQ ID NO: 77956 - DNA, 844 bp, Homo sapiens
  misc_feature: GYAE6OF01A2R0J.49.28.C06.1.454.CMB.1.raw
  modified_base (153)..(153): a, c, t, g, unknown or other
  misc_feature (153)..(153): n is a, c, g, or t
  modified_base (211)..(211): a, c, t, g, unknown or other
  misc_feature (211)..(211): n is a, c, g, or t
  modified_base (823)..(823): a, c, t, g, unknown or other
  misc_feature (823)..(823): n is a, c, g, or t
tcagagtcgagagacacgaccggtgctcgatttagagctcacgtattgggtttgggggaggaactgctcagttaggacccagacggaaccatggaacgccccagcgcagcttctcttcctcctgctactctggctcccagacgaccactgganaaatagcgatggacgcagtctccagccctaccctgtctgtcgtctccgaaggggaaancgcccaccctctccgtgcgagggccagtcagtagttgttacgacacgtactaaccgttagccctaggtaaccacggaacgtaacggaaaacccttggggaccctaacgggtcccttacccggaacggtccttaccccgtaacgtacgtttaccgttacggttcggtacgacccgtaaccgtacccgaccggtaacggggtccctacggtttaccgggtaacccttaccccggaaggtcccggtagggttaccgaaggggtccgacggttaacgggttcggggtacgtacggggtaacctaagggttaaccgttccggtaaaccttccgtaaccggaaccgtacgtaccgtaacgtaccctaacgggtcccgtacgtacgtaaccgttacggtaacgttaacggtttacgttttacggagtttaacgttttaacgttcgttaggtaacgtacgtaacgttaaccgttaagtttaaggttaccggttacggttttccgtttacgggttttaccgggaaccgttacggggtaaccgttaacggtaccgttaagggtaccgtaacgtaacggtaacggttacggtaacgtccgggttacgacgttaaccggtaccncgtttacgttacgtttaccgg

SEQ ID NO: 77957 - DNA, 759 bp, Homo sapiens
  misc_feature: GYAE6OF01AE520.49.28.C06.1.454.CMB.1.raw
  modified_base (98)..(98): a, c, t, g, unknown or other
  misc_feature (98)..(98): n is a, c, g, or t
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
tcagagtcgagagacacgaccggtgctcgatttagagctcacgtattgggtttggggggaggaactgctcagttaggacccagacggaaccatggaanccccagcgcagcttctcttcctcctgctactctggcctcccagagaccactgggaagaaatagcgatggacgcagtcctccagcccaccctgtctgtcgtctccgaaggggaaanacgcccaccctctcctgcacgggccagtnagtagtgtagcagtactaacttacgccgtaggtaccagacaacgaaccgtggaccacggcctcccgaggtccctcctactatcgtagtggcgacactacccgaccggacgggtccctaacgtcggtacctccgacggtccgtacgggttccagggtcggacgtaggggttcgggtacggtaggggaactagtaccgtttcgaaccttccaccgaaccctagtccgacgaccgtaaccggtccgtacgtacgtaacgttacgtaacggtaaagtttctttacggttacgtttaaagttttacttacgttacgtacgtacgtacgttaaacttaatttaaccgtttacgttaccggtttacggttttacggttttaacccgggacccgggttaaacgggtaaccgtaacggtacgggtaacggtacggtaaccgttaacggtaacgggtaccgttaacggttacgggaccgggttactaccggtaaccggttaacccttaagtttcccggtttacccgg

SEQ ID NO: 77958 - DNA, 768 bp, Homo sapiens
  misc_feature: GYAE6OF01DE5UX.49.28.C06.1.454.CMB.1.raw
  modified_base (221)..(221): a, c, t, g, unknown or other
  misc_feature (221)..(221): n is a, c, g, or t
tcagagtcgagagacacgaccggtgctcgatttagagctcacgtattgggtttgggggaggaactgctcagttagacccagacggaaccatggaacgccccagcgcagtcttctccttcctcctgccttactctggcctcccgagacgacccagtggaataaatcgcgtatgacgcaagttccacagcccacctgtctgttcgtcaccggaagggaaaccnccgtccctacctctcgagacgacggctagtacgagttagtgtacgaccgtagtacgtaactcggccgtacgtaccaacgacgaaacgtaccgtcgaccgtacgtcctaccgacgtcctacctactacgtacgttacgacgtacgacctaaccgaccgaacggccgtactacggttaccgtaccgtaccgacgacgttacgtcgcggtacgtacggttacgggtcggtactagggactacgtcttaccacgttacccgacaaccgttcgaaccgtacgccgacgtcgtacgtacttagtaagtaacggttaagttcgttagttaacgtttacgtttacttacgtacgttaaccgtaagttaacgttaaacgttaagtttaacgttacggtttacggtttaccggtttacggtttaccgggaccggtaaccggtaacgtaccggtaccgtaggtaaaccgtaacggtaaccgtaacggttaaccggttaacggtacggttaaccgtaccggtaacccttaaccgttaaccgttccgtttccgttaaccg

SEQ ID NO: 77959 - DNA, 933 bp, Homo sapiens
  misc_feature: GYAE6OF01D9RTW.49.28.C06.1.454.CMB.1.raw
  modified_base (229)..(229): a, c, t, g, unknown or other
  misc_feature (229)..(229): n is a, c, g, or t
tcagagtcgagagacacgaccggtgctcgatttagagctcacgtattgggtttgggggaggaactgctcagttaggacccagacggaaccatggaacgccccagcgcagcttctcttcctcctgctactctggcctacccgagacgaccacgtggaagaaatacggcgagtcgacgcacgtcctccgacgcccaccttgttctggtcgtccgtaccggaaggggaaacncgaccctacccgtctccgtcgcggtacggaccagtacgagtagttcgtagcgacgtacgttaactcgtccgtacggtaaccacgaccgaacggtaaccgtcggaccctacggtccgtaccccgacggtcccttaccgtactaacgttcgttacggtacggtaccgtacctaaccgtaccccggtacccggaaccgggtaccccgtaacggtttacccgggtacctaccccggtaaccggtacccggttaacgggttcccgaggggttaccggggtacggtttacgggggttcccgggggttacggtaaccgggggtaaacgtacgggttaaccgtttacccgttaacccgttacccggtaaacctacccgtaagttaccggaaccgttccgaaccgttccgtacggtaccggttaagtccgggtttaaagtttaacgtttaccgttttaggttaaccgtttttaagttttaccgttacgtttacgttacgtaaacgttaacggtttaactttaaacggtttaccggttttaaccgggttaccggttttttacgggttttaccgggttaaccgggtaacgggtaacgggttaaccccgagggtttacgtaacggtaaccggtacgttaaaccggtacgggtaccgtaccgggttagggttaccccgcgttaaccgaacccgttacgtttggttcccgtttaccgg

SEQ ID NO: 77960 - DNA, 835 bp, Homo sapiens
  misc_feature: GYAE6OF01EHIQ8.49.28.C06.1.454.CMB.1.raw
  modified_base (342)..(342): a, c, t, g, unknown or other
  misc_feature (342)..(342): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagacgaccacgtggaagaaatagcgatgacgcagtctccagcccacctgtcctgtgtctcgagggaagacgccaccctctccgtgcgacgggaccagtcagagtgttacgcacgctaacgtacgtccgtaggtaccagaccaacgtaaccgtcgggaccacggccctacccgacggtcctcctactacttacgtagtcgggtacncctactaccccgaaccggtaccggacctaaccggttacggtaccgtacccgaacggtacccgtagggttcgacggtcggtacgtggggtacgggtcggaagggtacgtacggtacgttacctaccgttaccgtacctaaccgcgttaccgaccgggtacctaccggcgtaacgggtaccttagggttacggttaattaacgggtttttactttacgggtacttttaaggttttacttacggtttcccgaattaacccggttacttaaaagggttttaacctacgggtttttaccgttacccgggggttttttacgtttttacccgggggtttacggggaaccccggttaaacggggggttaaccctaaccgggttcgggggttaaacgttaccgggtaaaccgtttaaccggggaaacgttccggggttaaacccggtggtttaacccggtcgtacccgaaacggtttacccggttattccccggggttttac

SEQ ID NO: 77961 - DNA, 489 bp, Homo sapiens
  misc_feature: GYAE6OF02GEQML.49.28.C06.1.454.CMB.1.raw
tcagagtcgagagacacgaccggtgctcgatttagagctcacgtattgggtttggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtgcagtgggtctgggacagagttcactctcaccatcagcagcctgcagtctgaagatttgctagtttattactgtcagcagtatattactgtcttcgttttgcctagggaccagtctggagatacaagcgaacgtgtggctgcacctatctg

SEQ ID NO: 77962 - DNA, 526 bp, Homo sapiens
  misc_feature: GYAE6OF02H04LZ.49.28.C06.1.454.CMB.1.raw
  modified_base (300)..(300): a, c, t, g, unknown or other
  misc_feature (300)..(300): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaacctggccaggctcccaggctcctcatctatggtncatccaccagggccactggtactcccagccaggttcagtggcagtgggtctgggacagagttcactctcaccatcagcacgcctgcagtctgagtatttgctagtttattactgtcagtctagtattaattacgtggtcgttcgtttttcggacgtaacggggtacctaaggtcgtaggtagtaagtacgtaagacgtaacgtggtggcgtcgacgactagtctcg

SEQ ID NO: 77963 - DNA, 504 bp, Homo sapiens
  misc_feature: GYAE6OF02IHDN7.49.28.C06.1.454.CMB.1.raw
  modified_base (355)..(355): a, c, t, g, unknown or other
  misc_feature (355)..(355): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaacctggccaggctcccaggctcctcatctatggtgcatccaccagggccactggtactcccagccaggttcagtgcagtggtctgggacngagttcactctcaccatcagcagcctgcagtctgagtatttgctagtttattacttgtcagcagtataattactggtcttcgttttggcgtagggtacgaagcgtaggagatacgagtacgtaacgtggtcggcgtgacactactctcg

SEQ ID NO: 77964 - DNA, 501 bp, Homo sapiens
  misc_feature: GYAE6OF02GWU14.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtactcccagccaggttcagtggcaggtgggtctgggacagagttcactctcaccatcagcagcctgcagtctgaagtatttgctagtttattactgtcagcagtatatgtccgggtctccggactacgttcggcggagggacgaggtggagatacgaaacgactgtggctgcactatctcg

SEQ ID NO: 77965 - DNA, 495 bp, Homo sapiens
  misc_feature: GYAE6OF02ITSQI.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctccaggctcctcatctatggtgcatccaccagggccactggtatcccagccaggttcagtggcagtgggtctgggacagagttcactctcaccatcagcagcctgcagtctgaagtattttgctagtttattactgtcagcagtataattactggtcttcgttttggccgtaggggaccaagctggagatacaagcgaacgtgtggctgcacatctg

SEQ ID NO: 77966 - DNA, 511 bp, Homo sapiens
  misc_feature: GYAE6OF02HI9DG.49.28.C06.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaangccaccctctcctgcagggccagtcagagtgttagcagcaacttagcctggtaccagcagaacctggccaggctcccaggctcctcatctatggtncatcccaccgagggcccactggtactcccagccaggttcagtgcagtgggtctgggacagagttcactctcaccatcagcacgcctgcagtctagaagtatttgactagtttattactgtcagtcagtattaatactgtcttcgttttggccgtagggtacgagtcgtaggagatacgaagacgtaacgtggtcgcgtgaccacgtatctcg

SEQ ID NO: 77967 - DNA, 506 bp, Homo sapiens
  misc_feature: GYAE6OF02F3WC7.49.28.C06.1.454.CMB.1.raw
  modified_base (203)..(203): a, c, t, g, unknown or other
  misc_feature (203)..(203): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgctagtttattactgtcagctagtataattactggtcttcgttttgcgtaggggtaccaagtcgtggagtatacaagcgtaacgtggtcggcgtgcacctatctcg

SEQ ID NO: 77968 - DNA, 561 bp, Homo sapiens
  misc_feature: GYAE6OF02HQK6Z.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccacgtggtactccccagccaggttcagtggcaggtgggtctgggacagagttcacttcctcaccctatcagcacgcctgcagtctgaagtattttgcttagtttattacttgtcagtctaagttaattaattacttggtctttcggtttttcggaccgtacggggtacctaacggtcgtaggtaggtaacgtacgaacggtacgtaacgttggtacggtcgtacggacctaccgtacgttcgttacg

SEQ ID NO: 77969 - DNA, 503 bp, Homo sapiens
  misc_feature: GYAE6OF02GCD1H.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccgagggccactggtactccccagccaggttcagtggcaggtgggtctgggacagagttcactctcaccatcagcagcctgcagtctgaagtatttgctagtttattactgtcagcagtatattactggtcttcgtttgccgtagggacctagcgtggagtatacgaagcgaacgtggtcggctgcacctatctcg

SEQ ID NO: 77970 - DNA, 503 bp, Homo sapiens
  misc_feature: GYAE6OF02FXTKG.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccacagggccactggtactcccagccaggttcagtggcagtgggtctgggacagagttcactctcaccatcagcagcctgcagtctgaagtatttgctagtttattactgtcagctagtataattactggtcttcgttttgccgtagggacctaagcgtggagtatacaaggcgtaacgtggtggctgcacctatctcg

SEQ ID NO: 77971 - DNA, 801 bp, Homo sapiens
  misc_feature: GYAE6OF02ICDAD.49.28.C06.1.454.CMB.1.raw
tcagagtcgagagacacgaccggtgctcgatttagagctcacgtattgggttttggggggaggaacgtgcctcagttaggacccgagtaccggaaccgattcggaagtccccgagcgcagcttctcttacctcctgcgtactctggctccgagtaggaccactggagtaaagttacgtcgtattgtacgcgagtcctcagccacctgtctgtgtcgtcgacgggggaaagagtccgaccctctccctggcgtacgggccagtccagtacgtgttagcacgctaacgttagtcctacggtaccagactaagaaacctggaccaaggtcctacccgagggtcctccctacgacttcctaaggtacgggggtcacgaacgttcccgaaccgtacgggggcccctaacgttacgggttaaaacctaccccggtaggaccccgtaagggtttaccttaaggtcgggacctaaggggttacgggtccgtcgggggaacctacggtagtttaccaaccgttcctacgaacccttaactaccacgtaccgaaacgtccgtagtacgtaaggtttaccgtaaggtaaacgttacgtttttagtaccgtttaaagtttttacgtttaaccgttgtaacgtaacggtaccttaaacggtttaaattaaaccgttacgttacggtccgtttaccggttttagggaccgtaaggggttaacctaaggtcgttacgggtaagttaacgttacgtaacgggtacgtaacgttggtacggtacgttcgggacccgtaacggttaccgttcgttacgg

SEQ ID NO: 77972 - DNA, 538 bp, Homo sapiens
  misc_feature: GYAE6OF02GIG3P.49.28.C06.1.454.CMB.1.raw
  modified_base (208)..(208): a, c, t, g, unknown or other
  misc_feature (208)..(208): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
tcagagtcgagagacacgaccggtgctcgatttagagctcacgtattgggtttggggggaggaactggctcagttaggtacccagacggaaccatggaaggccccagcgcagcttctcttcctcctgctactctggctcccagagaccactggagaaatagcgatgacgcagtctccagcccaccctgtctgtgtctccaggggaaanagccaccctctcctgcagggccagtcagagtgttagcagcaacttagcctggtaccagcagaaacctggccaggctcccaggcctcctcatctatggtgcatcccaccgacggggccacgtggtactccccagccaggttcagtggcaggtggggtctgggacaggtcgttcactctccaccntcagcacgctgcngtctagaagtnttttgnttagtttattactgtcagctagtattaattactggtctttcgttttcggccgtaaggggtacctagtacgtaggacgatacgaagtacgtacgtggtcgctgaccactattcgttcg

SEQ ID NO: 77973 - DNA, 523 bp, Homo sapiens
  misc_feature: GYAE6OF02HISTT.49.28.C06.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (398)..(398): a, c, t, g, unknown or other
  misc_feature (398)..(398): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaanagccaccctctcctgcagggccagtcagagtgtagcagcaacttagcctggtaccagcagaaacctggccaggcctcccaggctcctcatctatggtncatccaccgagggccactggtactcccagccaggttcagtgcaggtgggctgggacagagttcactctcaccatcagcagcctgcagtctagaagtntttgctagtttattactgtacagtctagtattaattactggtcgtttcgttttggccgtaaggggtaccaagtcgtaggagtaatacgaaggcgtaacgtggtacggctgaccgactattcgtcg

SEQ ID NO: 77974 - DNA, 606 bp, Homo sapiens
  misc_feature: GYAE6OF02JZDAC.49.28.C06.1.454.CMB.1.raw
  modified_base (207)..(207): a, c, t, g, unknown or other
  misc_feature (207)..(207): n is a, c, g, or t
  modified_base (311)..(311): a, c, t, g, unknown or other
  misc_feature (311)..(311): n is a, c, g, or t
tcagagtcgagagacacgaccggtgctcgatttagagctcacgtattgggtttggggtaggaacgtgctcagttaggacccagacggaaccatggaagccccagcgcagcttctcttcctcctgctactctggctcccagagaccactggagaaatagcgatgacgcagtctccagccaccctgtctgtgtactccgaggggaaacngccaccctctcctgcaggccagtcagagtgttagcagcaacttgcctggtaccagcagaaacctggccaggcctcccgaggcctacctcgaatcctagtggacncatcccaaccgagggcccacgtggtactccccagccctaaggttccaggtcggccaaggttcgggtactcggggaactacggtagtttccgaaccgttcgtccaacccgtatccgacgaccgtacgccgtcgccgtacgtcgtacgacgtactttgtcgtacgtttagttacttagtctagtcgtagttataattactaggtcttacgttttcgaccgtacggtaccgtacgtcgtacgtagtactacgtaaggtaccgtaacgtgtacggtcgtgtaccacgtacgtcgttacg

SEQ ID NO: 77975 - DNA, 545 bp, Homo sapiens
  misc_feature: GYAE6OF02G6UAI.49.28.C06.1.454.CMB.1.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaangccaccctctcctgcagggccagtcagagtgttagcagcaacttagcctggtaccagcagaacctggccaggctcccaggcctcctnatctatggtncatccaccagggccacgtggtactccccagcctaggttcaggtggctaggtgggtctgggacagtacgttcactctaccacctatcacgcacgtcctgctagtctaggaacgtagttttcgtacttagtttattacgtgtacagtactagttaattaacttacgttggtctttcggttttacggcgtaacggggacctaggcgtaggagtatacgagacgacgttgagctcgctactagtctcg

SEQ ID NO: 77976 - DNA, 553 bp, Homo sapiens
  misc_feature: GYAE6OF02ICGW4.49.28.C06.1.454.CMB.1.raw
  modified_base (213)..(213): a, c, t, g, unknown or other
  misc_feature (213)..(213): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctntcctgcagggccagtcagagtgttagcagcaacttagcctggtaccagcaagaacctggccaggctccaggctcctnatctatggtncatcccacagggccagtggtactcccaggccctaggttcaggttggcaggtcgggtctgggacagtagttccacttcacaccatcacgcagcctgctagtcgtagaagtatttagacttagtttattacttgtcagtctagttaataattacgtggtacttcgttttcggacgtagggtaacctagtccgtaggtacgtacgtacgaacggtaccgtaacgtggtacggtcgtacgtaccacgtactcttacg

SEQ ID NO: 77977 - DNA, 533 bp, Homo sapiens
  misc_feature: GYAE6OF02I88Q0.49.28.C06.1.454.CMB.1.raw
  modified_base (362)..(362): a, c, t, g, unknown or other
  misc_feature (362)..(362): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagagccaccctctcctgcagggccagtcagagtgttagcagcaacttagcctggtaccagcagaaacctggccaggctccaggctcctcatctatggtgcatccaccaggggccactggtactcccagccaggttcaggtggcaggtgggtcgtgggganaggtagttcacgtctacactatcagcagcctgcagtctagtaagtattttgacgttagtttacttactgtcagtctagttaattaattacgtggtcctttggttttggaccgtaggggactagcgtaggagatacgaaggacgtagtggtcgcttcgactacctattctcg

SEQ ID NO: 77978 - DNA, 719 bp, Homo sapiens
  misc_feature: GYAE6OF02GK4XK.49.28.C06.1.454.CMB.1.raw
tcagagtcgagagacacgaccggtgctcgatttagagctcacgtattgggtttgggggaggaactgctcagttaggacccagacggaacccagtggaacgccccagcgcagcttctcttcctcctgctactctggcctcccagacgacccacgtggaagaaatagcgatggacgcagtcctccagcccacccgtgtctgtgtcctccgaaggggaaagcgcccaccctctccgtgcgacgggccagtcagagtgttagcagacctaacgttacgccgttacggtaaccagccaacgaaaccgtcggacccgaggcccctacccgaggtccctccctacactctagtggtcgcactcccgaaccgcggggaccctacgttaggtacctaccccgacgacccgtaggttaccaagggttcggaccgtaggggttcggggtcgtaggggaacctaggtacgtttacccaaccgttccctaccaaccctataccgaacgccgaaccggtcccgttcgaccgtacgttaccgtaggtaaacgttagttttcgacgttaagttttaacttacgttgtacagtacgtagtaattaagttacgtggttacgttttcggttttacggaccggtaacgggtaaccgacggtcgtaggtaacgtacgtaacgaacggtaccgttaacgtgggtacggtcgttacggacctaaccgtacgttccgttaccg

SEQ ID NO: 77979 - DNA, 690 bp, Homo sapiens
  misc_feature: GYAE6OF02JCVLJ.49.28.C06.1.454.CMB.1.raw
  modified_base (203)..(203): a, c, t, g, unknown or other
  misc_feature (203)..(203): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaangccaccctctcctgcagggccagtcagagtgttagcagcaacttagcctggtaccagcagaacctggccaggctcccgaggcctcctcatcctatggtcgacactcccgacgacgggccaacgttggtaacctccccaacgtccgtaaggtttccaggtcggacctaggtcgggttcgtacgggactaaggtacgttcaaccgttcctaccgaacctagtaccgaacgccacgccgtcgtacgacgttccgtaggtaacgttaacgttttgacgtttaacgttttacttaaccgttagttacgagttactaagttaacttaaacgtttacgttacggttccttttacgggtttttaccgggaccgtaacggggtaaccgtaacggttcgttaaggtaacggtaacggttaaccgtaaacgggtaccggttaacgttacgggtacggtacccgttaggaacccgttaccggtaacgtttcgttaacgg

SEQ ID NO: 77980 - DNA, 531 bp, Homo sapiens
  misc_feature: GYAE6OF02HEN61.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccacgtggtactccccagccaggttcagtggcaggtgggtctggggacagagttcactctcaccatcagcagcctgcagtctgtaagtatttgctagtttattactgtctagtctagttattaattacgtggtcgtttcgtttttggccgtaaggggtacctaaggtcgtggtagtatacgaaggcgtaacgtggtaggctcggctaccgtatcgtcg

SEQ ID NO: 77981 - DNA, 571 bp, Homo sapiens
  misc_feature: GYAE6OF02F8ZJE.49.28.C06.1.454.CMB.1.raw
  modified_base (204)..(204): a, c, t, g, unknown or other
  misc_feature (204)..(204): n is a, c, g, or t
  modified_base (394)..(394): a, c, t, g, unknown or other
  misc_feature (394)..(394): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaanagccaccctctcctgcagggccagtcagagtgttagcagcaacttagcctggtaccagcagaacctggccaggcctcccaggcctcctcatctagtggtcgcactccaccgacgggcccaacgtggtactcccagccaggttcaggtcggcaggtgggtcgtggggacaggtacgttcacttcctccacntcacgcacgcctgcagtctagaagtatttgacgttagtttacttactgtcagtctaagttaattaagttacgttggttacgtttcgttttcggaccggtacgggtacctaaggtcgtagggagtaacgtacaaggtaccgtaacgtggtacggtcgtcgacctacgtacttcgtacg

SEQ ID NO: 77982 - DNA, 516 bp, Homo sapiens
  misc_feature: GYAE6OF02GNO0Y.49.28.C06.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (304)..(304): a, c, t, g, unknown or other
  misc_feature (304)..(304): n is a, c, g, or t
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
  modified_base (513)..(513): a, c, t, g, unknown or other
  misc_feature (513)..(513): n is a, c, g, or t
tcagagtcgagagacacgaccggtgctcgatttagagctcacgtattgggtttgggggaggaactgctcagtttaggacccagacggaaccatggaagccccagcgcagcttctcttcctcctgctactctggctcccagagaccactggagaaatagcgatgacgcagtctccagccacctgtctgtgtctccaggggaaangccaccctntcctgcagggccagtcagacgtgttagcagcaacttagcctggtaccagcagaaacctggccaggctcccaggcctcctacatctatgggtncactccgaccagggcctactcggtactccccagcccaggttcaggtcggctaggtgggtctggggacagngtttcacttctacaccntcagcagcctgctagtctagaatattttgactagtttattactgtacagctagtataattactgtcttcgttttgcgtagggacagtctggagtatacaagcgaacgtgtcgctagcacatntcg

SEQ ID NO: 77983 - DNA, 575 bp, Homo sapiens
  misc_feature: GYAE6OF02IZA99.49.28.C06.1.454.CMB.1.raw
  modified_base (203)..(203): a, c, t, g, unknown or other
  misc_feature (203)..(203): n is a, c, g, or t
  modified_base (374)..(374): a, c, t, g, unknown or other
  misc_feature (374)..(374): n is a, c, g, or t
  modified_base (398)..(398): a, c, t, g, unknown or other
  misc_feature (398)..(398): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaanagccaccctctcctgcagggccagtcagagtgttagcagcaacttagcctggtaccagcagaaacctggccaggctcccaggcctcctcatctatggtgcatccaccagggccactggtactcccagccaggttcagtggcagtgggtctgggacagagttcactctcacntcagcagcctgcagtctgtaagtnttttgacttagtttactttacgttgttacgtagtactaagttaattaagtttacgttaggttcgtttaccggttttttggacccggttaacggggaaccgtaacggtcgttagggtagtacgtacgtaacggacgtaacgttggtacggtcgttacggccgtacctagttcgttccg

SEQ ID NO: 77984 - DNA, 692 bp, Homo sapiens
  misc_feature: GYAE6OF02IZO09.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccagggaaagagccaccctctcctgcagggccagtcagacgtgttagcagcaacttagcctggtaccagcagaaacctggccaggcctccaggctcctcatctatggtgcactccgaccagggccaactggtactcccagccaggttcaggtggcagtgggtctacggggacagtagttcactctacctacaacttccgagccgacgtaccccgttggaccgtaaggttccttaggaaacgtacgttttttaggcccgtttaaagggttttttaacttaaccgtttacggttacccgtaagggtacccttaaagggttaacttttaacgttttaaacgttcgggttaccgtttttaccggtttttttacggggacccggttaacgggggtaacccctaagggtccgttaaggggtacgtaacgttaccgaaagggttacccgtaacgttaagggttcggtaccgttacggtacccgtaacgttacgttaccgtttaccgg

SEQ ID NO: 77985 - DNA, 496 bp, Homo sapiens
  misc_feature: GYAE6OF02G1WK5.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatccccagccaggttcagtggcagtgggtctgggacaggagttcactctcaccatcagcagcctgcagtctgaagtatttgctagtttattactgtcagctagtataattactggtcttcgttttgcgtagggaccagctggagatacaagcgaacgtgtggctgcactatctcg

SEQ ID NO: 77986 - DNA, 604 bp, Homo sapiens
  misc_feature: GYAE6OF02I7KOR.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggcctcccaggcctcctcatctatggtgcatccaccgacgggtccacgtggtactcccaggccaggttcagtggcaggtgggtctgggacagtacgttcacgtctacacctatcagcagcctgctagtcgtagaagtatttgacttagttttattacttcgtacgacgtacgtaagttaacttaatttacgtcggttcttttacggtttttacggacccggtaaggggtacccgtaagtacgttagggaacgtacgttaaccggaacggtaaccggtaacgtttagggtacgggaccgttaggaacccgtacccgtacttccgttacgg

SEQ ID NO: 77987 - DNA, 632 bp, Homo sapiens
  misc_feature: GYAE6OF02GV7EQ.49.28.C06.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
tcagagtcgagagacacgaccggtgctcgatttagagctcacgtattgggtttgggggtaggaacgtgctcagttaggacccagacggaaccatggaagcccagcgcagcttctcttcctcctgctactctggcctcccagagaccactggagaaatagcgatgacgcagtctccagccaccctgtctgtgtctccgaggggaaangccaccctntcctgcagggccagtcagagtgtagcagcaacttagcctggtaccagcaagaaacctggccaggcctcccgaggcctccgtcatctatggtgacagtcccaacgacgggccaactgggtactcccgagccctaaggttccaggtcggcctagggttgggtcctaggggactaacggtagtttccaaccgttcctaccgaacctagtacgacgtcgacgcccgtgcctagtcctagtaacgtattttcgacgttagttttacttactgtactacgtactaagttaattaagtttacgtacggttccgttttacgggttttacggtaccggtaacggggtaacctaacggttcgtaggtacgtagtaccgtaacggtacgtaacgtggtacgtcgtacgaccgtaccgtacgtcgttcg

SEQ ID NO: 77988 - DNA, 526 bp, Homo sapiens
  misc_feature: GYAE6OF02IP3NA.49.28.C06.1.454.CMB.1.raw
  modified_base (203)..(203): a, c, t, g, unknown or other
  misc_feature (203)..(203): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaanagcccacctctcctgcagggccagtcagagtgttagcagcaacttagcctggtaccagcagaaacctggccaggctcccaggctcctcatctatggtgcatccaccgagggccacgtggtactcccagccaggttcaggtgcaggtggtctgggacagtagtcactctccacatcagcagcctgctagtctgaacgtatttgctagtttattacttgtcagcagttattaattactggtctttcgttttggaccgtaaggggacctaggtcgtaggagtaatacgaaggtacgaacgtgtcggtcgtgccaactatcgttacg

SEQ ID NO: 77989 - DNA, 522 bp, Homo sapiens
  misc_feature: GYAE6OF02GD0RN.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtgcagtgggtctgggacagagttcactctcaccatcagcagcctgcagtctgaagtatttgctagtttattactgtcagctagtataattacgtggtcttcgttttggccgtaacggggacctaagtcgtaggagtagtacgaagtcgtaacgtaggtggacgtcgcgtaccgtacttcgtacg

SEQ ID NO: 77990 - DNA, 545 bp, Homo sapiens
  misc_feature: GYAE6OF02HSQ26.49.28.C06.1.454.CMB.1.raw
  modified_base (204)..(204): a, c, t, g, unknown or other
  misc_feature (204)..(204): n is a, c, g, or t
  modified_base (378)..(378): a, c, t, g, unknown or other
  misc_feature (378)..(378): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcaagtctccagccaccctgtctgtgtctccaggggaaanagccaccctctcctgcagggccagtcagagtgttagcagcaacttagcctggtaccagcagaaacctggccaggctcccaggcctcctcatctatggtgcatccaccagggccacgtggtactcccagccaggttcagtggcaggtgggtctgggacagagttcactctcaccntcagcagcctgcagtctagaagtatttgacttagtttacttactgtcagtctagttaattaagttacgttggtacgtttcggtttttacggaccgtaacggggtacctaaggtcgtaggtagtagtacgaaggacgtaacgtggtcggtctagccactagtcgttcg

SEQ ID NO: 77991 - DNA, 549 bp, Homo sapiens
  misc_feature: GYAE6OF02GBJP8.49.28.C06.1.454.CMB.1.raw
  modified_base (403)..(403): a, c, t, g, unknown or other
  misc_feature (403)..(403): n is a, c, g, or t
  modified_base (427)..(427): a, c, t, g, unknown or other
  misc_feature (427)..(427): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagagccaccctctcctgcagggccagtcagagtgttagcagcaacttagcctggtaccagcagaaacctggccaggctccaggcctcctcatctatggtgcatccaccgagggccacgtggtactccccagccaggttcagtggcagtgggtctgggacagtagttcactctcaccatcagcagcctgcagtctagaagtntttgctagtttattactgtctagntaagttattaattactggttcgtttcggtttttcggccgtaaggggtaccgtaaggtcgttagggacgtagtaacgaacggtacgtaacgtggtcggcgttggacctacgtacgttcttcgg

SEQ ID NO: 77992 - DNA, 545 bp, Homo sapiens
  misc_feature: GYAE6OF02HEFD4.49.28.C06.1.454.CMB.1.raw
  modified_base (203)..(203): a, c, t, g, unknown or other
  misc_feature (203)..(203): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccgagggccacgtggtactccccagccaggttcagtgcaggtgggtctgggacagtagttcactctcaccatcacgcagcctgcagtctgtaagtatttgacttagtttattacttgtactagtactagtattaagtttacgtcggttctttcgtttttcggacgtaacgggtacctaagtcgtaggtacgtagtacgtaacgacgtaacgtgtcggtcgtcgacacgtactcgttcg

SEQ ID NO: 77993 - DNA, 581 bp, Homo sapiens
  misc_feature: GYAE6OF02HC9WC.49.28.C06.1.454.CMB.1.raw
  modified_base (301)..(301): a, c, t, g, unknown or other
  misc_feature (301)..(301): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttgcctggtaccagcagaaacctggccaggcctcccaggctcctcatctatggtnctactccaccgagggacccacgttcggtactccccgagccctaagggttccaggtggctagggttcgggtcgtaggggacaggtacgtttccacttccacaccatcacgcacgtcctgctacgtctagtagtatttgacttagtttattactgtcagtactagttaattatacgttggtcgtttcggttttcggaccgtaacgggtacctaacggtcgtaggacgtaacgtacgaacggtacgtaacgtggtcgtacgtcgacctaccttagttcgtacg

SEQ ID NO: 77994 - DNA, 540 bp, Homo sapiens
  misc_feature: GYAE6OF02HW08Y.49.28.C06.1.454.CMB.1.raw
tcagagtcgagagacacgaccggtgctcgatttagagctcacgtattgggtttgggggaggaactgctcagttaggacccagacggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgaggggccacgtggcactcccagccaggttcaggtggcaggtgggtctgtgacagacttcactctcaccatcagcacgcctagacgctagaatattctgctagtttaattactgtcagcagcgtagctaacgtcgcctcgtctaccgttcggacgggacggaccgtagggtggaagtacgtaacgaaacgtaacgtggtacggtcgtacgaccacctacttcgtagttacc

SEQ ID NO: 77995 - DNA, 665 bp, Homo sapiens
  misc_feature: GYAE6OF02J1D7O.49.28.C06.1.454.CMB.1.raw
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
  modified_base (307)..(307): a, c, t, g, unknown or other
  misc_feature (307)..(307): n is a, c, g, or t
  modified_base (416)..(416): a, c, t, g, unknown or other
  misc_feature (416)..(416): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccacctgtctgtgtctccgaggggaanagccacctctcctgcagggccagtcagagtgtagcagcaacttagcctggtaccngcagtaaacctggaccaggctacccagggcctcctcgatcctagtcggtnctactccgaccgacgggtccacgttgggtaacctccccgaaggccgtaggtttaccaggtcggacacggttcggggtctaggggactagtacggttacacctcgttacncctagtcacgctacggtcctcgtacgacgttccgtaagtaacgttagttttacggtactttaacggttttacttaacgtcgttcctaacggtacgttaagttaacgtttaaagtttaccgttacgggtttaacgttttccgggtttttcggaaccgttaacggggtaaccgaaggttccgagggttacgacgtaccgtaacggtacgtaacggttcggtacggtactcggacctacttacgtgttaccg

SEQ ID NO: 77996 - DNA, 570 bp, Homo sapiens
  misc_feature: GYAE6OF02HV09W.49.28.C06.1.454.CMB.1.raw
  modified_base (204)..(204): a, c, t, g, unknown or other
  misc_feature (204)..(204): n is a, c, g, or t
  modified_base (365)..(365): a, c, t, g, unknown or other
  misc_feature (365)..(365): n is a, c, g, or t
  modified_base (409)..(409): a, c, t, g, unknown or other
  misc_feature (409)..(409): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaancgccaccctctcctgcagggccagtcagagtgttagcagcaacttagcctggtaccagcaaggaacctggccaggcctcccaggcctcctcatctatggtgcatcccacgacgggccaacgtggtactccccagccgtagttcaggtggctaggtcgggtntgggacaggtagttccacgttcctcaccatacagcacgcctgcngtctagagtatttgacgttagtttattacttgtctagctagttattaagtttacgtgttcgtttcggtttttcggaccgtacggggtaaccgtacgacgtacgggtagtacgtacgaacggtacgtaacgtcggtcggctacgccgtacgtacgttcttcg

SEQ ID NO: 77997 - DNA, 583 bp, Homo sapiens
  misc_feature: GYAE6OF02JF82G.49.28.C06.1.454.CMB.1.raw
  modified_base (310)..(310): a, c, t, g, unknown or other
  misc_feature (310)..(310): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactgggagaaatagcgatgacgcagtctccagccaccctgtctgtgtctccgaggggaaagacgccaccctctcctgcagggccagtcagagtgttagcagcaacttagcctggtaccagcaacgaaacctggaccaggcctcccgaggcctcctcatctatggtncactccaccgacgggcccacgttggtactcccgagccgtaggttcaggtcggctaggtcgggtcgtggggacaggtacgttcaccgtctacaccatcagcagcctgctacgtcgtagtaagtatttgacttagtttattacgtgtcagtctagttataagttacgtcggtcgtttcggttttcggaccgtacggggacctaaggtctagggtacgtacgttacgaacggtaccgtaacgttggtcggactccgacctaccgtacttcgttacg

SEQ ID NO: 77998 - DNA, 678 bp, Homo sapiens
  misc_feature: GYAE6OF02JZRQF.49.28.C06.1.454.CMB.1.raw
  modified_base (206)..(206): a, c, t, g, unknown or other
  misc_feature (206)..(206): n is a, c, g, or t
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
  modified_base (317)..(317): a, c, t, g, unknown or other
  misc_feature (317)..(317): n is a, c, g, or t
  modified_base (497)..(497): a, c, t, g, unknown or other
  misc_feature (497)..(497): n is a, c, g, or t
  modified_base (652)..(652): a, c, t, g, unknown or other
  misc_feature (652)..(652): n is a, c, g, or t
tcagagtcgagagacacgaccggtgctcgatttagagctcacgtattgggtttgggggtagggaacgtgctcagttaggacccagacggaaccatggaagcccagcgcagcttctcttcctcctgctactctggcctcccagagaccactggagaaatagcgatgacgcagtctccagccaccctgtctgtgtctccgaggggaangccaccctctcctgcagggccagtcagagtgttancagcaacttagcctggtaccngacagaacctggacccaggtcctacccgaggtcctcctccgatccttatgggtcnctagtccccaccggtagggccctacgttggtaacctccccgtaggtccgtacgggttcctaggtacgggcctaggggtttcggggtccgtcgggggaactacgggtacgtttacccgactttccgtaccgaccgtactcgacgccgtaacgcccgtagcctaggttcctaggtaacgttnttttacgacgtttagtttacttaacttgttacaacgttcgtaagttaacgttaactttacgttgggttaccttttacgggttttggacccggtaaggggttaccaggtcgttaggtagtaacgttacgtaacggtaccggtaagttggttacggngtaccggtactaccgtattcgttacg

SEQ ID NO: 77999 - DNA, 603 bp, Homo sapiens
  misc_feature: GYAE6OF02HW6DP.49.28.C06.1.454.CMB.1.raw
  modified_base (242)..(242): a, c, t, g, unknown or other
  misc_feature (242)..(242): n is a, c, g, or t
  modified_base (306)..(306): a, c, t, g, unknown or other
  misc_feature (306)..(306): n is a, c, g, or t
  modified_base (405)..(405): a, c, t, g, unknown or other
  misc_feature (405)..(405): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccacctgtctgtgtctccgaggggaaacgagccaccctctcctgcagggccaggtcagagtgttagnagcaacttagcctggtaccagacagaacctggccaggctcccaggtctacctcatctagtggtnacactccacgagggccacgtggtactccccagcccgtagggttccaggtcggactaggtcgggtctaggggactaggtacgttcactctcaacctatcncgtcacgtctgctagtcgtagtaagttagttttagactttaaggtttattaccgttgtactagtactaagttaattacgttagttcggttcttttcggttttcgggacgtaacggggtacctaaggcgttaggaacgtagtaccgacggtaccgttaacggttggtcgtacggtacgacccgtacgtacgtacgttcg

SEQ ID NO: 78000 - DNA, 582 bp, Homo sapiens
  misc_feature: GYAE6OF02HH07V.49.28.C06.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaanagccaccctctcctgcagggccagtcagagtgttagcagcaacttagcctggtaccagcagaacctggccaggctccaggctcctcactctatggtcncactccaccgagggccacgtggtactccccgagtccaggttccaggtcggctaggtcgggtcgtgggacaggtacgttacacgttcctacgaccagtcacgcacgtcctgacagtctaggtaagttatttagtcgttaagttttacttacgtgttacacgtactaagttaattaagttacgttaggttcgtttcggttttcgggaccgtacgggtacctaggtcgtggtagtacgtacgtaacgacggttaacgtggtcggcgtagacctcgtagtctcg

SEQ ID NO: 78001 - DNA, 611 bp, Homo sapiens
  misc_feature: GYAE6OF02H23ZQ.49.28.C06.1.454.CMB.1.raw
  modified_base (205)..(205): a, c, t, g, unknown or other
  misc_feature (205)..(205): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtcctccagccaccctgtctgtgtctccgaggggaaanagccaccctctcctgcgagggcccagtcagagtgttagcagcaacttagcctggtaccagacaacgaaacctggccaggcctcccgaggcctcctcatctagtggtcgctactcccaccgagggacccacgtggtactaccccagtccaggttcaggtgccgaggtgggtctggggacagtagttcctactccgtacaccctatcgacncacgtccngcagtctagagttagtttgacgttagtttattactcgtactagactaagttaataacgttacgttggtccgtttacggtttttcgggaccgtacgggtaaccgtaaggtacgtaggtaaggtaacgtaacgaacggtacggtaacgtcggttacggtaccgtacgtacccgaactccgttagttcccgg

SEQ ID NO: 78002 - DNA, 632 bp, Homo sapiens
  misc_feature: GYAE6OF02JQ7DV.49.28.C06.1.454.CMB.1.raw
  modified_base (171)..(171): a, c, t, g, unknown or other
  misc_feature (171)..(171): n is a, c, g, or t
  modified_base (205)..(205): a, c, t, g, unknown or other
  misc_feature (205)..(205): n is a, c, g, or t
  modified_base (309)..(309): a, c, t, g, unknown or other
  misc_feature (309)..(309): n is a, c, g, or t
  modified_base (407)..(407): a, c, t, g, unknown or other
  misc_feature (407)..(407): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtcnccagcccaccctgtctgtgtctccgaggggaaangcccaccctctcctgcagggccagtcagagtgtagcagctaacttgcctggtaccagcaagaaacctggccaggcctccgaggcctcctcatcctagtcggacnctactcccacgacgggcctagtcggtactcccgagccgtaaggtcaaggtcgacgtggtcgggtctagggaacaggtacgttcacctcgtcaaccgtntacgacgtacgacgtccgtagcgtacgtctaggtaacgttactttcggactttacgtttaacttacgttacgtacgtacgtacgttaagttaacgttaacttacgtcggttccgttttacgggttttacggaccggtaacgggtacctaacggtcgtaggtacgaacgttacgaacggtccggtaacgtttggacggttactacggtacctaccgtacttcgtcg

SEQ ID NO: 78003 - DNA, 767 bp, Homo sapiens
  misc_feature: GYAE6OF02JBQAZ.49.28.C06.1.454.CMB.1.raw
  modified_base (205)..(205): a, c, t, g, unknown or other
  misc_feature (205)..(205): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctaccgaggggaaancgccaaccctctcctgcacgggcctaagtcaggtagtgtagcagcctaaacgttgcctggtaccagcaacgaaacctggcctaggcctcccgaggtcctaccgtcactcgtaattggtcgaccgaactcccgaacccgacggggaccctaacggttacgggttaccttccccgaacggacccgttaacggttaccgaacggttcgggcccgttaaggggtcggggttaccggtacggggaactaacggggtaactttccgaaccctttaccgtaacccaaccgtacgtacgaacggaccacggtcctcggactacggttacgtaaggtaacgttagttttcgaacttagttttacttacgttcgttacgtaacgtcgttaattaacgttaacgttacgttacggttacgttttccggtttttacggggaaccggttaaaccggggaccgttaaacggttcggtaacgggtaacgttaacggttaaccggaaacggtacccggttaagttacgggttacggtacgttaccggaaccgtaacccgttacgttacccggtttacg

SEQ ID NO: 78004 - DNA, 662 bp, Homo sapiens
  misc_feature: GYAE6OF02IV4C5.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagagccaccctctcctgcagggccagtcagagtgttagcagcaacttagcctggtaccagcaagaaacctggaccaggctcccgaggcctcctcatctatggtcgcatccaccgacgggcccacgtcggtactccccgagccgtaggttcaggtcggacgtagggttcgggtcgtggggaacctaggtacgtttcgaaccgttcgtaccgaacctacgtaccgaacgccgtaacgtcccgtcgcctaacggtactagggtaaacgtttagtttcgtacgtttaagttttacttacgttgtactagtactaagttaattaagttacgtacggttcgttttacgggttttcggaccggtaacggggtacctaaggtcgttaggtaacggtaactacggtaacggtaaccgttaacggttcggttacggtacgttaccggaccgtacctagttccgtttacgg

SEQ ID NO: 78005 - DNA, 727 bp, Homo sapiens
  misc_feature: GYAE6OF02F9017.49.28.C06.1.454.CMB.1.raw
  modified_base (203)..(203): a, c, t, g, unknown or other
  misc_feature (203)..(203): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccacctgtctgtgtctccgaggggaaanacgccaccctctcctgccggaggccagtcaggtagttgtacgcagactaacttacgccgtacggtaccagacaacgtaaaccgtcggaccgacggtcccctacccgacggtccccttcccgtacctacttaccgttaggtcgggtcgacctaacctaccccgaaccggtaccgggaccctacggttacggtaccctacccgacgtaccgttaggttacgaggtcggacgtaggggtcggtcgtagggactaggttactacacttcgtaccactagacgtacgcacgtcctagactacgttcgtaagtaagtttcgtttacgactttacgttttaagttcgttcgtacaggttacttaagttaactttacgttacgttcggttacggttttttaccggtttcggaacccgggaacgggttacgtaacggttcggtaagggaccgttacggtaacgtaaacggggtccgttaaacggttcgggtacggttccggtaacgtccctaacggtttcgttccgttaccgg

SEQ ID NO: 78006 - DNA, 705 bp, Homo sapiens
  misc_feature: GYAE6OF02H3VLN.49.28.C06.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctcgaggggaaancgccaccctctcctgcagggccagtcagagtgtagcagcaacttgcctggtaccagcaagaacctggaccaggcctcccaggctcctcattctagtgggtcnctactccaccgacgggccacgtcggtactccccaggcctaggttcaggtggctaggtcgggtcgtgggacagtacgttcacctctaccacctatacacgcgacgcctcgacgtacgtacgtagtaagttagttttagtagtttacccccccgttttaagtttaaccgttacgttacgtaacggtacgttaagttaacgtttaaacgttttacgtttacgggtttaccgttttaccgggttttttacgggtaccggtaaaccgggggtaacccgtaacggttacggttacgggtaacggttaacggttaaccggtaacgggtaacccggttaaaccggttacgggttacgggttaccggttaccggtacccggtaacccgttaccgttacccgtttaccgg

SEQ ID NO: 78007 - DNA, 587 bp, Homo sapiens
  misc_feature: GYAE6OF02G6XI1.49.28.C06.1.454.CMB.1.raw
  modified_base (418)..(418): a, c, t, g, unknown or other
  misc_feature (418)..(418): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagagccaccctctcctgcagggccagtcagagtgttagcagcaacttagcctggtaccagcaagaaacctggccaggcctcccgaggcctcctcatctatggtgcatcccacgacgggccacgtggtactcccgagcctaggttcaggtcggctaggtgggtctgggacagtacgttcactctacacctatcacgcagcctgctagtctagaagtntttgacttagtttacttagtgtactagtctaagttaattaacgttacgtggttccgtttcggttttacggaccggtaacgggtaacctaggtcgtaggtaacgtacgtaaccgtaacggtaaccgtaacgttggtacggtacgtacgacctaaccgtacgttcgttacg

SEQ ID NO: 78008 - DNA, 666 bp, Homo sapiens
  misc_feature: GYAE6OF02HH8YR.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctccagagaccactggagaaatagcgatgacgcagtctccagccaccctgtctgtgtcctcgaaggggaaagagccaccctctcctgcagggccagtcagagtgtagcagcaacttgcctggaccagcagaactggccaggctcccgaggcctccgtcatctagtgtgcactcccaccgagggcccacgttggtaactccccgaggcctaggttccaggtcggactagggttcgggtctaggggaaccagtacggtttacaccgttcctaccgaacgtactcgacgccaacgccgtgaccgtagttacgtacgtaaagttgttttacggacgttaagttttacgttaacgttcgtacgtaagtaccttaaagttaactttaaacgttccgttacggttaccgttttaccggtttttacgggacccggtaacggggtaacctaacgggttaccgttagggtaacgtaacgttaccggaacggtaccggtaagttcggtacggtaccgtccgtaccgtaccttacggttccttacg

SEQ ID NO: 78009 - DNA, 526 bp, Homo sapiens
  misc_feature: GYAE6OF02I7C5T.49.28.C06.1.454.CMB.1.raw
  modified_base (215)..(215): a, c, t, g, unknown or other
  misc_feature (215)..(215): n is a, c, g, or t
  modified_base (310)..(310): a, c, t, g, unknown or other
  misc_feature (310)..(310): n is a, c, g, or t
  modified_base (352)..(352): a, c, t, g, unknown or other
  misc_feature (352)..(352): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggacagtgcccaccctntcctgcagggccagtcagagtgttagtagcttcttagcctggtaccaacagaacctggccaggctccaggctcctcatctatgatgcatccaacngggccactggcatcccagccaggtcagtgcaggtggtctgtnacagacttcactctacacatcagcagctagacnctagaagtnttcgngctatttatactgcagcagtcgtagcaacgtcggcctcgtcgtacgttccgggcggtaacgggaccgtaagggtggaacgtaacgtaacgaaaccggttacgtggttacggcttacggacctaaccg

SEQ ID NO: 78010 - DNA, 609 bp, Homo sapiens
  misc_feature: GYAE6OF02G5GHG.49.28.C06.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaangccaccctctcctgcagggccagtcagagtgttagcagcaacttagcctggtaccagcagaaacctggccaggcctccaggcctcctcatctagtggtncactccacgacgggccacgtgtactcccgagcctaggttcaggtggctaggtcgggtcgtggggacctaggtacgttccacttcctaccacctatcacgcagccgtgctagtactaggtaagttcgtttagtacttagttttattacgttgtactacgactaaggttaattaacgtttacgttcggttacgttttcggttttcgggaccggtaacggggtaccgtaacggtcgttaggaacggtaacgtaccgaacggtacgtaacgttcggtacggtacgtaggtaccctacgtcgttacgttcg

SEQ ID NO: 78011 - DNA, 618 bp, Homo sapiens
  misc_feature: GYAE6OF02G8S02.49.28.C06.1.454.CMB.1.raw
  modified_base (205)..(205): a, c, t, g, unknown or other
  misc_feature (205)..(205): n is a, c, g, or t
  modified_base (376)..(376): a, c, t, g, unknown or other
  misc_feature (376)..(376): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtcctgtgtctccgaggggaaangccaccctctcctgcagggccagtcagagtgttagcagcaacttagcctggtaccagcaagaaacctggccaggcctccgaggcctcctcatcgtagtggtcgcactccaccgacgggccacgtggtactcccgagtccgtaggttcaggtcggcgtagggtcgggtccgnggggactaggtacgtttccacgtctaccgaccatcgacgcacgtcctagctagtctaggtattagtttcgtactttagtttacgtacgttcgtactacgtactaagttaacttaacgtttacgttcggtttcgttttacgggttttacggaccggtaacgggtacgtaacggtcgtaggacgtacgtaaccggaacggtaccggaacgttggtcgtacgtcgacctaccgttgttaccttcg

SEQ ID NO: 78012 - DNA, 581 bp, Homo sapiens
  misc_feature: GYAE6OF02FMODD.49.28.C06.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaangccaccctctcctgcagggccagtcagagtgttagcagcaacttagcctggtaccagcagaaacctggccaggcctccaggctcctcatctatggtncatccaccgagggccacgtggtactcccgagcctaggttcaggtcggctaggttcggggtacgtgggactaggtagttcgactctccgaacctagtaccagcacgcctgctagtctaggtaatattttgactaagttttattaactgtcagtactagttattaatttacgtgttacgtttcgttttggaccgtaacggggtacctaaggtcgtaggagtacgtagtaacggtacgtaacggttcgttagggtacttacggtacacccgttatcccgttacg

SEQ ID NO: 78013 - DNA, 548 bp, Homo sapiens
  misc_feature: GYAE6OF02FK7LJ.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagagccaccctctcctgcagggccagtcagagtgttagcagcaacttagcctggtaccagcagaaacctggccaggctcccaggcctcctcatcctatggtgcatccaccaggggccacgtgtactccccagccaggttcagtggctagtgggtctggggaccaggacgttcacgtctcaccatcagcagcctgcagtctaggagtatttgctagtttatactgtcagctagtaataattactggtctttcgtttttaggaccgtaggggtacccaagtctgggtaacgattaccgaaggccggtaacgttgtacgggtctacggtccaaccgtattccgttaccg

SEQ ID NO: 78014 - DNA, 815 bp, Homo sapiens
  misc_feature: GYAE6OF02HATPC.49.28.C06.1.454.CMB.1.raw
  modified_base (204)..(204): a, c, t, g, unknown or other
  misc_feature (204)..(204): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaangcccaccctctcctgcgagggcccagtcaggagttgtagcagcaacttagcctggtaccagcaagaacctggaccaggcctcccgaggcctcctnatctagtcggncactccaccgagggcctacgtcggtactcccgacgccgtaggttcaggtcgggtcgtaggttcggggtcgtaggggtaactaggtacgtttccaaccgttccgttaacccaccgtacgttacccgaacggccgtaaacggtccccgttaggtacccgtaacgggtttacgttaacggttaaacggttttacgtttttacgggttaaccgtttaacggtttttttaaactttaccggtttacggtttacgtaacggttaaccgttaaacggtttaaacgtttaacggttttaaccggtttcgggttttaaccggtttttacggggttttttaaccggggaacccgggtttaaaccggggggtaaacccttaaaccggggttccggttaacggggtaaccggttaaacggttaaccggtaaaacggggttaacccggttaacgggtttagggttaccggttccggtaaccggtaaccgtttaacccgtacgtttacccgtttaccgg

SEQ ID NO: 78015 - DNA, 580 bp, Homo sapiens
  misc_feature: GYAE6OF02F6U3O.49.28.C06.1.454.CMB.1.raw
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
tcagagtcgagagacacgaccggtgctcgatttagagctcacgtattggggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaangcccaccctctcctgcagggccagtcagagtgttagcagcaacttgcctggtaccagcagaacctggccaggctccgaggcctcctcatctagtggtcncactccaccgagggcctacgtggtactccccagcctaggttcagtggactaggtgggtctggggacaggtacgttccacttctaccactatcagcacgcctgcagtctagagtagtttgactagtttattacgtgtactacgtactagttaattattacgtcggttctttacgttttacggaccgtagggtaacctaggtcgtacggtacggtaacgtaccgtaaggtaccgtaacgtggtacgggtcttacggaccctaccgtacttccgttacg

SEQ ID NO: 78016 - DNA, 781 bp, Homo sapiens
  misc_feature: GYAE6OF02GX4R6.49.28.C06.1.454.CMB.1.raw
  modified_base (120)..(120): a, c, t, g, unknown or other
  misc_feature (120)..(120): n is a, c, g, or t
  modified_base (348)..(348): a, c, t, g, unknown or other
  misc_feature (348)..(348): n is a, c, g, or t
  modified_base (461)..(461): a, c, t, g, unknown or other
  misc_feature (461)..(461): n is a, c, g, or t
tcagagtcgagagacacgaccggtgctcgatttagagctcacgtattgggtttgggggaggaacgtgctcagttaggacccagacggaaccatggaagcccagcgcagcttctctctctnctactctgctccagagaccactggagaaatgcgatgacgcagtctccacgccaccctgtctgtacgtcctaccgaaggggaaactcgccctaccctcgtccgtgaccggacgggcctaggtacgaaggtacggttaggttacgacgacggtactaacgttacggccgttacggacccgagacgtaaaccgtaaacccgtcgggacccgaacgggtccctaaccccggnggtcccttacccgttaccatttaccgtagttccgggcaaccgttaccaccccgaacgggaccggtccctaacggttggtaccaccccgtagaccccggtaaggtcgtacgggnggaccttggggttcgacgtaggacgtacgtaacggtttcccactacgttaccgaacgtacgtacgtacgtaccgaccgtccgtcgtaccgtacgtacgttaacgtaacgttagtttcgtaccgtttaagtttaacgttaccggtactacgtacggtacttaacgttaactttaacgtacgttacggttaccgtttaccgggttttacggtaaccggtaacgggtaacctacggtacgtacgtaacggtaacgttaccgtaaacggtaccgttaaggttcgtacggtaccgttccggacctaaccggtacgtacttaccgg

SEQ ID NO: 78017 - DNA, 691 bp, Homo sapiens
  misc_feature: GYAE6OF02F1FK7.49.28.C06.1.454.CMB.1.raw
  modified_base (202)..(202): a, c, t, g, unknown or other
  misc_feature (202)..(202): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccagggaaangccaccctctcctgcagggccagtcagagtgttagcagcaacttgcctggtaccagcacgaaacctcggccaggctcccgaggcctcctcatctagtggtcgcactccaccgacgggcccacgtcggtactccccgagccgtaggttccaggttcggcgtaggttggggtcgtggggacacggtagtttccacgttcctacacctatccgaggccacggcccgtcgacgtacgttacgtaggtaagttacgttttcgacgtttaagtttttaacttaccgttagttccgaacggttacttaaaggtttaacttaaacgttttaccgttacggggttactttttaccgggttttttcggggaacccggtacgggggtaaccctaaagggtcgttaagggtaacggtaacggttacccgtaacgggtaacccggtaaacggttcgggttaacggtcgttaccggacctaacccgttagttccgtttaccgg

SEQ ID NO: 78018 - DNA, 605 bp, Homo sapiens
  misc_feature: GYAE6OF02IKFVZ.49.28.C06.1.454.CMB.1.raw
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
  modified_base (372)..(372): a, c, t, g, unknown or other
  misc_feature (372)..(372): n is a, c, g, or t
  modified_base (391)..(391): a, c, t, g, unknown or other
  misc_feature (391)..(391): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaanagccaccctctcctgcagggccagtcagagtgttagcagnaacttagcctggtaccagcaagaaacctggccaggctcccaggcctcctacatcctagtcggtgcctactcccaccgagggcccagtcggtactccccagcccaggttcaggtgcaggtggctggacngtagttcacgtcacacatnacgcacgcctcgacgtagtcgtacggtaagttacgttttacgctttaagtttaacgttacgttacgtacgacgtacgtaagttaacttaacgtttacgttgtaccgtttcgttttacgggaccgtaacggggtaccaacggtcgtaggtacgtaacgtacgtaacggtacgtaacgttggtcggtactacgtaccgtaccgtacgttacgttcg

SEQ ID NO: 78019 - DNA, 679 bp, Homo sapiens
  misc_feature: GYAE6OF02JXMAN.49.28.C06.1.454.CMB.1.raw
  modified_base (191)..(191): a, c, t, g, unknown or other
  misc_feature (191)..(191): n is a, c, g, or t
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (262)..(262): a, c, t, g, unknown or other
  misc_feature (262)..(262): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggcctcccagagaccactggagaaatagcgatgacgcagtctccagcccaccctgtctgtntcctccgaagggaaagacgcccaccctctccgngcgagggccagtcagngtntagcagcattgcctgtacngctaagaacctggccaggtccctcccgaggtcctctacgactcgtatggtcacctcgtacccgaccgtcgggtaccacggtagtacctcccgagtcccgtagtacgtacgtcggcgtacgggttcgggtacgtaggggaacctacggtacgttaccgaccgttcctaccgtacccgtacgtaccgtacgtacgaccgtaccgtacgtaccgtacgtacgttacgtaaagtttacgtttcgtacgtttactttagttacgtcgtagacttagtagtttaacttaacgttcgttacggttccgttttacgggttttaccggacggtaacggggttactaacgggtacgtaggtaccgtagtaaccgtagtaaccggtacgttggtaccgggtctacgacctacggtacttcggttaccg

SEQ ID NO: 78020 - DNA, 611 bp, Homo sapiens
  misc_feature: GYAE6OF02GJYJZ.49.28.C06.1.454.CMB.1.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
  modified_base (354)..(354): a, c, t, g, unknown or other
  misc_feature (354)..(354): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaanagccaccctctcctgcagggccagtcagagtgttagcagcaacttagcctggtaccngcacgaaacctggccaggcctcccgaggtcctcctcactctagtggtcgcactccacgagggcccacgtggtactcccagccaggttcaggtgcnggtggtcgtgggacagtacgttcacttcgtccacctatcagcacgctgcgtagtctaggaacgttagtttgacgttaatttacgttaccgttgtactacgagtaattaattaacgttacgttgggttacctttcgggtttttaccgggaccgttaacggggtaacctacggtacggttacggaggttacgtaacgtaacggtaaccggttaacgttgggtaccgggtcgtaccgtactaccgtacgtttccgttacg

SEQ ID NO: 78021 - DNA, 638 bp, Homo sapiens
  misc_feature: GYAE6OF02JGQSP.49.28.C06.1.454.CMB.1.raw
  modified_base (312)..(312): a, c, t, g, unknown or other
  misc_feature (312)..(312): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaagacgccaccctctcctgcgagggccagtcagagtgtagcagcaacttgcctggtaccagcaacgaaacctggaccaggcctcccgaggcctcctcactctagtcggtcnccagtcccaaaccgtgggaccctacgtggtacctccccgagtccgtaggttcaggtcggacgtagggttgggtacaggggaactaggtacggtttccaacgttcctacgtaaccagtacgacgtacgacgtcctacgcgtacgtcgtagtaacgttagtttacgtacttagttttaacgttacgttagtactagtacgtaacgttaattaacgttacgttcggttacgtttacggttttcggaccgtaacgggtaccgtaagtcgtaggtaggtaactacgtacgtacgtaacgtgtacggtcgtccgacgtacgtacttcgtacg

SEQ ID NO: 78022 - DNA, 680 bp, Homo sapiens
  misc_feature: GYAE6OF02I90KN.49.28.C06.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaangccaccctctcctgcagggccagtcagagtgtagcagcaacttgcctggtaccagcagaaacctggccaggcctcccgaggcctcctcatctagtggtnccactccacgacgggcctacgtggtactcccgagtccgaggttcaggtcggactagggttcgggtcgtagggaactaggtacgtttccgacttccgtacctacctacttacgacgccgacgtccctacgtacgtacgtacgttaggtaaagttacgttttagtacgtttagttttaacgttaccgttacgttacgaagttacttaagtttaacgttaaagtttaccggttacgggtttccgttttacgggttttttaccgggaccggttaacggggaacccgttaacggtacggttaagggtacgtaacggtacgaaacggtaccggtaacggttaggtacggtcgtacgtacccgtacgttacgttccgttaccgg

SEQ ID NO: 78023 - DNA, 782 bp, Homo sapiens
  misc_feature: GYAE6OF02IWYJD.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgagggaagcgcccaccctctcctgcagggcagtcagtagtgttagcagacaacttacgccgtacggtaccagcaacgaaaccgtggaccgaggcctacccgaggcctcctctacttcgtagtcgggtacgacctacgtcccaacccgcggggaccctaaccgttacgggtaccttccccgacggtcccgtaggtttaccgtacgggtcgggacgtacgggttcggggtacgtggggtaactaaggtacggtttccaccgttcctacccgtaacctaacgtccgaacgtaccgtaccggtaccgtacgtacgtacgttaccgttaaggtaaacggtttacgtttttacggtacgttttaacgtttttaaacgtttaccgttaggtttaccgtaacggtaccttaaaggtttaaatttaaacgttttaacgtttcgggtttaccgtttttaccgggttttttaccgggacccggttaaacgggggtaacctaacggtacggttagggtaacggtcgtaaccgtaacgggtaaccgttaacggtcggttacgggtccgttaccgaccgttaacgtacgttacgtttacccg

SEQ ID NO: 78024 - DNA, 678 bp, Homo sapiens
  misc_feature: GYAE6OF02GDQYV.49.28.C06.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctccagagaccactggagaaatagcgatgacgcagtctccagccaccctgtctgtgtctccgaggggaaangcccaccctctcctgcgagggccagtcagagtgttagcagcaacttacgcctggtaccagcaagaaacctggccaggcctcccaggtcctcctcatctagtggngcncaccacgacgggccacgtggtactcccgagcccgagttcaggtcggactagggtgggtacgtgggactacggtatttccaacgttccgtaccaacgtactaccacgtccgacggtaccgtcggaccgtacgtaccgttagtaaacgttacgttttcggtacgtttaaggttttaacgtttacgttacgttacgtaacgtcgttaagttaacgttaagttttacgttacggttacgttttcggtttttacgggaccggttaggggtaacccttaacggtacggttagggtaacggtaacgtaccggtaacggtaccggtaacgttcgggttacggacgttaccggtacctaccgtacgtccgttaccgg

SEQ ID NO: 78025 - DNA, 609 bp, Homo sapiens
  misc_feature: GYAE6OF02GZ08U.49.28.C06.1.454.CMB.1.raw
  modified_base (204)..(204): a, c, t, g, unknown or other
  misc_feature (204)..(204): n is a, c, g, or t
  modified_base (452)..(452): a, c, t, g, unknown or other
  misc_feature (452)..(452): n is a, c, g, or t
tcagagtcgagagacacgaccggtgctcgatttagagctcacgtattgggtttgggggaggaactgctcagttacggacccagacggaaccatggaagccccagcgcagcttctcttcctcctgctactctggctcccagagaccatggagaaatagcgatgacgcagtctccagcccacctgtctgtgtctccgaggggaaangcccaccgtctcctgcagggccaggtcagagtgttagcagctaacgttacgcctcggtaccaggccaacgaaacctcgggaccacggcctcccgaggcctcctctactctagtggtcgcactccaccgacgggcctacgtgtaactccagccgtagttcgagtcggcgtaggtcgggtcgtggggactaggtacgttcacgtctacacctactgaacgcgacgtcctgactaggtcgtaagtacgttntttacgacttagtttaacttgtacgtctacggtactaaggttaacttacgttcgtaggtccgttttacgggtttcggaccggtaagggtaaccaggtcgttagggactaggacgtaaggccgtaagtggtcgctacgtccacgttactccgttacgg

SEQ ID NO: 78026 - DNA, 679 bp, Homo sapiens
  misc_feature: GYAE6OF02I3339.49.28.C06.1.454.CMB.1.raw
  modified_base (150)..(150): a, c, t, g, unknown or other
  misc_feature (150)..(150): n is a, c, g, or t
tcagagtcgagagacacgaccggtgctcgatttagagctcacgtattgggtttggggaggaactgctcagttaggacccagacggaaccatggaagccccagcgcagcttctcttcctcctgctactctggctcccagagaccactgganaaatagcgatgacgcagtctccagcccaccctgtctgtgtcctccgagggaaagacgcccacctctcctgcgagggccagtcagagtgttagccagacaacttcgccgtggtaccagacgacgaaaccgtggaccgaggcctccgacggctccctcattctagtggtcgaccactccgaccgacggtacctacgttcggtaccgtacccgcgtaccggtacggtacgtcggtcggcgtaggttcggtcggtacgggactacgtacgtacctaccgtcctaccgacctaagtccgacgtcccaacgtcccgtagtaccgtaggttcgtaacggttaacgttacgttttacgacgtttaagttttcgttacgttcgtacgtacggttactaacgttaagttacgttacggttccggttacgttttacgggttttaccggaccggttaacgggactaccggtacgtacggtaacgtacgtacggtaaacgtcggttaacgtgtcggtactcgaccgtcttaccgtcgttacg

SEQ ID NO: 78027 - DNA, 635 bp, Homo sapiens
  misc_feature: GYAE6OF02HNUH3.49.28.C06.1.454.CMB.1.raw
  modified_base (204)..(204): a, c, t, g, unknown or other
  misc_feature (204)..(204): n is a, c, g, or t
  modified_base (316)..(316): a, c, t, g, unknown or other
  misc_feature (316)..(316): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagngcccaccctctcctgcgagggccagtcagagtgttagcagcaacttacgcctggtaccagcaacgaacctggaccaggcctacccgaggcctccgtcattcctagtcggtcnctactcccaaccgacgggccctacgtggtaactccccgagccctaggtttccgaggtcggacgtagggttgggtcgtagggacctaggtacgtttccacgttcaccacctatcgacgtcacgtccctgacgtagtcgtagtaacgtttactttagacgtttagttttaacgttacgttgtaccagttacttaagttaattaacgtttacgtggttacgttttcggtttacgggacccgaaggggtacctaggtcgtaggtacgtacgtacggaacggtacgtaacgtggtacgtcgtacgtaccgtactagttcttacg

SEQ ID NO: 78028 - DNA, 764 bp, Homo sapiens
  misc_feature: GYAE6OF02FZQZN.49.28.C06.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccacctgtctgtgtctcgagggaangccaccctctctgcagggccagtcagagtgttagcagcaacttgcctggtaccagcaacgtaacctggaccaggcctcccgaggcctccnctatctagtggtcgcacgtcccgaacgacgggcctacgtcggtacctcccgacgccgtaggtttacgacggttggacgtaggttccggggttcgacgggggtaaccagggttacctttccgaaccgtttctaccccgtaacgtacttaccgacgtaccgtaccgcccgttggaaccgttccgtaacgtagggtaaacgttttacggtttttacgtaacggttttaaacgttttttacgttaacccggttagttacccggtaaaggtacgttaaaggtttaaaactttaacgtttaacggtttaccgggttaccgtttttttacgggggttttaaccgggacccggggtttaacgggtaaaccgttaacgggtacgttaacggggacgttaaacgtttacgggaaaccgggtaccggttaacggttcgggtaacgttccgtaccgtacccgtacgtttaccgttccgtttaaccg

SEQ ID NO: 78029 - DNA, 851 bp, Homo sapiens
  misc_feature: GYAE6OF02H06WX.49.28.C06.1.454.CMB.1.raw
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagcccacctgtctgtgtctcgaggggaagacgccaccctctcctgcgagggccagtcagagtgtagcagacaacttagcctaggtaccagaccagaaaccgtggaccaggcctcccgaggcctcctnactctagtggtcnctactacccgacgacgggacctacgtcggtaactccccgagtcccgtaggttaccgaggtcgggaccgtaggggtacggggtccgtagggggaacctagggttacgttaccgtaccttaccgtaccgtaaccctagtacgtaaccgtaccgtaaccggtcccgtacgtcccgtaacggtttaccgtaagggttaaacggtttacgttttttacggaaaccgtttttaacgtttttaacgtttaccggtttaacggtacgttaacggttaaccggtttaaaggttttaaaaccgtttaaacgtttttaaaccgggtttccggggtttttaccgttttttaaccggggtttttttacccggggaacccgggttaaaaccggggggttaaccgttaaccgggttaccggtaacgggttaaacgggtaaacgtttaaccggaaacggggttaacccggttaaccggtttaccgggttacggggtaccgttaaccggtaaccccccgtaaaccggtttaaccgttttacccgttttacccggg

SEQ ID NO: 78030 - DNA, 733 bp, Homo sapiens
  misc_feature: GYAE6OF02I6JTF.49.28.C06.1.454.CMB.1.raw
  modified_base (204)..(204): a, c, t, g, unknown or other
  misc_feature (204)..(204): n is a, c, g, or t
  modified_base (680)..(680): a, c, t, g, unknown or other
  misc_feature (680)..(680): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtcgtctccgagggaaancgccacctctcctgcacggtccagtcagagtgttacgcagactaacttagccttaggtaccagacaacgtaaaccgtggacccaggacctaccgaaggtcctaccgtcgtaactaccgttaagtcggttacgaccgtacgttcccgaaccgtacgggtacctaacggtacggttaacctccccgaagcccgtaagggtttccaacgggttcggacgtaacgggttcggggtacgttacgggggactaacgggtacgtttaccgaaccgttccgtaacctaaccgtaacgttacccgaaaggtccctaacgggtacccgtacggtaccgtacggttaaccgttaggtaaacgttagttttacggactttaacgtttacgttaacgttgtaactacgtataacggttaacttaagttacgtaggttaccgtttggtttacggacggtaacgggtacctaaggtcgtaaggtaacgtangtacgtaacgtacgtaacgtacggtacggtacgtacgtacgtacgtacgtacg

SEQ ID NO: 78031 - DNA, 693 bp, Homo sapiens
  misc_feature: GYAE6OF02IS872.49.28.C06.1.454.CMB.1.raw
  modified_base (439)..(439): a, c, t, g, unknown or other
  misc_feature (439)..(439): n is a, c, g, or t
tcagagtcgagagacacgaccggtgctcgatttagagctcacgtattggggtttgggggaggaactgctcagttaggacccagacggaaccatggaagccccagcgcagcttctcttcctcctgctactctggctccagagaccactggagaaatagcgatgacgcagtctcagccacctgtctgtgtctccgaggggaaagagcccaccctctcctgcgacgggccaggtcagagtgttagcagcaactagcctggtaccagcaacgaaccgtggccaggcctcccgaggcctcctcatctagtggtcgcacgtaccaccgacgggcccacgttcggtaactccccgaaggtccctagggttccagggtcgggccgtagggttccggggtagttcgggggaacctagggtagttaccctaccgttcctaccaaccgtntaccgacggaccacgggtccctgggactacggttacgtaaggtaagtttacgttttaggaacctttagttttaactttaccggttacgtacgtacggtacgaacggtcggtaacgtacgtaacggtcggtacccttaccgttacgttaaccggtttcgggaccgggtacgggtaccgtaagggggttacgaacgtacgtaaaccgaaccggttacgtacgggtaccggcgttacggacctaaccgtcgttaccg

SEQ ID NO: 78032 - DNA, 628 bp, Homo sapiens
  misc_feature: GYAE6OF02FJ8VL.49.28.C06.1.454.CMB.1.raw
  modified_base (418)..(418): a, c, t, g, unknown or other
  misc_feature (418)..(418): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaacgagcccaccctctcctgcagggcccagtccagtagtgttagcagccaacttagccttggtaccagcaacgaacctggccaggctcccgaggctcctcatctatggtgcactccgaccacggggccacgttcggtactccccgagcctacggttcaggttcggcgtagggtcgggtcgtagggactaggtacgttcaacttcctaccgaaccctntacgacgcgacgtaccgtggcagtctacggtaacgtagttttagacgtttagtttaagtttactgttactacgacgttaacgttaattaagtttacgtcggtttcgtttacgttttcggaccggtacgggaaccgtagcgttaggacgtaagtacggaaacggtcggtaacgttggtcggtctacggtacctaccgtacgttcgttccgg

SEQ ID NO: 78033 - DNA, 699 bp, Homo sapiens
  misc_feature: GYAE6OF02IPEIZ.49.28.C06.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaanagcccaccctctcctgcagggccagtcagagtgttagcagcaacttagcctggtaccagcaagaaacctggaccaggctcccgagcctcctnatctagtggtncatcccgacagggcccacgttggtacctccccgagccgtagggtttccaaggtcggacgtaaggggtttcggggtacgtagggggaaccaaggttaccgttccaaccgttccctaccaaccctaatccgacggtaccacggtcccgtagaccgtacgtaccgtaggtaaacgttagtttttacggactttaaacgtttttactttaaccgttgttaccgtacgtacgttaaaggttaatttaaacgtttacgttcgggttacgtttttaccgggtttttacgggacccggtaacgggggtaacctaacgggtcggttagggaacgtaacgttaaccggaaggtaccggtaacgttcggttcggacttcggaccctaaccgtattaccgttcg

SEQ ID NO: 78034 - DNA, 692 bp, Homo sapiens
  misc_feature: GYAE6OF02FP0MD.49.28.C06.1.454.CMB.1.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccgaggggaaangccaccctctcctgcagggccagtcagagtgtagcagacaacttacgcctggtaccagacagaaccgtggccaggcctccgaggcctcctcgatctagtcggtnactacgtccaccgacgggccaacgtcggtacctcccgagccgtaaggttcaggtgcgtacggtggtcgtgggacaggtacgtcacgtcctaccacgtactacgagcgacgccgtcgacgtacgttactaggtaacgttacgttttacgtacgtttacgtttttaacgttacgttacggttactaacggacgtttaaagttaacgtttaaacgtttaccggttaacgggtttcccgttttacggggtttttaccggaacccggggttaacggggtaaccctacggggttacggtacggtaacgtacggtaacgtaaaccgggtacggtaacggtttggtaaccgggttcgtaccgtacccgtaaccgttacgttcccgtttaacg

SEQ ID NO: 78035 - DNA, 689 bp, Homo sapiens
  misc_feature: GYAE6OF02JKJWS.49.28.C06.1.454.CMB.1.raw
  modified_base (249)..(249): a, c, t, g, unknown or other
  misc_feature (249)..(249): n is a, c, g, or t
  modified_base (343)..(343): a, c, t, g, unknown or other
  misc_feature (343)..(343): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagcccaccctgtctgtgtctccgaggggaaacgagccctaccctctcctgcgagggcccagtccagagttgttacncacggacaactttacgccgtaggttaccagcaacgaaacctcgggccaaggcctacccgaggctccgtcatctatcggtcgctacgtccaccgngggcccagtcggtactcccgacgcgtacggttcaggtcggtcgaggtttcgggtacgtgggaacaaggttacgttccgaaccttccgtaccaacctacgtacacgtccaacgtccgtacgacgtaggttaccgtaggtaaacgtttagtttccgaacgtttacggttttacttaaccgttgtaacgtaccgtataacggtttaacttaagttttccgtggtttaccgttttcgggttttaccggaaccggttaacgggaaccgttaggtacgtacgggtacgtacgttaacggaacgttaccgttaacggttgtcggtacttccgacctaaccgttgtactttccg

SEQ ID NO: 78036 - DNA, 634 bp, Homo sapiens
  misc_feature: GYAE6OF02HF3Y2.49.28.C06.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagataccatggagaaatagtgatgacgcagtctccagcccaccctgtcctgtgtctccgaggggaaangtccaccctctcctgcgaggccagtcagagtgtaggagcacttagcctggtatcgagcagaacctggccaggcctccaggctccgtcatctatggtnccatccaccgacgggccacgtggtacctcccgagccgtaggttcgaggttggactgggtcgggtctacggggactaaggtcgtttaccaccttcgtaccacctaagtcgaacgcacgtcccgtgacctagtcgtaggtagttatttcggcttaaggttttactacgttagtcaggtactaagtacttaacgtccgggtaccggtacgtcccgttacggttaccggttccgggacggggtaaccgggaccggaacgggtacgggaactaacggtaaccggaaaacgtaccgttgggttaccgcggtagtacccgacgttacgttcgtacccgg

SEQ ID NO: 78037 - DNA, 718 bp, Homo sapiens
  misc_feature: GYAE6OF02HOU67.49.28.C06.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaangccaccctctcctgcagggccagtccaggagtgttagctaagcaacttagcctggtaccagcaagaaacctggccaggctccgagctcctcatctatggtncatccaacgcggtccacgtggtactccccgagtccgaaggttacnggtcggtacgaggttacgggtcgttacggggacaaggtagtttaccaccgtttctacctaccgattacgaacgtcgaacgtccgtacgtccgtagttacctaggtaaagttaacgttttaggaaccgtttaaggttttaaacgtttaccgttaccgtttaacgtaaccgtacgttaaacgttaacgtttaaacgtttacgtttaccgggttacgttttttccggttttttaccggggacccggttaaacggggtaacccgtaaagggtaccgttaagggtaacgtaacgttaaccgtaaacggggtacctaaccggttacgggttacgttacccggtaggtacctaacccgtaacgttcgtttaaccgg

SEQ ID NO: 78038 - DNA, 659 bp, Homo sapiens
  misc_feature: GYAE6OF02JH08G.49.28.C06.1.454.CMB.1.raw
  modified_base (202)..(202): a, c, t, g, unknown or other
  misc_feature (202)..(202): n is a, c, g, or t
  modified_base (327)..(327): a, c, t, g, unknown or other
  misc_feature (327)..(327): n is a, c, g, or t
  modified_base (378)..(378): a, c, t, g, unknown or other
  misc_feature (378)..(378): n is a, c, g, or t
  modified_base (601)..(601): a, c, t, g, unknown or other
  misc_feature (601)..(601): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctcagccacctgtctgtgtctccgagggaaagngcccacctctccgtgacagggccagtccagtagttgtacgcaggcctaattacggcctagggtaccagcgaacgtaaccgtggccaggtccctacccgaggtcctaccgtctatcgtaagtcggnaccgatcccgaccgaggccaacgttggacctacccgtagccgtacggttanacggtcggactagggtcgggttacaggggacctaggtacgtttacgacttccgtaccgtaacctacgccgtacggacgaccggttaccgtacgaccgtagtacgtaaggttaacgttacgtttacggtacttaggttttaccttacgtgttacgtacgtacgtaagttaacttaacgtttacgttacgttacgtttacggtttcgacggtaacggacgtacgngtacggtagaacgtcgaaggtaccgagtacggtgtcgtacgacctactacgttcgtcg

SEQ ID NO: 78039 - DNA, 842 bp, Homo sapiens
  misc_feature: GYAE6OF02IF9KB.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaataggcgatgacgcagtctaccagcccaccctgtctgtgtcctccgaggggtaaagacgccaccctctcctgcagggccagtacacgtagttcgttacggcagtactaacgttacggccgtaggttaacccaaggtacaacgtaaaacccgtcgggacccacggtcccttacccgaacgggtcctaccctacgtacgttaccttaaggtcggtacgctaacctcccgaaccggtaacggggtaccctaacgttacgggtaacctaccccggtaacggtaccccgttaagggttaccaagggtcggtacggtaacgggttcgggtttaccggtacggggaaccgttaggtaacgtttcccgaacgttacccttaaccgacctaacgtttaccgacggtaacccgacggttccgacggtaaccgtacgttaccggtagttaacggtttagttttccgtaaacgtttaaggttttacgtttaacgttcgacgtaaacgtacgttaaacgttaacgttaacttttacgggttacggttcgtttttacggtttttccgggaacccggttaacggggtaaccgtacggttaccgggtttaagggaacgtttacgtaaccgggtaacggtaacccgtttaacggttcgggtacggttaaccttgggaaccccttacgttacgttaccgtttacccg

SEQ ID NO: 78040 - DNA, 666 bp, Homo sapiens
  misc_feature: GYAE6OF02IVFTS.49.28.C06.1.454.CMB.1.raw
  modified_base (231)..(231): a, c, t, g, unknown or other
  misc_feature (231)..(231): n is a, c, g, or t
  modified_base (380)..(380): a, c, t, g, unknown or other
  misc_feature (380)..(380): n is a, c, g, or t
  modified_base (546)..(546): a, c, t, g, unknown or other
  misc_feature (546)..(546): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggcctcccagacgacccactggacgaaaataggcgatgaccgcagtctccagccacccttgtcctgtcgtcctacgaagggggtaaacgcgccacccttcncctgcgagggcctagtacgagacgttgttagcgagctaacgttagcctagtaccagacaacgtaaactcggacacggcctccgaggtcctaccgtctagtctaggtgggtcaccgtactaccgacgaccggcctaccgttacggtaccnccccgtaagacccgttaggttacgagtacgggctacgggtgggtctaacgggactaaggtacgttccgtacttaccgaactactacgtacgacgtcgaacgtccgtagtcgtacgtcgtaacggtagttacgtttcgtaaacgtttattacgttaccttacgtacncgtacgtaagtattaacgtttactcggttactttcgggtttacgacggtaacgggtacgtagtcgtagacgtactaacggagtccgtaagtgtcggtacctcgacgtacgtacgtctcgg

SEQ ID NO: 78041 - DNA, 922 bp, Homo sapiens
  misc_feature: GYAE6OF02I16I8.49.28.C06.1.454.CMB.1.raw
  modified_base (168)..(168): a, c, t, g, unknown or other
  misc_feature (168)..(168): n is a, c, g, or t
tcagagtcgagagacacgaccggtgctcgatttagagctcacgtattggggtttgggggaggaactgctcagttaggacccagacggaaccatggaagccccagcgcagcttctcttcctcctgctactctggctcccagagaccactggagaaatagcgatcgacgnagtcctccagcccaccctgtctgtacgtcctaccgagggggaaacacggcccaaccccttctccctggccgacgggcctaagtcgaggtacggttgttaacggcacgtacaaaccgtttagcccgtaggtaaccaggacctaaacggtaaaccgttcgggaccctaacgggccctaccccggagggtcccttacccgtacctacttaaccggttagtcgggttaccgacctaactaccccgaccgggtacgggaccctaacgtcggtaacctcccgagtccgtacggtcaggttcgacgttacgggtacgggtcgtacgggactacggtacgtttacccgacttacctaaccgtaccgtacgtacaaccggtaccgtaccggtaccgtacggtaccgtacgttaacgggttaacgtaaacggttttagttttaaccgggtaattttaacccggtttttaagttaaccgttaccgggtttaccgtaaaccggttacgtttaaaccgggttttaaacctttaaacggttttacccggggttaaccgggttttacccgttttttccggggggtttaaccggggtacccgggttaaaaccggggggttaaccctaggggttacccgggttaacgggttaaccggtaaacccggttacccgggtaaacgggtaaccggtttaaccggggttcgggtaaccggttacccgggttaaccgggtaaccctaaccccggtttaccggttaggtttaaccccgg

SEQ ID NO: 78042 - DNA, 840 bp, Homo sapiens
  misc_feature: GYAE6OF02HSDOZ.49.28.C06.1.454.CMB.1.raw
  modified_base (245)..(245): a, c, t, g, unknown or other
  misc_feature (245)..(245): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatggacgcagtctccagccaccctgtctgtgtcctccgaaggggaagcgcccaccctctcctgcgacggccagtcagagtgttagnacgcaacttacgccgtaggtacccaggaccaacggaaaccgtcggccgacggccctacccgaggtcctccctcattccttaggttcgggtacgacctacctcccgaacccggacggggaccctaccggttcgggttacctccccggacggtacccgtaacgggtttccaagggtcgggaccgttaggggttcggggttacggtacgggggtaacacggggttactttcctaacccggtttcccaaccctaacccgtaactcgtaacccggtacgtaccggtcccgtccggtaccttaggttaccgtaagggtaagtttacgttttacggtaccgtttttaagtttaacgttttaccggtacgttactaacgtacgttaaacgttaagtttaaacggtttacggttacggttttaccggttttacccgggttttttaaccggggaccgggttaaacccgggggtttaaccgtaaaccgggttccggttaaggggttaacccgtaacggttacccgggaaacgggtaaccgtttaacggggtccgttacggggttaccgtcccggttaaccggtaccgttcccgtttaggtttcccc

SEQ ID NO: 78043 - DNA, 757 bp, Homo sapiens
  misc_feature: GYAE6OF02G4EO9.49.28.C06.1.454.CMB.1.raw
  modified_base (202)..(202): a, c, t, g, unknown or other
  misc_feature (202)..(202): n is a, c, g, or t
  modified_base (306)..(306): a, c, t, g, unknown or other
  misc_feature (306)..(306): n is a, c, g, or t
tcagagtcgagagacacgaccggtgctcgatttagagctcacgtattggggtttgggggaggaactgctcagttaggacccagacggaaccatggaagccccagcgcagcttctcttcctcctgctactctggcctccagagaccactggagaaatagcgatgacgcagtctcagccacctgtctgtgtctccgaggggaancgccacctctcctgcgaggcatcagagtgttagcagctaacgttacgccgtaggtaccagacgaaacgtaaaccgtggacccaggtccctccgacggcctaccnctactcgtagttcggtcgcctactccccgaacgcggggaccctacgtcggtacctcccgacggtaccgtagggtttacgacgggtcggtaccggtagggtaccggggtttcggtaacggggaacgtaagggttaccggttactaccgttcctaccgaccgtaactcgtacgacgtaccgtccgttagcgtcgttacgtaaggttaacgttacgttttacggtactttaacgtttttacttaacgttacggttacctaaggtaccttaacggttaactacgtacgttaacccggtacggacccgtaaccggttcgtttaaacccgtttacgggtttaaccgacccggggtaacgggtaaccccgtaagggttccggttaacggtaacccgttacgtaaacggtttcccgttaccgggtaactttcggggtaccgttcccggacttaacccgg

SEQ ID NO: 78044 - DNA, 737 bp, Homo sapiens
  misc_feature: GYAE6OF02GJ4TV.49.28.C06.1.454.CMB.1.raw
  modified_base (204)..(204): a, c, t, g, unknown or other
  misc_feature (204)..(204): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagcccaccctgtctgtgtctccgaagggaangcccaccctctcctgcgagggccaggtcagtagttgtagcagactaacgttcgccgtaggtaccagaccaacggtaaccgtcggacccgacggaccctacccgaggtcctccgtcctattccgtagttggtcgcctactcccgaaccggacggacctacgttcggtacctccccgaacggtcccgtacgggtttccgaggtccgggtacgtacgggttcggggttacgtcggggtaacgtaggttacgtttaccgaccgttaccgtacctaactacgtaccgacgtccgtaccgtcccgtacggtaccgtacggttacgtaaggttaacgtttagtttacggtacgtttaagttttacgttacgttcgtaaccgtacgttaacgtaagtttaagtttacgttacgttacgggtttccgttttaccgggttttccggacccggtaacggggtaaccttagggacgtacggtacgtaacgtacggaacgtcggtaacgtggtacgtcgtacgtaccgaccgtagttccgttaccg

SEQ ID NO: 78045 - DNA, 685 bp, Homo sapiens
  misc_feature: GYAE6OF02HWW57.49.28.C06.1.454.CMB.1.raw
  modified_base (204)..(204): a, c, t, g, unknown or other
  misc_feature (204)..(204): n is a, c, g, or t
tcagagtcgagagacacgaccggtgctcgatttagagctcacgtattgggtttgggggagaactgctcagttaggacccagacggaaccatggaagccccagcgcagcttctcttcctcctgctactctggctccagagaccactggagaaatagcgatgacgcagtctccagcccaccctgtctgtcgtctccgaggggaaancgcccaccctctccgtgccgagggccagtcagagtgtagcagctaacgttgcctggtaccagacacgaaccgtggccaggcctcccgaggtcctccctactacttctaggttcggtcgacctactacccgaccggacgggtccctaacggtcggtacctaccccgagtacccgttaggttaccgacgggttcggtaccggtagggttcggggtaccgtacgggggaactaacgggttacgttacccgaccgtttccctaccgacccgtacgtaccgaacggtcctaccggtacctcgtacgtacgttacgtaacggtagtttacgtttcgtacgtttaagttacttacgtcgtacgtaacgtacgtaagttaacttacgttacgtcggttacgtttcggtttaccggacggtaacgggactacgtcgtaggacgtaacgtgtaacgcgtacgtcggtacgtctcgtaccacgtctcttacg

SEQ ID NO: 78046 - DNA, 679 bp, Homo sapiens
  misc_feature: GYAE6OF02HM6P0.49.28.C06.1.454.CMB.1.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggcctcccagagaccactggagaaatagcgatgacgcagtctccagcccaccctgtctgtgtctccgaggggaaancgcccaccctctccngcagggccagtcaggatgtancagacaacttagcctggtaccagaccaagtaacctggaccaggcctcccgaggtcctacctcgtactcgttagtcggtacgacctactcccgaccgacggggccctaacggtggtacctccccgaagtccccgtaagggtttccaaggttcggggactagggttcggggtcgtaggggaacctagggtacgtttacccacgtttccaccgaccctataccgacgaccgtacgaccctcgcgtacgtacgtagtaagttacgtttagtactttagtttacttacgtgtacgacgtacgtaagttaacttattaccgtcggtttcgtttacggttttaccggaccggtaacgggtaaccgtaggtaccgttaggtacgtaactacggaacggtaccgtaacgttggtacggtctacgacccgtaacgttctacgttacg

SEQ ID NO: 78047 - DNA, 779 bp, Homo sapiens
  misc_feature: GYAE6OF02JNAPH.49.28.C06.1.454.CMB.1.raw
  modified_base (206)..(206): a, c, t, g, unknown or other
  misc_feature (206)..(206): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagcccaccctgtctgtgtcctaccgaggggaanacgccaccctctcctgcgagggccaggtcaggagtgttacgcgcgactaacttacgccgttgggtaacccagcgtaaaccgtaaacccgtgggaccccgagggtccctacccccggtaagggcccttacccttacccagttaccgttaaggttgggtaccgaccgtaaccttccccgaaccggtaacgggcccgttaacgttaccgggttaacctacccccggacgtacggtacgggtttaccgaagggtccggggtttagtaaccggggttcgggtttaccgacggggggtaactaccggggttacgtttacctaaccggttccgtaccgtacccggaacttccggaacgtaccgtccggtacctacggtaccgtacgttaccgttaacgggtaacgtttcggtttaacgtaccggttttacgtttaacttaccgttcggttaccgagtacgtttaagtaacgtttacgttagtacgggtttccttttacggtttcggaacgttagggaccaggttagtacggtgtacacggttacgacgtaacgtgaccgtctagcctacggtattcgtac

SEQ ID NO: 78048 - DNA, 741 bp, Homo sapiens
  misc_feature: GYAE6OF02JNNGK.49.28.C06.1.454.CMB.1.raw
  modified_base (205)..(205): a, c, t, g, unknown or other
  misc_feature (205)..(205): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctccagagaccactggagaaatagcgatgacgcagtctccagccaccctgtctgtgtctccgaaggggaaacncgccaccctctcctgcagggcctagtcaggagtgttacgcagcaacttagcctaggtaccagtacaacggtaaacctggcccagggcctacccgacggtcctaccctccgtacgtctacggttacgggtcacgtactacccgaccgtacgggccctaacgttcggtaacctccccgaacgtccgttaacggtcacgggtacggcgtaggggttggtcgacggggaactacgggtacttcgacgtcctaccgtacctagtccgacgtacgaccgtcgtacgaccggtacgttcgaaggttaaacgtagttttacggtacgtttaggtttttaaccgtacgttacgggtaactacgggtaactttaacgttaacgtttaaccgtttacggttaacgggtttccggtttttaccgggttttcccgggacgggtaaaccggtccgtaagtcggtttaacggacgttaacgtaaccgtaacgggtaacttaccgggtacgtacgggtacctccggaacctaccgtttacgtcgtttacccg

SEQ ID NO: 78049 - DNA, 705 bp, Homo sapiens
  misc_feature: GYAE6OF02GUH56.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctaccgaggggaaagcgcccaccctctccgtgcagggccagtcagagtgtagcagacacttgcgtaggtaccagcaacgtaaacctggacctaggcctacccgaggtcctcctcagtcttagtggtacaccactaccgaccggaggaccacgttacggtactcccaacggccgtaggttccagggtcggtaccgtagggttcgggtcgtaggggaactagggtacgttccaaccttcgtaccaaccgtcgtacacggtaccacggccgtacgactacgtacgtaaggtaacgtttacgttttacgtacgtttaacggttttacgtttacgttaccgttacctacggttacgttaaggtttaacttaacgtttacgttcggtttaccgtttttaccgggtttttaccgggaaccggttaaacggggacgttacggttacggtacggtaagtaaccgtaacggacggtacgtacgtggttacgggtactaccggtaccgacgtttacgtgtttaccg

SEQ ID NO: 78050 - DNA, 907 bp, Homo sapiens
  misc_feature: GYAE6OF02JLE8G.49.28.C06.1.454.CMB.1.raw
  modified_base (202)..(202): a, c, t, g, unknown or other
  misc_feature (202)..(202): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctccagagaccactggagaaatagcgatgacgcagtctccagccacctgtctgtgtctccgaggggaaanacgccaccctctcctgcgagggccagtcagagtgttagcagcaacgttagccgtaggtaccagacaacgtaaaccgtggaccgacggcctaccccgacggcctacccgtactacttccgttacgtgggtcgtacctaccgttaccccgaccggtacgggtccctaacggttacggtaccgttccccgaggtacccgtacggtttaccgacgggttacggtacggtaacgggttcgggttacgtacggggggtaacctaagggttaccgtttacccgtaccgttacccgtttaccgaacccgtaacgtacccggtaaaccggtaccgtaaccgggttccccgttaacgggtacccgttaacggggttacccgttaaagggttaaacggttttaccgtttttacggtaacccggttttaacgttttttaaacggtttacccgttaggtttaaccggtaaccggtttaccggtaaaggtttttaacgtttaaacccggttttaacggtttaccgggtttaccgtttttttaaccggggtttttaccggggaaaccccggtttaacgggggtaaacccgtttaacggtccgggttttaaagggaaccggtttaaccgggttaaccgtaaacgggtaccggttaaccggtttgggtaccgggttacccgttaccggtacccggttaaccctaggttttcccgtttaccgg

SEQ ID NO: 78051 - DNA, 684 bp, Homo sapiens
  misc_feature: GYAE6OF02FL9CE.49.28.C06.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
tcagagtcgagagacacgaccggtgctcgatttagagctcacgtattggggtttggggggaggaactgctcagttaggacccagacggaaccatggaagccccagcgcagcttctcttcctcctgctactctggctcccagagaccactggagaaatagcgatgacgcagtctccagcccacctgtctgtgtctcgaggggaaangcccaccctntcctgccagggccagtcagagtgttacgcaggctaacttagcctggtaccagcaagaacctggaccagctacccaggctcctcatctatggtgcactccaacgcgggaccacgtggtactcccgagccgtaggttccaaggttcggacgtaggtcggggtctacggggtacaaggtacgtttcgaccttacgtcaacctacgtacaaacgcgaagtccctggctagtactaggtaaacgtgttttaccgagtttaacgttttaattaccgtgtaacctaggtactaagttaacgttaaagtttaccgttaggttaccgttttacgggttttaccggacccggttaacgggggtaaccagggttaccgtagggtaaccgggttaagttaacccggtaaacgggtaccgtaaccgtttacggggtacgaccggtacgggttaaccctaacccggttacgtttccgtttccg

SEQ ID NO: 78052 - DNA, 721 bp, Homo sapiens
  misc_feature: GYAE6OF02H108J.49.28.C06.1.454.CMB.1.raw
tcagagtcgagagacacgaccggtgctcgatttagagctcacgtattgggtttggggggaggaactgctcagttaggacccagacggaaccatggaagccccagcgcagcttctcttcctcctgctactctggctcccagagaccactggagaaatagcgatgacgcagtctccagccacctgtctgtgtctccgaggggaaagagccaccctctcctgcagggccagtcagagtgttagcagcaacttagctaggtaccagcaagaaacctggacccaggcctccgaggcctccgtcatctagtgggtgccatccaccgagggccacgtggtactcccagcctaggttcacgtggacgtaggtgggtccgtaggggactaggtagttaccaacgttcctaccgaaccctattaccgacggacctaaccggcccgttacgccgtaagttaccgtaaggtaaagtttacttttacggtacgtttaagtttttacgttaccttacgttacctaacgggtacgttaaagttaaagtttaacttttaacggtttaccggttacgtttttaccggttttttacggggaaccccgggttaaagggggtaaccccttaagggtaccgggttaaggtaacggtaaacgttaaccggaaacgggtaccggttaaacggttagggtacgggttcgtaccggtaaccgtaaccctacgttccgtttaaccgg

SEQ ID NO: 78053 - DNA, 732 bp, Homo sapiens
  misc_feature: GYAE6OF02G30SW.49.28.C06.1.454.CMB.1.raw
tcagagtcgagagacacgaccggtgctcgatttagagctcacgtattggggtttgggggaggaactgctcagttaggacccagacggaaccatggaagccccagcgcagcttctcttcctcctgctactcgtggctccagacgaccactggagaaatacgcgatgacgctacgtctccagcccacctgtctgtcgtctccggagggaaagcgcccacccgtctaccgtgaccgacgggcctagtcgaggtagttcggttacgcaagtactaacgtacgccgtacgtaaccagacgaacgtaaaaccgtcggaccgacggtcctaccccgaacggtccctccgttacgaacgttcgtaacggtcggtacgtacctactacccgaccgtacggcctaacgtacggtaccgtacccgaacgtccgtaggttaccgaggtcgggactaggggtcggttacggacggacgtagtacgttcgacgttcaccgtactatcgacgtccgacgtcgtacgaccgttagtacgtaggtaacgttagtttacgtaacgtttacgtttaacttacgttcgttaccaggttaccgttaaaggttaactttaagttaccgtccggttccgtttacgggtttaacggaccggtaaccgggtacgtaccggtagtaacgtacggtaacggtcgtaaacggtcgtaacgtcggtacgtcgttaccacggtttaccgtacgttcgttacg

SEQ ID NO: 78054 - DNA, 914 bp, Homo sapiens
  misc_feature: GYAE6OF02FOSWE.49.28.C06.1.454.CMB.1.raw
  modified_base (202)..(202): a, c, t, g, unknown or other
  misc_feature (202)..(202): n is a, c, g, or t
tcagagtcgagagacacgaccggtgctcgatttagagctcacgtattgggtttgggggaggaactgctcagttaggacccagacggaaccatggaagccccagcgcagcttctcttctcctgctactctggctcccagagaccactggagaaatagcgatgacgcagtctcagccacctgtctgtcgtctccggagggaaancgaccctaccctctccgtgccgacgggtccagtccagtagttgttacgacaggacctaacgttaccggccgttacggtaaccaggtaccgtaaaacggtaaaccccggttcgggaccccgtaaccggggtacccctaacccgggtaccggttaccccttaccgttaaccgttacgttaccgggttaggttaccgggttccaaccctttaacccggaaccccggtaccgggtaacccgggtaccgtttaaccgggttaacccggttccccgttaaccccggaccggttaccggttaaccggggttcggtaaccggggtccggtaaggttccgggggttaccgggtaacgggtacggtaaccggtaggttaacccgttacgttacccgtacccggttaccaaccgtacgacgtaccggtaccggtcgttaccgtacggtacgttaacgtacggttaaacggtttaccttcggtttacgtttaacgtttacgtttacgttcccagggtaactaacgttaacgtttaactacgtttaccggtcgggttttacgtttccgttttaaccgggggtaccccaaaggggtaaaccgttaaccgtcgggttagggtaaaccgtcggtaaacccggtaaggacccgtttagggtacccggtttaacccgggcttaccccgggttagaaacccctttccgggttacggttccctttaacccgg

SEQ ID NO: 78055 - DNA, 736 bp, Homo sapiens
  misc_feature: GYAE6OF02J0L8P.49.28.C06.1.454.CMB.1.raw
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccacctgtctgtcgtctccgagggaagacgcctacccgtctccgtagcgacgggccagtcgagtagtcgtagcagctaacgttacgccgtagtaccagactaagaaccgttggccaggccctaccgacggtcctcctactacgttactacgtacgggtcacgtacctacccgacgggttaacggcctaacggttcggtaacctccgaccgaccggtagtaccgaggtacggtgtaacggggttcgggttacccggagggtaacttacggtacggttacccgtacctaccgttacccgaaccgtacggtaccctaacggacccgtaacgttccgtacgtaccgtacgttaacgtaggtaaacgttagtttcggtacctttaagtttaaccttcgttataccgtagtacgttaagttaacgttaacgttaccggttggttccgttttacggtttacggccgggttaacgggaaccgttaacgtgggttacgtaaggtaccgtaacgtaacggttaccgtaacgttcggtacgactaccggtactaccgttaccgtactttacg

SEQ ID NO: 78056 - DNA, 719 bp, Homo sapiens
  misc_feature: GYAE6OF02JL5QV.49.28.C06.1.454.CMB.1.raw
  modified_base (247)..(247): a, c, t, g, unknown or other
  misc_feature (247)..(247): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctcagccaccctgtctgtgtctaccgaggggaaagacgcccaccctctccgtgccgagggccagtcagtagtgttacncgagacctaacttgacccgtacggtaccgagacgaacgaaacccgttcggacccgacgggtcccctacccgtacgggtacccttaccccgtaaccgtaccgttaccgttagttaccgggttcgtaccgtacctaccccgaaccggtacgggaccctaccgttcggtacctccccgaacggtccgtacggttcgtaggtcggtacgacggttcgggtacgacggggtacagtccgttaccaccgttcgacctaaccgtgtaccgtacgaccgtacgtcgtacgtacgtagtacgtaggtaagttcgttacggtacttagtttacgttacgttacgtactacgtacgttaacgttaacttacgttacgttcggttacgtttcggtttacggaccggttaggacgttaggcgttaggacgtacgtacgtacgacgtacgttacggtcgtacggtactaccgtacgtagtccgtcg

SEQ ID NO: 78057 - DNA, 734 bp, Homo sapiens
  misc_feature: GYAE6OF02FK9MY.49.28.C06.1.454.CMB.1.raw
  modified_base (217)..(217): a, c, t, g, unknown or other
  misc_feature (217)..(217): n is a, c, g, or t
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
tcagagtcgagagacacgaccggtgctcgatttagagctcacgtattgggtttgggggaggaactgctcagttaggacccagacggaaccataggaagcccccagcgcagcttctcttcctcctgccttactctggcctcccgagacgaccactgggagaaataggcgatgaacgcagtcctccacgcccaccctgtctgtgtctccgaggggaaancgcccaccctctcctgcacgggcctagtcgaggagttgttagcagccaacgttcgcctggtaccagcaagtaaccncggaccaggccctacccgaggtccctccanacttctagtcggtagcctagtcccgaccggtacgggcctacggttcggtacctccccgacgtaccgtaggttacgaagggtcggacacggggtttcgggtacgttacggggaactagttaacggttaccgaaccgttccgtaacccgtaaccctacgtacgaccgaccgacgcccggtacgaccgtacgttaccgtaggtaaacgttgttttaccggaacgtttacgtttaacttaccggtacttacccggtaatacgtaccgtaaccgacggtaacggttcctttacgttaacccgttcccgtaccggttaccgggaccgtaggtacggtagtaaccttcggtaaacctaaccggtaacggtcggttacggactaccggtaccgtacgtaccgtttccgttccgttaccg

SEQ ID NO: 78058 - DNA, 744 bp, Homo sapiens
  misc_feature: GYAE6OF02F47SB.49.28.C06.1.454.CMB.1.raw
  modified_base (205)..(205): a, c, t, g, unknown or other
  misc_feature (205)..(205): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctgcctcccagagaccactggagaaatagcgatgacgcagtctccagccaccctgtctgtgtctccgaggggaaagngcccaccctctccctgccgaggccagtcagagtgttagcagctaaacttcgcctaggtaccagcctaagaaacccgtggaccaggcctccccgagggtcctcccgtcacgttcctagtggtcgacctacgtaccccgaaccggaggggtaccctacgttacgggtaccctaccccgagtcccgtaacgggtttccaagggttcgggacgtagggtcggggttacgtacgggggtaactagggtcgtttaccacgttcctacccgaacctacgtaccgaagcccgtaagtcccgtcgtacgtacggttctagtaacggttagttttacgtaacgtttaacggttttaacgttaacgttcgttaccgtaacgtacgttaagttaaacgtttaacgttttaccgttacggttttccgttttaccgggttttttacggacccggtaaacggggttaaccaacggttcgtacgggtaagtaacggtaacgtaacgtacggtaacgttggtaccggtcgtccgaccgtacgtcgttagttaccgg

SEQ ID NO: 78059 - DNA, 915 bp, Homo sapiens
  misc_feature: GYAE6OF02HY4I2.49.28.C06.1.454.CMB.1.raw
  modified_base (187)..(187): a, c, t, g, unknown or other
  misc_feature (187)..(187): n is a, c, g, or t
  modified_base (202)..(202): a, c, t, g, unknown or other
  misc_feature (202)..(202): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccacctgtctgngtctccaggggaaangccaccctctcctgactagggccaaggtccaaggagttcgttagcaggctaaacttagcctgggttaacccaggacctaagaaacctggacccaaggtccctccccgaggtactcccgtacaattccgtaagtcggggttacaccacgttacccccgaccgaaggggtccccctaaacggtttagggtaacctacccccggaacgtcccggttaacggggtttacaaccggggttcggggtaacctaaggggttccggggggtttaaccctagggggggtaaactaaccgggttaaccgtttacccgaacccgggttcccgtttaccaaacccggttaagttaccgaaccggtacccgtaacggtacccgttaaacgggtaaccggttaacccgtaacggttaaaacggtttacggtttttaacgtaccggtttaaacggtttttaaacgtttaaccgttaaccggttaaaccgtaaaccggtaaccggtaaccggtttaaaccccgtaaacggttaaacgggttaaacgttttacccgttaaccgtttttacccgggtaacccccggttagggtaacccgtaaacgggtacgggttaaccgggtaacgtttaaccggttaaacgtaaaaacccgtaacggttaccggttacgggaccgttaccggtaaccgtaacccgttaaccgttccgtttaccggtaccgtttaacccg

SEQ ID NO: 78060 - DNA, 774 bp, Homo sapiens
  misc_feature: GYAE6OF02HG9GN.49.28.C06.1.454.CMB.1.raw
  modified_base (211)..(211): a, c, t, g, unknown or other
  misc_feature (211)..(211): n is a, c, g, or t
  modified_base (357)..(357): a, c, t, g, unknown or other
  misc_feature (357)..(357): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggcctcccagacgaccacgtggagaaatagcgatgacgcagtctccagcccaccctgtctgtcgtctccgaaggggaaacncgccctaccgtcctccgtgccgacgggccagtccaggtagttggttagcacgaccaacgttcgccgtacggtaccaggtccgaaacgtaaccgcggacccaggccccttacccggagtcccttacctacacgttcgtagtcggttnacccgactacccaaccggtacggtcctacggttcggtaacctccccgacggtaccgttagggttaccacggggttcgacgtacggggttagggtacggtacggggaacttaacgggttaccttcccgtaaccgtttccctaacccgtacccgttagtacccgtaacggaccgtacccgtccggtacgtaccgtagttccgttaaggtaagtttacgttttacgaacgttttacggttttacctaacgttcggtataacgtagttaacgttaacgttaacgtttacggttacggtttacgttttaccgggtttacgtaccggggtaagtaaccgtcggtacggtagtaacgtaacgtaccggtaacgtacgtaggtttcgccggttaaccgtacgtaccggtaccctagtttaccgtc

SEQ ID NO: 78061 - DNA, 772 bp, Homo sapiens
  misc_feature: GYAE6OF02G5IWJ.49.28.C06.1.454.CMB.1.raw
  modified_base (151)..(151): a, c, t, g, unknown or other
  misc_feature (151)..(151): n is a, c, g, or t
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
  modified_base (524)..(524): a, c, t, g, unknown or other
  misc_feature (524)..(524): n is a, c, g, or t
tcagagtcgagagacacgaccggtgctcgatttagagctcacgtattgggtttgggggaggaactgctcagttaggacccagacggaaccatggaagccccagcgcagcttctcttcctcctgctactctggctcccagagaccactgganaaatgcgatgacgcagtctccagccacctgtctgtacgtctccgaaggggaaanacgccctacctctcctaggcacgggccagtccagagttgttacgngacgactaacttacgcctaggtaaccaggaccaagtaaaccgtcggaccacgggtcctacccgaacggcccttacccgtcctaagttccgttaacgtgggttacgtaccgtaaccgttaccccgaaacccggacgggtccccttaaacggttccggtaaaccgttcccccgaagggtccccttaagggttcccgaaggtcggaccgtacggggttacgggtaccggttgggacccgttaggtaacggtttccaaccggttcgtacctaaaccgntccaacgtcgtaacgtacgtcggtccgtaacgtcgtaacgaacttacgtttggtaccgtttaagtttaactttacgacgttactacggtaacgttagtttaaccgttaactttaccggttagttaacccgggttttcgttttcgggaaccggttaacggtaccgtacgtccggtaaggtacgacgttaaccgaaaggtaccgtaacgtttggaccggtactccgtaccgtacgtacgttaccgttacg

SEQ ID NO: 78062 - DNA, 496 bp, Homo sapiens
  misc_feature: GYAE6OF01BQBLE.22.29.C07.1.454.CMB.1.raw
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgctagtttattactgtcagcagtataattactggccttcggacgttcggccaagggaccaagggtggaagtcaaagactgtggctgcacatctgtcttc

SEQ ID NO: 78063 - DNA, 573 bp, Homo sapiens
  misc_feature: GYAE6OF01BQCU0.22.29.C07.1.454.CMB.1.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaanagccaccctctcctgcagggccagtcagagtattagcaacacttagcctggtaccagcagagacctggccaggctccaggctctcatctatgtncatccagcaggccactcggtaccccagccaggttcaggtggcaggtgggtctgggacaggtattcactctcactatcagcagcctgcagtctagtaagtattttgacttagttttactcgtgtactagtctaagttattaagttacgtcggtccttacgggtacgttccggaccgaaaggggtacccgtaaaggggttagggaaacgtaccgtaaaacggtaacgttgggtacggtacgtacgtaccgtaacccgtagttccgttgttcccttaccg

SEQ ID NO: 78064 - DNA, 572 bp, Homo sapiens
  misc_feature: GYAE6OF01DT4BP.22.29.C07.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (324)..(324): a, c, t, g, unknown or other
  misc_feature (324)..(324): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcacctgtctgtgtctccgaggggaaanacgccaccctntcctgcagggccagtcagagtattagcaacaacttagcctggtaccagcagagacctggccaggctccaggctctcatctatgttgcatccagcaggccacgtcggtacccngccaggttcagtggcaggtggtctgggacagagttcactctcatcatcagcagctgcagtctagaacttatttgacttagtttacttactgtacaggtctaagtaattaacgttacgtcggtacccgttacgggtaccgttacgggaccgtaaacggggtaacccgaaagggttacggtaaacgttaacgaaaaccggtaacttcgggtaggtaccgtacgaccgaacctacttccgttggttacccg

SEQ ID NO: 78065 - DNA, 564 bp, Homo sapiens
  misc_feature: GYAE6OF01COQTL.22.29.C07.1.454.CMB.1.raw
  modified_base (202)..(202): a, c, t, g, unknown or other
  misc_feature (202)..(202): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaanagccaccctctcctgcagggccagtcagagtattagcaacaacttagcctggtaccagcagagacctggccaggctcccaggctcctcatctatgttgcatccagcagggccacgtcggtaccccagccaggttcaggtggcgagtgggtcgtgggactagacgtttcactctcacctatcagcacgcctgctagtctagaagttatttcgacttagtttattacgttgtacagtctaagttaattaagttacgtcgtccgtacggtaccgttcgggaccgtaacgggaccgtaagggtacggtaagtaaccgaaacggtaacgtggtcggacgtacgaccacctattcctgttccttaccg

SEQ ID NO: 78066 - DNA, 510 bp, Homo sapiens
  misc_feature: GYAE6OF01AICBF.22.29.C07.1.454.CMB.1.raw
  modified_base (201)..(201): a, c, t, g, unknown or other
  misc_feature (201)..(201): n is a, c, g, or t
  modified_base (395)..(395): a, c, t, g, unknown or other
  misc_feature (395)..(395): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaangccaccctctcctgcagggccagtcagagtattagcaacacttagcctggtaccagcagagacctgaccaggctcccaggctcctcatctatgttgcatccagcagggccactcggtaccccagccaggttccagtggcaggtgggtctgggacagagttcactctcaccatcagcagcctgcagtctgaagtnttttgctagtttatactgtcagctagtatattactggcctcggtacgttcggaccgaagggacctaaggtggaacgtcgaaacgtactggtacggctcgaccacatctgtcttac

SEQ ID NO: 78067 - DNA, 623 bp, Homo sapiens
  misc_feature: GYAE6OF01CUQ23.22.29.C07.1.454.CMB.1.raw
  modified_base (261)..(261): a, c, t, g, unknown or other
  misc_feature (261)..(261): n is a, c, g, or t
  modified_base (391)..(391): a, c, t, g, unknown or other
  misc_feature (391)..(391): n is a, c, g, or t
tcagacatacgcgtcacgaccggtgctcgatttagagtgctacgaagggaaaggggaggaactgctcagttaggacccagacggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctaggtaccaanagacggcctggccaggctcccaggcctcctcatgtatgatgcttacgaaaacgggccacgtggacatcccagccgtaggttcaggtgcgaggtggtcaggaagagtacttcactctacacctatacaacngcctagacgctcgacgtatcgtgtcttaagtttattacgtgttcagtacgacgtacgtaaccgtaagtcggtcccgttaccggtacgttttccgggaccgggtacgggggacccgtaacgggtaccggtagggaacgtagtaccggaacggtaaccggtaacgtcgggtacggccgtcgacccgtaaccgtagttccgttacgttactttacctccgttcccgttacccccg

SEQ ID NO: 78068 - DNA, 569 bp, Homo sapiens
  misc_feature: GYAE6OF01AMCRU.22.29.C07.1.454.CMB.1.raw
  modified_base (202)..(202): a, c, t, g, unknown or other
  misc_feature (202)..(202): n is a, c, g, or t
  modified_base (421)..(421): a, c, t, g, unknown or other
  misc_feature (421)..(421): n is a, c, g, or t
  modified_base (564)..(564): a, c, t, g, unknown or other
  misc_feature (564)..(564): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaanacgccaccctctcctgcagggccagtcagagtattagcaacaacttagcctaggtaccagcagacgacctggccaggcctcccgaggcctcctcatctatgttgcatccagcagggcccacgtcggtacccccagccaggttccaggtggcgtaggtgggtcgtggggacaggtagttccactctccaccatcagcagcctgcagttcgtagtaagttntttcgacttagttttacttacgttgtcagtctaagttaacttaattacgtggtaccgttcggtacgttacggaccgtaacggaccgtaagggtggtaacgtacgaaacggtacgtggtacggctagaccgactagtctcgttntaccg

SEQ ID NO: 78069 - DNA, 508 bp, Homo sapiens
  misc_feature: GYAE6OF01DBBOJ.22.29.C07.1.454.CMB.1.raw
  modified_base (203)..(203): a, c, t, g, unknown or other
  misc_feature (203)..(203): n is a, c, g, or t
  modified_base (464)..(464): a, c, t, g, unknown or other
  misc_feature (464)..(464): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaaggggaaanagccaccctctcctgcagggccagtcagagtatagcaaacaacttagcctggtaccagcagagacctggccaggctcccaggctcctcatctatgttgcatccagcagggccactggaccccagccaggttcagtggcagtgggtctgggacagagttcactctcaccatcagcagcctgcagtctgaagattttgctagttttatactgtcagcaagtataattactggcctcggacgttcggccaagggacctaaaggnggaaacgtacgaaacgaactagtggctgacaccatctgtcttac

SEQ ID NO: 78070 - DNA, 498 bp, Homo sapiens
  misc_feature: GYAE6OF01A5R5T.22.29.C07.1.454.CMB.1.raw
  modified_base (201)..(201): a, c, t, g, unknown or other
  misc_feature (201)..(201): n is a, c, g, or t
  modified_base (481)..(481): a, c, t, g, unknown or other
  misc_feature (481)..(481): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaanagccaccctctcctgcagggccagtcagagtattagcaacaacttagcctggtaccagcagagacctggccaggctcccaggctcctcatctatgttgcatccagcagggccactcggtaccccagccaggttcagtgcagtgggtctgggacagagttcactctcaccatcagcagcctgcagtctagaagtattttgctagtttattactgtcagctagtataattactggtcctcggacttcggcctaacgggacaaggtggaagtcaaagacgtgngctgacacatctgtctc

SEQ ID NO: 78071 - DNA, 731 bp, Homo sapiens
  misc_feature: GYAE6OF01B6W3I.22.29.C07.1.454.CMB.1.raw
  modified_base (210)..(210): a, c, t, g, unknown or other
  misc_feature (210)..(210): n is a, c, g, or t
tcagacatacgcgtcacgaccggtgctcgatttagagtgctacgaagggaaaggggtaggaactgctacagttaggacccagacggaaccaatggaacgccccgagcgcagcttctcttcctcctgctactcgtggctcccaggtgtccagtgcagaagtagtgatgacgcagtctcgaggcaccctgtctgtgtcgtccaggggaaagngtcaccctctcgtgcgagggccagtcagagtagttagcaacgacttgcctggtaccagcagacgtacctggccgaggcctccgacggtccttcccgtcaacgtccttaagttcgttgacctagtacccgagtccgacgggtccacgttcggtaacccccagacccgaaggtttccgaagtcgggacgtaaggttcgggtacgtggggaaccagtacgtttaccacgttaccgtaccaaccgtaataccgaacgtacctaacggtacctacggacgtacggttacgtacggtaaagttacgttttacgtcgttaacgttttaactttaccgttcggttacgtaaggtaccttaaccgttaacttaaacgttaaccgttacggttacccgttaccgttaacggttacggttttacggaccgtaacggggtaccctaaggtaccgttacgggttaacgtaacgttaaccgtaaaccgttaacgttcggttacggtaccgttacgccgtaacccgtcgttacccg

SEQ ID NO: 78072 - DNA, 527 bp, Homo sapiens
  misc_feature: GYAE6OF01BMPPT.22.29.C07.1.454.CMB.1.raw
  modified_base (202)..(202): a, c, t, g, unknown or other
  misc_feature (202)..(202): n is a, c, g, or t
  modified_base (397)..(397): a, c, t, g, unknown or other
  misc_feature (397)..(397): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagngccaccctctcctgcagggccagtcagagtattagcaacaacttagcctggtaccagcagagacctggccaggctcccaggctcctcatctatgttgcatccagcgagggccactggtaccccagccaggttcagtggcagtgggtctgggacagagttcactctcaccatcagcacgcctgcagtctagaagtnttttgctagttttatacttgtacagtctagttaacttaattcgtacggtcctcgggtaccggttcggaccgtaacgggaaccaagggtagaagtaccgaaacgacgtgcggctggcaccatctgtcttac

SEQ ID NO: 78073 - DNA, 516 bp, Homo sapiens
  misc_feature: GYAE6OF01A0UV2.22.29.C07.1.454.CMB.1.raw
  modified_base (202)..(202): a, c, t, g, unknown or other
  misc_feature (202)..(202): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaancgccaccctctcctgcagggccagtcagagtattagcaacaacttagcctggtaccagcagagacctggccaggctcccaggctcctcatctatgttgcatccagcagggccactcggtaccccagccaggttcagtggcagtgggtctgggacagagttcactctcacatcagcagcctgcagtctgaagtattttgctagtttactactgtcagctagtataattacgtcggccttcgggacgttcggaccgtaagggaccgtaagggtggaaggtacgaaacgacgtcgtggctcgcacatctgtcttacg

SEQ ID NO: 78074 - DNA, 557 bp, Homo sapiens
  misc_feature: GYAE6OF01BJGD4.22.29.C07.1.454.CMB.1.raw
  modified_base (303)..(303): a, c, t, g, unknown or other
  misc_feature (303)..(303): n is a, c, g, or t
  modified_base (385)..(385): a, c, t, g, unknown or other
  misc_feature (385)..(385): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccagatgccagtgcagaagtagtgatgacgcagtctccagccaccctgtctgtgtctccgaggggaaagagccacactctcctgcagggccagtcagagtgtagcagcagcttagcctggtaccagacagaaacctggccaggcctcccaggcctcctcatctagtggtncatctacggaggccacgtggactccagccaggttcagtggcaggtggtctgggacagtgttcactctacaccatcagctacncctgactaatactagaagttattttagacttaagttttattacttgtacacgtactaacttaattaattaaacgtcggtacccttaccgtacttacggtttcggaccgtaacggggacctaaggcgttaggacgtaactaacgtaaacgtactaggtcggcgtcgtaacccg

SEQ ID NO: 78075 - DNA, 511 bp, Homo sapiens
  misc_feature: GYAE6OF01EU37P.22.29.C07.1.454.CMB.1.raw
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgtcggcaagggtaccgaaacggtaggaaggtacgaaagaaactagtaggcgtagtcaaccgatctgtcgttac

SEQ ID NO: 78076 - DNA, 548 bp, Homo sapiens
  misc_feature: GYAE6OF01C0V2O.22.29.C07.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (299)..(299): a, c, t, g, unknown or other
  misc_feature (299)..(299): n is a, c, g, or t
  modified_base (349)..(349): a, c, t, g, unknown or other
  misc_feature (349)..(349): n is a, c, g, or t
  modified_base (397)..(397): a, c, t, g, unknown or other
  misc_feature (397)..(397): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctcaggcaccctgtctgtgtctccgaggggaaancgccaccctntcctgcagggccagtcagagtattagcaacacttagcctaggtaccagcagagacctggccaggcctccgaggcctctcatctatgtncatccagcaggccacgtcgacccagctaggtcagtgcaggtggctggacngtagtcactctacacgatcgagcacgccgtagctagtctagtaaagtnttttgctaagtttatactgtacagcgtaagtaattacgttacgtcggacctcggtaccgttcggaaccgaagggaaccgtagggttaggaacggttacgaaacggtacgtggtacggacttacgacgtaccaagttcccgtgtccgttacg

SEQ ID NO: 78077 - DNA, 687 bp, Homo sapiens
  misc_feature: GYAE6OF01EJYCI.22.29.C07.1.454.CMB.1.raw
  modified_base (202)..(202): a, c, t, g, unknown or other
  misc_feature (202)..(202): n is a, c, g, or t
  modified_base (528)..(528): a, c, t, g, unknown or other
  misc_feature (528)..(528): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaancgccaccctctcctgcacgggccagtcagtagtattagacaactaacttagccgtaggtaccagacaggacgaccgtcggacccaaggtccctacccgaggtccctcccttacgacttcgttagttgtttacgacctacgtacccgaggtccggaacgggtccctaaccggttaccggtaaccccccgaggtaccccgttagggttacccaagggttcgggacgtagggttcgggtacgtacggggactaagggttacgtttcccacgttcctaaccaccgtatccgaacgtccaacgcccgtagcctagttcgtagtaacgtttntttcgacttagttttacgtcgtcgtacacgtactaagttaacttaacgttcgacggttaccgttacggtacgttacccggaacgtaaccgggtacgtaagggtacgtaacgtaccgaagtacgtggcgtacgtcgacctactagttccgttgtcctacg

SEQ ID NO: 78078 - DNA, 591 bp, Homo sapiens
  misc_feature: GYAE6OF01D5XSS.22.29.C07.1.454.CMB.1.raw
  modified_base (201)..(201): a, c, t, g, unknown or other
  misc_feature (201)..(201): n is a, c, g, or t
  modified_base (404)..(404): a, c, t, g, unknown or other
  misc_feature (404)..(404): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaangccaccctctcctgcagggccagtcagagtattagcaacacttagcctggtaccagcagagacctggccaggctcccaggcctcctcatctatgttgccatccagcacgggcagttcggtaccccagccaggttcagtggctaggtgggtctgggacagtacgttcacgtctcaccatcagcagcctgctgtactagtaagtnttttgtactagttttacttcttgtaccagtactaaggttattaacgttacgttcggtaccgttaccggtacggttaccggacggtaacgggtaccgtaaacgggtacggtaaacggtaaccgtaaacggaacggttacgggtacggtcgtaccggacctaacctagttaccttcggttctttacccg

SEQ ID NO: 78079 - DNA, 736 bp, Homo sapiens
  misc_feature: GYAE6OF01CXS3P.22.29.C07.1.454.CMB.1.raw
  modified_base (204)..(204): a, c, t, g, unknown or other
  misc_feature (204)..(204): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggcctcccaggtgccagtgcagaagtagtgatgacgcagtctccaggcaccctgtctgtgtctccgaaggggaaancgccaccctctcctgcgagggccagtcagtagtatagacaactacttagcctaggaccagcagacgacctggccaggcctacccaggtcctcctacatccttagtgtcgctactccgagccgacgggccctacgtccgggtaaccccagaccgtaggttacaggtcggctagggttcgggtacaggggactaaggtacgtttccaacgttcctacaacctagtcgaacgcctacggcccttagacctaacgttacgtaggtaaacgttagttttcgaacgtttaacgtttttaacttacggttacgtaccgttaagaaccgttaaacttaaacttaaacgtttaaccggttaccggtacccctttaaccgggtttaaccggttaacgggttttaccgggaacccggtaaacggggggtaaacccttaagggtacccggtttaaggggaaaccgtaaacggtaaacccgttaaaaaccgggaacgtttacgggtacggtacccgttacgaccccgtaaccgttaacgttcccg

SEQ ID NO: 78080 - DNA, 535 bp, Homo sapiens
  misc_feature: GYAE6OF01B9A7S.22.29.C07.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggccaccctgtctgtgtctccgaaggggaaanacgcccacctctcctgcagggccagtcagagtattagacaacaacttgcctaggtaccagcagagacctggccaggctccaggctctcatctatgtncatccagcaggccacgtcggacccagcaggtcagtgcagtggtnggganagagtcactcncacatcagcagcctgcagtctagaagtatttgcttagtttatactgttcagtctaagtaattagtacgtggtaccgtggtaccgttcggaccgaagggaccgtaacgggtaggtaaacgtacgtaaacggtacgtcggtcgggactcggacaacccagttcctcggtcttaccg

SEQ ID NO: 78081 - DNA, 564 bp, Homo sapiens
  misc_feature: GYAE6OF01AIYC0.22.29.C07.1.454.CMB.1.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaanagccaccctctcctgcagggccagtcagagtattagcaacacttagcctggtaccagcagagacctggccaggcctcccgaggcctcctcatctatggtncatcgtacggagggccagtggtactcccgagccgtaggttcaggtcggctaggtgggtctgggacaggacgtttcactctccactactcagcacgcctgctagtctagtagtatttgcttagtttacttacgtgtctacgtctaactataactacgtcgtaccttcgttacgtacgtttacggaccgtacgggtaccgaggtcgtacgggagtacgtaccgaaacgtacgttacggtacggtaccgtacgcctacgtcgttcg

SEQ ID NO: 78082 - DNA, 542 bp, Homo sapiens
  misc_feature: GYAE6OF01BD9XF.22.29.C07.1.454.CMB.1.raw
  modified_base (395)..(395): a, c, t, g, unknown or other
  misc_feature (395)..(395): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctgtaccagcagagacctggccaggcctccaggctcctcatctatgttgcatccagcagggccactggtaccccagccaggtcagtggcagtgggtctgggacagagttcactctacaccatcagcagcctgcagtctagtaagtntttgactagtttattactgtacagctaagtataagttactcggtaccttcggtaccgttcggaccgaacgggaccgtaagggtacggaacgtaccgaaacgtaacgtggtacggtacgtaggaccaacctattcctgttccgttacg

SEQ ID NO: 78083 - DNA, 619 bp, Homo sapiens
  misc_feature: GYAE6OF01BPTFL.22.29.C07.1.454.CMB.1.raw
  modified_base (204)..(204): a, c, t, g, unknown or other
  misc_feature (204)..(204): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggccaccctgtctgtgtctccgaaggggaaancgccaccctctcctgcagggccagtcagagtattagcaacacttagcctggtaccagcagacgacctggccaggcctacccgaggcctcctacatctatcgttgctatccagcgacgggccacgtcggtaccccagcctaggttcaggtcggctaggttcgggtcgtagggacaggtacgttcacttcctaccaccatccgacgccacgcccttgacctaggttactaggaacgttattttcggactttagttttacttacgtacggtcacggtactaagtttaattaacgttacgtccggttaccgtacgggtaccggttccggaaccgtaacgggtaccgaagggttacggaaacgtacgaaacggtacgtcggtcggactacggacctaacgtacttcttcgttccttaccg

SEQ ID NO: 78084 - DNA, 629 bp, Homo sapiens
  misc_feature: GYAE6OF01A4T12.22.29.C07.1.454.CMB.1.raw
  modified_base (201)..(201): a, c, t, g, unknown or other
  misc_feature (201)..(201): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaangccaccctctcctgcagggccagtcagagtatagcaacaacttagccttggtaccagcagagacctggccaggcctcccaggctccctcatctatgttgcatccagcagggcccacgtcggtaccccagcctaggttcaggtggcgaggtgggtcgtggggacaggtacgtttccacttcctaccaccctataccgacgacacgccctggcctacggttcttaggaagttattttcggacttagtttttaacttacgttgtacagtacctaagtttaattaacgttacgttcggtcccgttcgggtaccggttccgggacccgtaacggggtaccgtaaacgggtacgggtaaacgtaacccggaaaacggtaacggttcggtacgggtccttacggacctaccgtactccgttcggttccttacccg

SEQ ID NO: 78085 - DNA, 674 bp, Homo sapiens
  misc_feature: GYAE6OF01EMIIA.22.29.C07.1.454.CMB.1.raw
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggccaccctgtctgtgtctccgaaggggaagacgcccaccctctcctgcgagggccagtcagagttattacgcaaactaacttagccgttggtaccagcaggacgaccgtggccaggcctcccgaggccttcctcgtattcctagttggttcgacctactccgagccgacgggccctacgttccggtaacccccagcccgtaaggtttccgaaggttcgggctagggttcgggtcgtagggacaggtacgttcactcctccaccatcagccgacgtccctgactagtcgtagtaagttgttttgactttagttttacttacgtgttacagttcgtaagtttaacttaacgtttcgtacggttacccggttacgggttaacggttacccgggaaccggtaaacgggtaccgtaaacggggtaacggtaaccgttaaccggtaaacggtaacggttcgggtacggtacgtacgtacctaccctaagttcgttcgttcgttaccg

SEQ ID NO: 78086 - DNA, 531 bp, Homo sapiens
  misc_feature: GYAE6OF01BUOUX.22.29.C07.1.454.CMB.1.raw
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaangccaccctctcctgcagggccagtcagagtattagcaacaacttagcctggtaccagcagagacctggccaggctcccaggctcctcatctatgttncatccagcagggccactggtacccccagcctaggtcagtggcagtgggtctgggacagagttcactctcaccatcagcagcctgcagtctagaagtattttgactagttttattacttgtcagtctaagtattaattactggtcctcggtacgttcgaccgtaacgggacctaaagggtaggaacgtacgaaagtaacgtggtacggcttcgaccactactctggttcttaccg

SEQ ID NO: 78087 - DNA, 741 bp, Homo sapiens
  misc_feature: GYAE6OF01C12C8.22.29.C07.1.454.CMB.1.raw
  modified_base (202)..(202): a, c, t, g, unknown or other
  misc_feature (202)..(202): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggccacctgtctgtgtctccgaggggaaancgccaccctctcctgcacgggccagtcagagtattagacaacaacttgcctggtaccagcagagacctggccacggctccgaggcctcctcatctagtgttgcactccagccgacgggccacgtcggtaccccagccgtacggttcaggtcggacgaggttcgggtcgtggggactaggtacgtttccaccgttctaccgaacctacgtaccaacgccgaacgtcccgtaggaccgtacgttacgtaacggtaagtttacgttttgaccgtttaaggttttactttaccgttcgttaccgtaagtacgttaaagtttaacgtttaaacgtttccggtaccggttacccgttacggggttaaccccggtttacgggaaaccccggtaaaacggggtaaaccccgggtaaaggggttaccgggttaaaaccgggttaaacccggtaaaaaccgggttaaccggttacggggttacgggtaacccgttacggtaaccccgtaacccttacgttttacccgttacggttttccctttaacccg

SEQ ID NO: 78088 - DNA, 694 bp, Homo sapiens
  misc_feature: GYAE6OF01EWL1A.22.29.C07.1.454.CMB.1.raw
  modified_base (425)..(425): a, c, t, g, unknown or other
  misc_feature (425)..(425): n is a, c, g, or t
tcagacatacgcgtcacgaccggtgctcgatttagagtgctacgaagggaaaggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggcccaccctctcctgcacgggccaatgagagtattagcgactacgttagcctggtaccagcagagacctggccaggcctcccgaggcctccctacactctagtggttgcctttcctaccgagggccctacgtggtacctcccccgcagggtttaccaggtcgaccgtaggtcgggtcgtcggggacaggtacgttccacgttcctaccgaacctatccgaacncgacgtcccttgacctacggttactaggtaagttacttttcgaaccttttacttttaacgtttacgtcgtacgtaacgtactaaattattaagttcggtacctttgggttccctaacggtaccgttccctaacccggtttccgggaacccgtaaagggtacccaaccgggtacgtacggtaacgtaaacgtttaaaccggaacgtttggaccggtactcggaaccctaccgtactttcgttaccgtttctttacccgcgtttacccccg

SEQ ID NO: 78089 - DNA, 769 bp, Homo sapiens
  misc_feature: GYAE6OF01D2ECQ.22.29.C07.1.454.CMB.1.raw
tcagacatacgcgtcacgaccggtgctcgatttagagtgctacgaagggaaaggggaggaactgctcagttaggacccagacggaaccatggaacgccccagcgcagcttctcttcctcctgctactctggcctcccaggtcgccagtgcaagaagtagtgatgacgcagtcctcgaggccacccgtgtctgtcgtcgtaccggaagggaacgcgccctaccctcgtccgtgcgacggcctagtacagtagtagtacgactaaactacgttacgccgttacggtaccacggacgaacggaccgtaccggtcggaccgtacggcccctacccgaacggtcccttaccctacgtaacttcgttagttcgttacgacctaccgtaccgaacggaccggtaccggggtaccctaaccggtaccccggtaaccccacggtacccgttaacgggttccaaggggtcggtacggtacgggttcgggttacggaacgggtacgtaacggttaccgttccaccttcccgaacgtaacctagtaccgacgcgtaccgtccgtcgtaccgtagttacgtaagttaacgttttacgtttcgtaacgtttaagttttacgttacgtcgtaacaacgttacttaaagtttattacgttccggtaccggtaccgtttacggtaccggttacggaaacggacggtaaccggtaaggtaaccgtaaacgaacgtaaacggtacgtcgggcgtacgccgactaccgttacgtcttcgtccgttaccg

SEQ ID NO: 78090 - DNA, 574 bp, Homo sapiens
  misc_feature: GYAE6OF01C67AW.22.29.C07.1.454.CMB.1.raw
  modified_base (204)..(204): a, c, t, g, unknown or other
  misc_feature (204)..(204): n is a, c, g, or t
  modified_base (309)..(309): a, c, t, g, unknown or other
  misc_feature (309)..(309): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggccaccctgtctgtgtctccgaaggggaaanacgcccaccctctcctgcgagggccagtcagtagtatagcaactacttagcctaggaccagcagacgacctggccaggcctccgaggtcctctacatctatgtcnctactcagacgacgggccacgttccgacccagccgtaggttcaggtgcgaggtggtctagggacagtacgtcactctacactatcagtcacnctagctagtntagtattntttgacttagtttactactagtacacgtactaattaattacgttcgtacggtaccgttacggaccggtttaccggaacggtaacggaccgtaaagggaggtaaccgtaacgaaacgtacgtggtcgctacgtaccactagttctcgttcttaccg

SEQ ID NO: 78091 - DNA, 621 bp, Homo sapiens
  misc_feature: GYAE6OF01ALK5B.22.29.C07.1.454.CMB.1.raw
  modified_base (202)..(202): a, c, t, g, unknown or other
  misc_feature (202)..(202): n is a, c, g, or t
  modified_base (315)..(315): a, c, t, g, unknown or other
  misc_feature (315)..(315): n is a, c, g, or t
  modified_base (346)..(346): a, c, t, g, unknown or other
  misc_feature (346)..(346): n is a, c, g, or t
  modified_base (405)..(405): a, c, t, g, unknown or other
  misc_feature (405)..(405): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaancgccaccctctcctgcgacgggccagtcaaggtagtattacgactaaacactttagcctggtacccagcaggacgacctggccaggcctcccgaggcctcctcattctatgtnctatccgagcgacggccacgtcggtaccccngccctaggttccaggtcggctagggtcgggttcgtgggaactaggtacgtttcacttcncacctatcgagctacgcctgctaggtctagtaagttntttacgnttagttttactcgttcgtcagtactaagttaacttacgtttacgccggtaccggttccggtaccggtttacgaaccggtacgggaaccgtaagggtaacggtaaacgtaaccgtaaaccgtacggttgggacgtacgtacggaccctactacgttccttcgtaccgttaccg

SEQ ID NO: 78092 - DNA, 668 bp, Homo sapiens
  misc_feature: GYAE6OF01BC2H1.22.29.C07.1.454.CMB.1.raw
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaacgacgcccaccctctcctgcgagggccagtcagagtattagcaactaacgttagcctggtaccagcaggacgaccgtgggccacggcctccccgacggcctccgtcatctagttgttcgctactccgagcgacgggcccacgtccggtaccccaggcccgtaggttcgaggtcggcgtaggtcgggtcgtgggacaggtacgttcacctcgtcgaccatccacgcacgctcgacgtagtctaggaatgtttgtacttagtttaacttacgtgttaccgtagtacgtaagtttaacttaagtttaccgtacgggttacccgtttccgggtaaccggttccgggtaacccgaacgggggtaaccgtaaacgggggtaacgggttaaacgtaaccggtaaaccggtacggttaccgggttacggtaccgttacggtacccgaccgtaacgttctaccggttccttacccgg

SEQ ID NO: 78093 - DNA, 717 bp, Homo sapiens
  misc_feature: GYAE6OF01BMVJU.22.29.C07.1.454.CMB.1.raw
  modified_base (303)..(303): a, c, t, g, unknown or other
  misc_feature (303)..(303): n is a, c, g, or t
tcagacatacgcgtcacgaccggtgctcgatttagagtgctacgaagggaaaggggaggaactgctcagttaggacccagacggaaccatggaagccccagcgcagcttctcttcctctgctactctggctcccaggtgccagtgcagaagtagtgatgacgcagtctccaggcaccctgtctgtgtctccgaggggaaacgagcccaccctctcctgcgagggccagtcagagtattagcaacacttgcctggtaccagcagagaccgtgccagcctccaggcctcctcactctatggttcncactccagccgagggcctaaccgtccggtaccccagtcccgtaggttcacggttcggcgtaggtcggggttccgtaggggtaccgtaagggtaccggtttaccaccgttacgtacctaaccctagttaccgaacgcccgtaacggtcccgtacggtccgtaaggttccgttaggtaacgttacgtttttacggacgttacggtttttactttacggttgttaccgtaacgtactaacgttaacgttaaacgttaccggttacggttacccggttacgggttaccggttacccgggaacgtaaaccgggggtaaccctaaaggggtaaccggttaaacggtaccaaaacgggttaacgtcgggttacggttaccgtacggtaccctaccgttaattccgttcgttacgttacccg

SEQ ID NO: 78094 - DNA, 716 bp, Homo sapiens
  misc_feature: GYAE6OF01CNKI4.22.29.C07.1.454.CMB.1.raw
  modified_base (204)..(204): a, c, t, g, unknown or other
  misc_feature (204)..(204): n is a, c, g, or t
  modified_base (370)..(370): a, c, t, g, unknown or other
  misc_feature (370)..(370): n is a, c, g, or t
tcagacatacgcgtcacgaccggtgctcgatttagagtgctacgaagggaaagggggaggaactgctcagttaggacccagacggaaccatggaagccccagcgcagcttctcttcctcctgctactctggctcccaggtgccagtgcagaagtagtgatgacgcagtctccaggcaccctgtctgtgtcctccgaggggaaanacgcccaccctctcctgcgacgggccagtcagtatatagacaacactacgccgtagtaccaggcaaggacgaccgtcggaccacggcctacccgaggtccctcctactactcctagttcgtcgctactcccgaggccgacgggtccctaccgtaccggtaaccccncggtaccgtaagggttccagggttcggacgttagggtcgggtcgtagggaactaggtacgtttcaaccgttccaccgtaccataccgagcgacgtccgtgacctaggtactaaggtaatttcgtttagacctttagttttacttacgttcggtacacgtacttaaagttaattaaccgttcggtccgggtacccgttccgggtaaccgggtttacgaaccgggttaaaccgggtacgttaaacgggtacgggaaaccggttaaaccgaaaccgggttaacgttcggggtacgtacccgtaacggtccccttaaacgttcgttacggttcccgtttaaccttacccg

SEQ ID NO: 78095 - DNA, 683 bp, Homo sapiens
  misc_feature: GYAE6OF01DL2IU.22.29.C07.1.454.CMB.1.raw
  modified_base (202)..(202): a, c, t, g, unknown or other
  misc_feature (202)..(202): n is a, c, g, or t
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccagcaccctgtctgtgtctaccgaagggaaanacgcccaccctctcctgccgacgggcctagtcgagtagtatagacaactacttacgcctagaccagacagacgaccgtcggccacggtcctacccgagtccctctcattctattgtcnctactaccgngacgacggccctacgtcccgaaccccngtacctaggttacgnggtacgcgtagggtcggtcgtaggactagtcgttaccatccacgacactacacgctacgtcgtcgacgttacgtcgtaagttaagttcgtttactacgtttaagttttacttaccggttgtaacgtacgttaacgttaatttaacgttaaccgttcggtaccggttaccggttaccgggttacccgggtaccggaacccgggtaacggtaaaccggtaacgggtaccggtaaaccggtaaaccgtaaaacggtcgttacgggacggtacgttaaccgaccggtactacgttccgttcgttccgttaacccg

SEQ ID NO: 78096 - DNA, 792 bp, Homo sapiens
  misc_feature: GYAE6OF01AITOL.22.29.C07.1.454.CMB.1.raw
  modified_base (762)..(762): a, c, t, g, unknown or other
  misc_feature (762)..(762): n is a, c, g, or t
tcagacatacgcgtcacgaccggtgctcgatttagagtgctacgaagggaaaggggaggaactgctcagttaggacccagacggaaccatggaacgccccagcgcagcttctcttcctcctgctactcgtggcctcccaggtcgccagtcgcaggaagtagtgagtgacggctacgtcctccgaggccctacccgttgtccgttgtcgtcctaccggaagggggaaagccgaccctaccccttcctcccgtaggccgacgggcctaggtaccagtacggttatacgacctaaactaacgttacggccgttacggtacacgactacggaacgtaccgtgggaccgtacggcccgttaccgacggtccctacctcctaacgttccttaagttcggttcgtacctaccgtaccgtaccggacggtaccgacccctaacgggttccccggttaaccccgacggacccgtttagggtcgaacggtggacgggtacgggtttccgggtaggtaacgggaccgttaggtacccgttacccgaccgtttacccaaccgtacctaacgtcccggtacgaccgtaccggtcgtacggttaccgtaacggttcgtaacgggtttaacttcgtttacgttaaacctttctttacgtacgttctactaagacttaagttaaccgtataccgttcgttcgttaaaccccgttacttaacccggtcctagggacccgtaggtacgaccggtctaaggtaaccgttaagttaacccgngtaggtcccgtagaccgtatccgttacggg

SEQ ID NO: 78097 - DNA, 888 bp, Homo sapiens
  misc_feature: GYAE6OF01BXC3T.22.29.C07.1.454.CMB.1.raw
tcagacatacgcgtcacgaccggtgctcgatttagagtgctacgaagggaaaggggaggaactgctcagttaggacccagacggaaccatggaagccccagcgcagcttctcttcctcctgctactctggctcccagagaccaccggagaagttgtgttgacactagtttccagccaccctgtctttgtctccaggagagcgggccaccctctcctgcgacgggccaatgagagtattagcgacttacgttacgccttggtaaccaacgaggacggccctggcccaacggtcctccccgagggtccttcctacagttcgtatgtattcgaccgttaaccgaaaacggggtccaacgttacggcctacttaccccgagtacccgtacgggtttaccgaaggttcgggacccgtaggggttacggggttacgtaaggggtaaaggtaacggttaccgtttacgtaaccgttacctacccgtaaaccgtaaccttaccgaaacccgtacggtaacccgttaacggtaaccgtcccgttaacggtaacggttaaccgtttccgttacggttacgtttaacggttttaacgtttaaccgttcgttaaccgtacgtacccgtaaccggtacccggtaacccgtaaacgggttcccgggtacccgtttacccgggttaacccggtttttacggggaccccggggtaaccggggggtacccgtaacggggttacccggttacggggtaacgtaaccggttacccgtaaacggtaacccgggttaacggttcgggttacgggtacccgttaaccggaccccgttaaacccggttaacctttccggtttaccgtttacccgtttaccctttccgtttacccccggtttaccccccggg

SEQ ID NO: 78098 - DNA, 791 bp, Homo sapiens
  misc_feature: GYAE6OF01CLSV7.22.29.C07.1.454.CMB.1.raw
  modified_base (140)..(140): a, c, t, g, unknown or other
  misc_feature (140)..(140): n is a, c, g, or t
  modified_base (169)..(169): a, c, t, g, unknown or other
  misc_feature (169)..(169): n is a, c, g, or t
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (465)..(465): a, c, t, g, unknown or other
  misc_feature (465)..(465): n is a, c, g, or t
  modified_base (765)..(765): a, c, t, g, unknown or other
  misc_feature (765)..(765): n is a, c, g, or t
tcagacatacgcgtcacgaccggtgctcgatttagagtgctacgaagggaaagggggaggaactgctcagttaggacccagacggaaccatggaagccccagcgcagcttctcttcctctgctactctggcctccaggtnccagtgcagaagtgtgatgacgcagtccnccgaggcctacccgtgtcgtgtacgtccgccggaaggggaaanccgcccacccgtnttcccgnggaccgtacggggccctaaggtccgaaggtacgttaacttaacggactaaaactacgtttcgccgtagtaccgagacgagacggtacctggaccgaccggtccaccggtacggtccctaccgtacgtaacttccttagttcggttacacctaccgtaccggacggaccgtaaccgggtaccctaccggtaccccgggtaaccccacggttaccggtacggttacgtacggggngtaccggtaggggttcggtacgtacgggaaccgtttaggtccgttacacgttcctaccctaagccgttaccgaacgcctaaccggtcgtaggttacctacgtttacgtaaggttactttcgtttaacgtacgtttaagttttaccttacgtcgttacgaagttaacgttacgttaagttaacttaccgggtccggttaccgtagggtttaccccgacggtaacccggtaaacggttccggaaacggtaggttaaaccgttaccggaaacggttcggtcggtacacgtacccgtaccgtanacggtttccttcgttaaccgtacccg

SEQ ID NO: 78099 - DNA, 641 bp, Homo sapiens
  misc_feature: GYAE6OF01EUFCC.22.29.C07.1.454.CMB.1.raw
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (299)..(299): a, c, t, g, unknown or other
  misc_feature (299)..(299): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctcgagggaancgccacctctccngcagggccagtcagagtatacgcaacaacgttcgccttaggtaccagacaggacgccgtggaccaggccctacccgaggcctccctntactcgttagtcggtacgtcctttccgaaccgacgggtcctacgttcggtacctcccccgacgtacggttaccaggtcgaccgtagggttcgggtacgtagggactaaggtcgttctaaccgtctaccgaccagtaccgagccacgtccgtgcgtagttctaagtaagttacgttttacgactttacgttttaattacttcgtactaagtactaattagttaacgtcgttaacgttgttacctacgtacttaccgtaccgttacggaccgtaacgggacacgtacggtacggtaagtaaacgtaacggacgtggtacgacgttagacccgtactattgtccg

SEQ ID NO: 78100 - DNA, 869 bp, Homo sapiens
  misc_feature: GYAE6OF01BS05B.22.29.C07.1.454.CMB.1.raw
  modified_base (201)..(201): a, c, t, g, unknown or other
  misc_feature (201)..(201): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccgaggcacctgtctgtgtctcgaagggaacncgcccacctctctgcgacgggccagtcaagtagttacttagaccaaactacgttacgacccgttaggtaaccacggtcgaacggacgtaacccgtcgggacccgaacggggtcccttaccccggacggtcccttacccctacgtaactttccgttaagttcggtttaccgaccttacgttacccgacgggtacccgtaaccggggtaccccctaaccggtttaacccgggttaaccccccgaagggttacccccggttaaaggggttttccgaacggggttccgggaccgggttaaggggttccggggttaccggtacggggtaacgtaacgggttacggttaccctaaccgttaccgtacccgtaacctacgtaccgtaccggactaaccggtccgttacggacgttaacgtaccgttaaggtaacgtttacgttttacggtaacgttttaacgtttttaacgtacgttcgtaacggtacgtaacgttaacgtttaactttaacggtttaccggtccggttaaccggtttccggtaacgggtttacccggaaccgggtaaccggggtaacgtaacggggtaacggtaaacgtaaccggtaaacgttacgggttcggtacggtccgaccgtacccttaaccgtagtttccgttcgttccgttaacccg

SEQ ID NO: 78101 - DNA, 902 bp, Homo sapiens
  misc_feature: GYAE6OF01DXHE5.22.29.C07.1.454.CMB.1.raw
  modified_base (140)..(140): a, c, t, g, unknown or other
  misc_feature (140)..(140): n is a, c, g, or t
  modified_base (170)..(170): a, c, t, g, unknown or other
  misc_feature (170)..(170): n is a, c, g, or t
  modified_base (345)..(345): a, c, t, g, unknown or other
  misc_feature (345)..(345): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtnccagtgcagaagtagtgatgacgcagtccnccgaggcctaccctgtctgtcgtccgtaccggaaggggaaacgcgcccgtaccctcctcctgcgacgggcctaaggtcaggtacgtaagttacgactaaactaacgttacgaccgtggtaaccacggacaaggtaacgccgtcggaccgacggtcccacccgacggtcctacctnacttcgttacgttgtacgacctactccggtagccgggtaacggtaccctaaccggttacccggtaaccccgtaggtcccggttaacggtttaccgaggggtaccggtacgtacggggtacgggggttaccgttacggggaacgttaagggtaccctttaccggtaaccttccccggtaacctacccggtaagttaccccgggacggacctaaccgggtacccttacgggtacccgtttaacggtaacggtttaaacgtaacgggtttttaacgttttcggtaaaccgttttaacgttttaacgttttaccgtaacgttacggtaaacgttaaacggtttaaagtttaacccgtttaaaacggttcccgggttaaccgggttcccggtttaaccggggttaacccgggtacggggttaaacccgggaaaccgggtaaccgggtaaaacggggttaacgggtaaacccgtaaaaccgggtaacggttaaacggggttggaccccggtacgaccgtaacccgtaacgtaaccgttcgtttcccgtaaacttttaccccgg

SEQ ID NO: 78102 - DNA, 696 bp, Homo sapiens
  misc_feature: GYAE6OF01ESIAH.22.29.C07.1.454.CMB.1.raw
  modified_base (389)..(389): a, c, t, g, unknown or other
  misc_feature (389)..(389): n is a, c, g, or t
  modified_base (451)..(451): a, c, t, g, unknown or other
  misc_feature (451)..(451): n is a, c, g, or t
tcagacatacgcgtcacgaccggtgctcgatttagagtgctacgaagggaaggggaggaactgctcagttaggacccagacggaaccatggaagccccagcgcagcttctcttcctcctgcctactctggctcccagactacccacgtgggataaagtagtgattcggaacgcagttcctccgagcccaccctggtcttggtgtcctaccgaggggaaacgcgtcccaccctctcctgaccgacgggcctaagtcaaggtagttacgtacgacctaaactaacgttagtccgtaggtaccagacagacgcctggccaggcctaccgacggcctcctctagtctaggtggttcgtccttcgaaccggcgggaccctacggttcggtaccnccccggtacgtaggtcagtcgcgtagggtcggtcgtaggaactggaccttcactcactaccntcgagtcacgtcctagctagtacgtagtacttcttacgtacttacgttttactacgttgaacgtacgtaactaacgttaatacgttacgtacgtttacggttacgttaccggtacttacccgtacccgttaaccggaccggaaacggtaccgtacggtacggttaaccggaagtttaaaccgttaaaccggagttacgggtaccacgtaccgacctacccgttagttaccgttccgtttaacccg

SEQ ID NO: 78103 - DNA, 766 bp, Homo sapiens
  misc_feature: GYAE6OF01EU4B5.22.29.C07.1.454.CMB.1.raw
  modified_base (207)..(207): a, c, t, g, unknown or other
  misc_feature (207)..(207): n is a, c, g, or t
  modified_base (214)..(214): a, c, t, g, unknown or other
  misc_feature (214)..(214): n is a, c, g, or t
tcagacatacgcgtcacgaccggtgctcgatttagagtgctacgaaagggaaaggggaggaactgctcagttaggacccagacggaaccatggaagccccagcgcagcttctcttcctcctgcctactctggctcccaggtgccagtgcagaagttagtgatgacgctagtctccgaggcctacctgtctgtgtcgtcgaagggaanctacccncctcactgcgaggcctagtacaggtatatacgacaaacgtaacttacgccgttagtaaccagacgaaggacgtaccgtcggaccgacggccctacccggacggtccctacctactacgttacgttacgttcggtcacctaccgtccgacggtaccggacccgggtacccgtacccggttaccggaacccccgaggtacccggtaggttacggaggtcgggtacggtagggttcgggtacggtacgggaacgtagggttacctcctaacgttcccgacctaacgtacctcgaacgtccgacgtccgtacgtaacgtagttacgtaagttagttacgttttcggtacttttaagttttacgttacgttacggtacgtacgtacgtacggttaaccgtaaccggtacggttccggttaccgttaccggttcgggttaccgggaccggggacgggtaacccgtaggtacgggttggaaacggtaccgtaaccggtagggtaacccgtagggttacccgggttacggacgtacgtaacccggttactcggtttcccg

SEQ ID NO: 78104 - DNA, 828 bp, Homo sapiens
  misc_feature: GYAE6OF01BGTH4.22.29.C07.1.454.CMB.1.raw
  modified_base (221)..(221): a, c, t, g, unknown or other
  misc_feature (221)..(221): n is a, c, g, or t
tcagacatacgcgtcacgaccggtgctcgatttagagtgctacgaagggaaaggggaggaactgctcagttaggacccagacggaaccatggaagccccagcgcagtcttctcttcctcctgcctacgtctggctcccaggtcgccagtgcagaagtagtgagtcgacgctagtcctccgaggcctacccttgtcgtgtcgtcctaccggaaggggaaacnccgccctacccgttctcctgacgacggtccagtccaggtacgttgttacgactaaaccgtacgttagtaccgtacggtaccacgtacgaacggtaccgaaccgtcggaccgtaccggtccctaccggacggtccctacctcgtactcgttacgtcggttacgtaccttaccgaccggtcgggtaccctggttaccgtaccctccccgagttacgtccgtaagtccgacgtgggtacggtcgtacggacgtacggtcgtacccgtacctccgtacgaaccctacgtaccgaccggtcccgacgttcccggtacgtacgttacggttaacccttaagggttaaccgtttacgtttaccgttaccgttttaaacgttttaacccgttaacggttacttacggaaacgttaacttaaaacgttaacgtttaaccgtttaacggtaccggttttaacgtttcccgtaacggttaccttaacccggtacccgtttaccgggaaaccggtaaccggtaacgtaaccgggtaaggttacggtaaaccggttaaacgttaacggttaccggttagtccgtaccgttcgaacccgtttaccgtccgttagttacccg

SEQ ID NO: 78105 - DNA, 745 bp, Homo sapiens
  misc_feature: GYAE6OF01BGHD9.22.29.C07.1.454.CMB.1.raw
  modified_base (201)..(201): a, c, t, g, unknown or other
  misc_feature (201)..(201): n is a, c, g, or t
  modified_base (411)..(411): a, c, t, g, unknown or other
  misc_feature (411)..(411): n is a, c, g, or t
tcagacatacgcgtcacgaccggtgctcgatttagagtgctacgaagggaaaggggaggaactgctcagttaggacccagacgggaaccatggaagccccagcgcagcttctcttcctcctgctactctggctcccaggtgccagtgcagaagtagtgatgacgcagtctccaggcaccctgtctgtgtctcgaggggaancgccaccctctcctgcgaggccagtacgagagtattacgactaaactaacttcgaccgtggtaaccagacgaggacgaccgtcggaccgacgggtccctcccgaggtccctacctctactcttagttggtacgcacgtccgaggcgacgggcctacgtccggtaccccacgtccgtaggtccaggtcgcgtagggtcggtcgagggacgngtacgttccactcctacaacgtcgtacacggccacgtcccgtagaccgtacgttacgtaacggttaacgtttagttttaccgtaaggttttacgtttttaacgtttaccggttctaccggtaaagttacgttaaagtttaaactttaccggtttaaccggtccgggtttacccggttaccgggttaaccgggttccccgggtaaaccggggtaaccgggaacccgggtttaaaggggaaaccgttaaaccggtaaccggtaaaccggtacgtttcggggaaaccgttcgtaaccgtaccgacgtttacccgtcgtttccgggtaccttaacccg

SEQ ID NO: 78106 - DNA, 838 bp, Homo sapiens
  misc_feature: GYAE6OF01ESHF8.22.29.C07.1.454.CMB.1.raw
  modified_base (201)..(201): a, c, t, g, unknown or other
  misc_feature (201)..(201): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctcaggccacccttgtctgtgtctcgaggggaancgccctaccctctacgtcggcgtacgggacctagtacgaacggagttaacgttaacaccgtaaactaacgttttaacggcccgttagggtaaccaggtacaacggtacggacccgttgggacccgtacgggtcctaccccgtagggccccttaccccttacgtagtttcttacgtttcgggtttacacccgttacgtaccgtacggacccggtaccgggaccctaccggtacccggtacccgaagtcccgtagggtctaggtcggacgttaggtccgggtacgtacgggaacgtaggtacgttacgtacctaccgtaccgtactaacgtcgaacgccgtaacgtccggtacggacgtaaccgtttcgtaaagggttacttaacggttttacggtaactttaacggttttacttacggtacgttacgtaaccggtattaaacgttaacgtttaccgtacggttcccgggttaccggttaacccgggttacggtaacccgggtaacgtaaccgggttaaacggggtaacggggtaaaccggtttaaaccgtaacggttaaagggttaccgtccgggttaccgtaaacgggtcccgacccgtttaactaaccggtttcctttaacggtcccgtttaaccg

SEQ ID NO: 78107 - DNA, 995 bp, Homo sapiens
  misc_feature: GYAE6OF01C0Y0N.22.29.C07.1.454.CMB.1.raw
  modified_base (122)..(122): a, c, t, g, unknown or other
  misc_feature (122)..(122): n is a, c, g, or t
tcagacatacgcgtcacgaccggtgctcgatttagagtgctacgaagggaaagggggaggaacgtgcctacgacgttaggacccgaaggaccgggaaccgtattcggaaagtccccgaggcnccgagcttccgtcttacctccagactacctcgcgctccgtaggttcgacctagtcggcgtaggtacgtagtgtacgtagtaacggcgtacgtccgtaccgaggtaccaccgtgtcctaggttcggtaccggtaacgggacgggggaaacgggtccaacccgtcccgttcggtccgtacgggaccggccggtaccgttaaccgacggtacgtaacggtttacgtaacgaaccggaaaacccgttacgttaaccggtccggtttacgtaacccggtaacgtaaccgtaacggtaaaccggtccggtaccgggaccgtaccgggtaccggtacccggtaccggttacctaccgttacccgtaaacgtccggttaaacggttcggttaccggtaacgttaccgtccgggtaccggtacgggtaccggtttaccgttaccgggtaaccccggtaaccggtacggtaccggtttaacgttaaccgggttagaacccggggttaaggtacggtttaccggggtaaccggtaaccgggtaaccgttaacgggttaccgtacccgggtaacccgttaccgaacccgtaacgtaccgtaaccgtaaccggtaccggtaccgtaccgtaaccgtaacggtaaacgtaacgttaaacgggttacttaacggttacgttaacgttaacgtaacggtacgttaacgtacgtaaacgtaacggtttaaccgtaacgtttaccggttaccgggttaccggtacggttacgttaccgggtaacgttacccgggaaaggtaacggggtaaacgggtaacggtaacgtaacggtaaggtacggtcgaccggttagaacccgttacgtacgtacgtcgttccgtggttaaccg

SEQ ID NO: 78108 - DNA, 855 bp, Homo sapiens
  misc_feature: GYAE6OF01DDNY8.22.29.C07.1.454.CMB.1.raw
  modified_base (142)..(142): a, c, t, g, unknown or other
  misc_feature (142)..(142): n is a, c, g, or t
  modified_base (220)..(220): a, c, t, g, unknown or other
  misc_feature (220)..(220): n is a, c, g, or t
  modified_base (541)..(541): a, c, t, g, unknown or other
  misc_feature (541)..(541): n is a, c, g, or t
tcagacatacgcgtcacgaccggtgctcgatttagagtgctacgaaggggaaaggggaggaactgctcagttaggacccagacggaaccatggaacgccccagcgcagcttctcttcctcctgctactctggctccgaggtnccagtgcagaaggtatgatgacgcagtcctccgaggccctaccgtgttctggtacgttccgaccggaaggggaaaacnccgcccacccttcctcgtacggacgacgggtcctaggtctaggtaacgttaagttaccgaaccaaactaaacgttacgaccgttacggtaaccagacgtaacggacgtaccgtcggaccctacggcccaccccggtagaccccttaccgtacgtaagtttaccttaggttcggtttaccgcctaccaccggtaacggcccggtaacgggtacccgtacccgtcccggtaaacccccggatacccggtacgttacgaggtacggtacgtcgggttcgggtacgtacgggacttaggacgttcctacgttacctaccaacgtnaacgtacgcgtaaccgtcgtacgcgtacgtaacgttaactagttttactttacggtaaccttttaacgggtttcttaacggttcgttaacggtacttacgttaaacggttttaacccgtaaacggtttccggttaggtaccccggtttaaccggtaaccgggtttaccccgggaaaccggttaaaaccggggtaaaccgggtacgggtttaaagggtaaaacccggtaaaccgttaaaccgggtggtttacgggacccgggttagaaccccgtttacgtaccgttaggtttccttaaccgtttcttaccccggg

SEQ ID NO: 78109 - DNA, 487 bp, Homo sapiens
  misc_feature: GYAE6OF02IQWOW.22.29.C07.1.454.CMB.1.raw
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctccaggctctcatctatgttgcatccagcagggccactggtaccccagccaggttcagtggcagtgggtctggggacagagttcactctcacatcagcagcctagagcctgaagatttgctagtttattactgtcagcagcgtagcaactcctcacgttcggcggagggaccaggtggagatcaaacgactgtggctgcaccatctgtctc

SEQ ID NO: 78110 - DNA, 502 bp, Homo sapiens
  misc_feature: GYAE6OF02F8LJ1.22.29.C07.1.454.CMB.1.raw
  modified_base (201)..(201): a, c, t, g, unknown or other
  misc_feature (201)..(201): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaanagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgctagtttattactgtcagtcagtataattactggcctcggacgttcggcctaagggaccaggtggaacgtcgaaacgacgtgtaggctgcaccatctgtcttac

SEQ ID NO: 78111 - DNA, 495 bp, Homo sapiens
  misc_feature: GYAE6OF02FXTK2.22.29.C07.1.454.CMB.1.raw
  modified_base (201)..(201): a, c, t, g, unknown or other
  misc_feature (201)..(201): n is a, c, g, or t
  modified_base (393)..(393): a, c, t, g, unknown or other
  misc_feature (393)..(393): n is a, c, g, or t
  modified_base (479)..(479): a, c, t, g, unknown or other
  misc_feature (479)..(479): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaangccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagtnttttgctagtttattactgtcagtcagtattattactggctcggacgttcgacgaagggaccaggtggaagtcaaacgactgtggntgcacatctgtcttcg

SEQ ID NO: 78112 - DNA, 507 bp, Homo sapiens
  misc_feature: GYAE6OF02H9GD2.22.29.C07.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
tcagacatacgcgtcacgaccggtgctcgatttagagtgctacgaagggaaaggggaggaacgtgctcagttaggacccagacggaaccatggaagccccagcgcagcttctcttcctcctgctactctggctcccaggtgccagtgcagaagtagtgatgacgcagtctccaggcaccctgtctgtgtctccgaggggaaanagccaccctctcctgcagggccagtcagagtattagcaacaacttagcctggtaccagcagagacctggccaggctcccgaggctccncatctatgttgcatccagcagggccacgtcggaccccagccaggttccaggtgacaggtgggctggggacagagttcactcacgaccatcagcagcctgcngtctagaagttntttgctagtttatctgtcagtcagtataatcgtgccttgaccgttgacgaaggaccaggtaggaagtcaaacggtatgtcgatgaccacctatactgtctacg

SEQ ID NO: 78113 - DNA, 453 bp, Homo sapiens
  misc_feature: GYAE6OF02F8PWH.22.29.C07.1.454.CMB.1.raw
  modified_base (424)..(424): a, c, t, g, unknown or other
  misc_feature (424)..(424): n is a, c, g, or t
  modified_base (426)..(453): a, c, t, g, unknown or other
  misc_feature (426)..(453): n is a, c, g, or t
tcagacatacgcgtcacgaccggtgctcgatttagagtgctacgaagggaaaggggctggagtgggtctcaggtattagtgataatgcttttagcacaaactacgcagactccgtgaagggccggttcaccatctccagagacaattccaagaacacgctgtatttgctaaaatgaacagcctgagagccgaagacacggccgtctagttactgtgcgagagttaccgcatacggtgactacctactttctcgactggggccagggaaccctggtcaccgtctcctcagcctccaccaagggcccatcggtcttccccctggcgccctgcctccaggagcacctccgagagcacagcggccctgggctgcctggtcaaggctactccacgcgtatgtctgagcgggctggcaaggcgcatacgnannnnnnnnnnnnnnnnnnnnnnnnnnnn

SEQ ID NO: 78114 - DNA, 552 bp, Homo sapiens
  misc_feature: GYAE6OF02GU0AR.22.29.C07.1.454.CMB.1.raw
tcagacatacgcgtcacgaccggtgctcgatttagagtgctacgaagggaaaggggaggaactgctcagttaggacccagacggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagagacttcactctcaccatccaacagcctagacgcctgacgattctgctagtttattactgttcgacgcagcgtacaagtcggccctccgtacgttttcggaccgtacgggggccaaggcgtagggagacgtacgacggaccgtaacgtggtacggtcgtaggccacctacgttcgtcgttcttctacttccttaccccg

SEQ ID NO: 78115 - DNA, 500 bp, Homo sapiens
  misc_feature: GYAE6OF02FNZNM.22.29.C07.1.454.CMB.1.raw
  modified_base (201)..(201): a, c, t, g, unknown or other
  misc_feature (201)..(201): n is a, c, g, or t
  modified_base (391)..(391): a, c, t, g, unknown or other
  misc_feature (391)..(391): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaangccaccctctcctgcagggccagtcagagtatagcaacaacttagcctggtaccagcagagacctggccaggctcccaggctcctcatctatgttgcatccagcagggccactggtaccccagccaggttcagtggcagtgggtctgggacagagttcactctcaccatcagcagctgcagtctagaagnttttgctagtttattactgtcagtcagtataacttatggcctcggacgttcggaccaagggacctaggtcggaagtcaaacgactgtacggctgcaccatctgtcttcg

SEQ ID NO: 78116 - DNA, 498 bp, Homo sapiens
  misc_feature: GYAE6OF02HICR8.22.29.C07.1.454.CMB.1.raw
  modified_base (394)..(394): a, c, t, g, unknown or other
  misc_feature (394)..(394): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagtnttttgctagtttattactgtcagcagtataattactggcctcggacgttcggaccaagggaccaggtggaagtcaacgaactgtggctgcacctatctgtcttc

SEQ ID NO: 78117 - DNA, 562 bp, Homo sapiens
  misc_feature: GYAE6OF02F7EJM.22.29.C07.1.454.CMB.1.raw
  modified_base (201)..(201): a, c, t, g, unknown or other
  misc_feature (201)..(201): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccagccaccctgtctgtgtctccaggggaaangccacactctcctgcagggccagtcagagtgttagcagcagcttagcctggtaccagcagaaacctggccaggcctccaggctcctcatctatggtgcatctacgagggccacgtggtactcccagccaggttcagtggctaggtgggtctggggacaggtagttcactctcaccatcagcagcctgcagtctagtaagttatttgacttagtttattactgtctagtactacttaataataacgtcggtacccttacgttaacgtacgttttcgggaccgtacggggacctaacggtccgtagggaacgtaagtaaccgaaacggtaaccgttggtacggtacgttacggaccctaaccg

SEQ ID NO: 78118 - DNA, 569 bp, Homo sapiens
  misc_feature: GYAE6OF02JA040.22.29.C07.1.454.CMB.1.raw
tcagacatacgcgtcacgaccggtgctcgatttagagtgctacgaagggaaaggggaggaactgctcagttaggacccagacggaaccatggaagccccagcgcagcttctcttcctcctgctactctggctcccagagaccaccggagaagttgtgttgacacagtttccagccaccctgtctttgtctccaggagagcgggccacctctcctgcagggccaatgagagtattagcgactacttagcctggtaccaacagaggcctggccaggctcccaggctcctcatgtatgatgcttaccaaaagggccacgtggcatcccagccaaggttcagtgcgagtggtctagaagagactttacacgtctcgaacctagtaccaacgacgaccctagacgcctgacgtaattctgactagtttatactgtcagtcagacgtactagtcgcctcgtacgtttggaccgtacggggaccaagcgtaggacgagtcacggtacgtaacgtacggtaggccgtaggtcctaaccgacgttcgtacggttcctttacgtacgttccttacccgg

SEQ ID NO: 78119 - DNA, 517 bp, Homo sapiens
  misc_feature: GYAE6OF02F7AX4.22.29.C07.1.454.CMB.1.raw
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcaggtggcagtgggtctgggacaggagttcactctcaccatcagcagcctgcagtctagagtatttgctattttatactgtcagctagttatattactggccttacggacgttcggacgaagggacctaagggttggaacgttacgaaacgtacgtgtacggctgccaccgatctcgtcttacg

SEQ ID NO: 78120 - DNA, 535 bp, Homo sapiens
  misc_feature: GYAE6OF02GDDC7.22.29.C07.1.454.CMB.1.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaanagccaccctctcctgcagggccagtcagagtgttagcaacaacttagtctggtaccagcagacgacctggccaggcctcccgaggcctcctcatcctatggtntcttcaccgagggccacgtggtactccccgcaggttcagtcgccgagtgggtctgggacaggattcacttctcacatcagcagcctgctagtctagaagtatttgcttactttatactgtcagtcaattatatgacttgttctgtacttctaccgttcggaccgtaagggccacggtacgtggaagtaacgttaaacgacttggtacgctacgacctacgtactcgtacg

SEQ ID NO: 78121 - DNA, 517 bp, Homo sapiens
  misc_feature: GYAE6OF02GYGU3.22.29.C07.1.454.CMB.1.raw
  modified_base (201)..(201): a, c, t, g, unknown or other
  misc_feature (201)..(201): n is a, c, g, or t
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaangccaccctctcctgcagggccagtcagagtattagcaacaacttagcctggtaccagcagagacctggccaggctcccaggctcctcatcctatgttgcatccagcagggccactcggtacccccagccaggttcagtgcagtgggtctgggacngagttcactctcaccntcagcagcctgcagtctgaagtattttgctagtttatacttgtcagctagtataattctaggtcctcggtacgttcggaccgtaacgggactagggtgaacggtcgaaacgtactagtggacgtgccacctatcttcgttctacc

SEQ ID NO: 78122 - DNA, 652 bp, Homo sapiens
  misc_feature: GYAE6OF02IQK7Q.22.29.C07.1.454.CMB.1.raw
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaagcgcccacccgtctcctgcagggccagtcagagtattagcaacaacttagcctggtaccagcagagacctggccaggcctcccgaggcctccgtcatctatgttcgctactccagccgagggcccacgtcggtaccccagccgtaggttcaggtcgcgtaggtcgggtctgggactaggtacgtttcacctcgtaccaccgtagtaccgagccacgccctagacgtacgtcgtaggtaacgttgtttagtacgttagttttacttacgttgtactagtacgtaagttaacgttaacgtttacgtcggtaccgttacgggtaccggtttacggaacccgtaagggtaaccgtaaggggtaacggtaacggtaaccgtaaaccggtaacgttaccgggtacggtccggttaccgtaaccgtacccttacgttccgttacgttaccgttaaccg

SEQ ID NO: 78123 - DNA, 561 bp, Homo sapiens
  misc_feature: GYAE6OF02GRYDO.22.29.C07.1.454.CMB.1.raw
  modified_base (407)..(407): a, c, t, g, unknown or other
  misc_feature (407)..(407): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaagagccaccctctcctgcagggccagtcagagtattagcaacaacttagcctggtaccagcagagacctggccaggcctcccgaggcctcctcatctatgttgcatccgagcgagggccacgtcggtaccccagccaggttcagtggcaggtgggtctgggacagagttcactctcaccatcagcgagcctgcagtcgtagtaagtntttgacttagtttattactcgtcagtactagttaattaagttacgtcggtccttaccgtacgttacggtttcggaccgtacggggtaccacggtcgtagggaacgtacgtaaccgtaaaccgtacgttggtcggtacgtcgacctacgtattcg

SEQ ID NO: 78124 - DNA, 542 bp, Homo sapiens
  misc_feature: GYAE6OF02HUG5L.22.29.C07.1.454.CMB.1.raw
  modified_base (201)..(201): a, c, t, g, unknown or other
  misc_feature (201)..(201): n is a, c, g, or t
  modified_base (396)..(396): a, c, t, g, unknown or other
  misc_feature (396)..(396): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaangccaccctctcctgcagggccagtcagagtattagcaacacttagcctggtaccagcagagacctggccaggctcccaggctcctcatctatgttgcatccagcagggccacgtcggtaccccagccaggttcagtggcaggtgggtctgggacagagttcactctcaccatcagcagcctgcagtctagaagtnttttgctagtttattctgtcagctagttaattaagttacgtggtccttacgggtaccgtttaccgggaccgaagggtaaccgtaagggtggtaaagtccgaaaacgtacgtaggtagggtctgaccacctacgttctgtcttaccg

SEQ ID NO: 78125 - DNA, 511 bp, Homo sapiens
  misc_feature: GYAE6OF02GDSQJ.22.29.C07.1.454.CMB.1.raw
  modified_base (287)..(287): a, c, t, g, unknown or other
  misc_feature (287)..(287): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtatagcaacaacttagcctggtaccagcagagacctggccaggctcccaggctccncatctatgttgcatccagcagggccactcggtaccccagccacggttcaggtgcaggtgggtctgggacagagttcactctcacatcagcagcctgcagtctagaagtatttgactagtttacttactgtcagctagtatattcgtagtcctacggacgttcggaccaacgggaccaggtgaagtcgaaacgacgtgtcggtctagcacctagtcttgtcttac

SEQ ID NO: 78126 - DNA, 556 bp, Homo sapiens
  misc_feature: GYAE6OF02GC1IC.22.29.C07.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaanagccaccctntcctgcagggccagtcagagtattagcaacaacttagcctggtaccagcagagacctggccaggctcccaggctcctcatctatgtgcatccagcagggccacgtcggtaccccagccaggttcagtggcagtgggtctgggacagagttcactctcacatcagcagcctgcagtctgaacgtattttgctagtttacttactgtcagctagtataattactcggtccgtacggtacgttcggaccgtaacgggtaccgagggttacggtaacgtaaccgtaaaacggtaacgttaggtacggtacgttacggaccgtaaccgtattaccgttcgttccttaccg

SEQ ID NO: 78127 - DNA, 568 bp, Homo sapiens
  misc_feature: GYAE6OF02IMICN.22.29.C07.1.454.CMB.1.raw
  modified_base (203)..(203): a, c, t, g, unknown or other
  misc_feature (203)..(203): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaagngcccaccctctcctgcagggccagtcagagtattagcaacaacttagcctggtaccagcagagacctggccaggctcccaggctcctcatctatgttgcatccagcagggccatcggtaccccagccaggttcagtggcaggtgggtctgggacagagttcactctaccacatcagcagcctgctagtctagaagtattttgcttagtttacttacgtgtacagctaagttaattaagttacgtcggtacctcggtaacgttccggaccgtaagggtaaccgtagggtaggaacggtaacgaaaaccggtacgttaggtacggtaccttacggaccgacccgtagtaccgttacggttcttaccg

SEQ ID NO: 78128 - DNA, 571 bp, Homo sapiens
  misc_feature: GYAE6OF02IDJVX.22.29.C07.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (408)..(408): a, c, t, g, unknown or other
  misc_feature (408)..(408): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctcaggcacctgtctgtgtctccaggggaaangccaccctntcctgcagggccaggttcagagtattagacaacacttagcctggtaccagcagagacctggccagggcctccgaggctcctcagtctatgttgcatccagcagggccagtcggtaccccagccaggttcaggtgcaggtgggtctgggacaggacttcacttctaccaccatcgagcagcctggctagtctagtaagttntttgcttagtttattactgtcagtctagttaattattacgtggtaccttcgggtacgttcggaccgtaagggacctaagggtacgggaacgttacggaaaaccgtacgtacggttacggaccgttacggacctaaccgtacgttcgttacggttaccttaccg

SEQ ID NO: 78129 - DNA, 564 bp, Homo sapiens
  misc_feature: GYAE6OF02GCN7J.22.29.C07.1.454.CMB.1.raw
  modified_base (362)..(362): a, c, t, g, unknown or other
  misc_feature (362)..(362): n is a, c, g, or t
  modified_base (403)..(403): a, c, t, g, unknown or other
  misc_feature (403)..(403): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccgttctcctcgtctttggtgcggccgacgacgggccacgggcactccccgtgacagattcgagtggcaggtcgggtccgggtnagactatctgctcaccagtccggcggtctggaactgaagtnttctgactatatattactgtacagtctttaatgttacttccacctcgtactatacttctttcgggaccgaacggggtaccaacggtcgtaggactacgttaaccgaaaacgtacgtggtacggacgtgacctacctatccgttaggttccttacgtacccg

SEQ ID NO: 78130 - DNA, 728 bp, Homo sapiens
  misc_feature: GYAE6OF02HR0MB.22.29.C07.1.454.CMB.1.raw
  modified_base (201)..(201): a, c, t, g, unknown or other
  misc_feature (201)..(201): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctcgaggggaaancgccaccctctcctgcagggccagtcagagtatagcaacattgcctaggtaccagcagacgacctggccaggcctccgagcctcctcatctatgtcgcagtccagcacgggccacgttcggtaccccagccgtaggttcaggtcgacgtagggttcggtacgtggggaactaggtacgtttccgaacctttccgtaaccaaacccgtagtacgtaacgaccgtaacgtcccgttacggaccgtaacgttccgtaaggtaacgtttacgtttttacggacgtttaagtttttaacgttacgttacgttacgtaacggtaccttaacggtttaactttaaacgtttaccggtacggttacccgttaccgggttaaccggtttacccggaaccggttaaaccggggaaccgttaacggggttaccgggtaaaacggttaaccggtaaaaccggttaacgttacgggtaccggtacggttaccgtaacccgtaaccgtaacgtttaccggttaccgtttacccgttaaccg

SEQ ID NO: 78131 - DNA, 555 bp, Homo sapiens
  misc_feature: GYAE6OF02H212H.22.29.C07.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (328)..(328): a, c, t, g, unknown or other
  misc_feature (328)..(328): n is a, c, g, or t
  modified_base (372)..(372): a, c, t, g, unknown or other
  misc_feature (372)..(372): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaangccaccctntcctgcagggccagtcagagtatagcaacacttagcctggtaccagcagagacctggccaggctcccgaggcctcctcatctattgttgctatccagcagggccacgtcggtaccccngcctaggttcagtggctaggtgggtctgggacaggattcactcncaccatcagcacgcctgctagtctagtaagttatttgactttagtttattacttgtctaagtctaagttattaacttacgtcggtacccgttacggtaccgttcggaccgtaagggtaccgaagggttaggaacgtacgaaacgtacgtggtacggcgtgaccgacctacgtctcgtcttacc

SEQ ID NO: 78132 - DNA, 675 bp, Homo sapiens
  misc_feature: GYAE6OF02I8HEW.22.29.C07.1.454.CMB.1.raw
  modified_base (202)..(202): a, c, t, g, unknown or other
  misc_feature (202)..(202): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctacgaggggaaancgccaccctctcctgcagggccagtcagagtatagcaacacttagcctggtaccagcgagacgacctggaccaggcctccaggctcctcatctattgttcgactactccaggtccgaacgggccctacgtcgggtacccccaggtccgtacggttcgaaggtcggacgtacggtcggggtcgtacggggaactaacgggtacgtttaccaccggttacctaccgaaaccgtacgttaccgaacggcccgtaaacggtccccgtagtacccgtaaacggttcgtacggtaaagttacgttttacggaaccttaaggttttactttaaccgtgtaccgtaggtactaacgttattaaccgtttgtacggtccttacgggtcgttacggaaccgtaacggaaccgtaggtcgaaacggtacggaaacgtaccgtgtacggtactacggtacctacgacgttcgttacgtcttaacg

SEQ ID NO: 78133 - DNA, 701 bp, Homo sapiens
  misc_feature: GYAE6OF02HAD3W.22.29.C07.1.454.CMB.1.raw
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
tcagacatacgcgtcacgaccggtgctcgatttagagtgctacgaagggaaaggggaggaacgtgctcagttaggacccagacggaaccatggaagccccagcgcagcttctcttcctcctgctactctggctcccaggtgccagtgcagaagtagtgatgacgcagtctccaggcaccctgtctgtgtctcgaggggaaancgccaccctctcctgcagggccagtcagagtactagacaaacaacttgcctaggtacagcagacgacctgccaggcctcccacggctccgtnactctatgttcgcatccgagcacgggccacgtcggtaccccagcgaggttcaaggttgcgagtgggtcgagggacagtagttccacgtcacctaccgtatcgaagtcgaacgtccgtaggacctacggttcgtaaggttaacgttattttaccggtaatttacggtttagtttaccgtaggttcctaacggttacgttaacggttaacttaaaacgtttcggtaccggttaccgtttaccgggtaacccgggtttaccggtaaccggggtaaaccgggtaccggtaacggggttacgggtaaaccggtaaccgggttaaaacccgggtaacggttaccggttacggtaacgttacgggtaaccgtaccgttaaccgttaccggttttccgttaaccgtttaacccgg

SEQ ID NO: 78134 - DNA, 677 bp, Homo sapiens
  misc_feature: GYAE6OF02HA1D1.22.29.C07.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
tcagacatacgcgtcacgaccggtgctcgatttagagtgctacgaagggaaaggggaggaacgtgctcagttaggaccagacggaaccatggaagcccagcgcagcttctcttcctcctgctactctggctcccaggtgccagtgcagaagtagtgatgacgcagtctccaggcaccctgtctgtgtctcaggggaaangccacctcncngcagggccagtcagngtatagcaactaacttagcctaggtaccagaccaggtaacaccgtggcccaagggtcctaccccgaagggccttcctctaatccgttaattggttcgactactcccagccgaacggggtcccacgttaccgggtaacccccaggtcccgtaaggggtttccaagggtcggactaagggttcggggtctagggggaactaggacgtttccaacttccgtacaccctagtacgacgtcgacgtccctagctagtccgtaggaaagttacgttttggaacctttaaggttttacttaccgttagtcgaacgtcgtaaagttaattaaacgtttaccgtaggtacccgttacggtaaccggttcgaaccgttaagggaaccgtaacgggttaggaacgttaacggaaacgtaacgtaggtacggtacgtacgacaccgtagtactacgtcttaccg

SEQ ID NO: 78135 - DNA, 684 bp, Homo sapiens
  misc_feature: GYAE6OF02H4X51.22.29.C07.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccagccaccctgtcctgtgtctccgaggggaaangccacactctcctgcagggccagtcagagtgttagcagcagcttagcctggtaccagcaagaacctggccaggctcccaggctccncatctatggtncatcgtacggacgggcctacgtggtacctccgacggcctaggttcaggtcgggactagggttcggggtctgggggaacaggtacggttccaacctttcctaccgtaaccgtacttaccgacggtccgtaacggtcccgtcggtacctacggtaccgttaggtaaaggttacgttttttcggacgtttaacgtttttaacgttacgtttcgtacgtaacggtaccttaacttaaacttaaacttaaccgttcggtacccgttacccggttaacgttacgggttttaccgggaccgggtaacggggtaccggtaaggtaccggttagggaacgttaacgtaaccgtaaacggttacggtcggttacggtcgtacgtaccgtaaccg

SEQ ID NO: 78136 - DNA, 556 bp, Homo sapiens
  misc_feature: GYAE6OF02F5NLV.22.29.C07.1.454.CMB.1.raw
  modified_base (202)..(202): a, c, t, g, unknown or other
  misc_feature (202)..(202): n is a, c, g, or t
  modified_base (410)..(410): a, c, t, g, unknown or other
  misc_feature (410)..(410): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaangccaccctctcctgcagggccagtcagagtattagcaacaacttagcctggtaccagcagagacctggccaggctcccaggcctcctcatctatgttgcatccagcgacgggccacgtcggtacccccagccaggttcaggtcggcaggtgggtcgtgggacagtagttcactctaccacctatcacgcagcctgcagtctagaagtnttttgcttagtttattactgtcagtctagtatattacgtgtacctcggtacgttccggacgtaacggaccgtagggtacggaagtaccgaaacggtaacgtcggtaggtacgtacggaccaaccgtataccgttcgttaccttacg

SEQ ID NO: 78137 - DNA, 596 bp, Homo sapiens
  misc_feature: GYAE6OF02HLX7S.22.29.C07.1.454.CMB.1.raw
  modified_base (202)..(202): a, c, t, g, unknown or other
  misc_feature (202)..(202): n is a, c, g, or t
  modified_base (302)..(302): a, c, t, g, unknown or other
  misc_feature (302)..(302): n is a, c, g, or t
  modified_base (396)..(396): a, c, t, g, unknown or other
  misc_feature (396)..(396): n is a, c, g, or t
  modified_base (425)..(425): a, c, t, g, unknown or other
  misc_feature (425)..(425): n is a, c, g, or t
  modified_base (452)..(452): a, c, t, g, unknown or other
  misc_feature (452)..(452): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaangcccaccctctcctgcagggccagtcaggatatagcaacaacttgcctggtaccagcagacgacctggccaggcctcccgaggcctcctcatctatgttnccatccagcgacgggccctacgtccggtacccccaggcccgtaggttcaggtcggcgtaggtgggtctagggacagtacgttcactctacaccntcgagcagtcctgctagtcgtagaagttntttcgactttagtttactttctgtacngtactaagtttaataatttccgtacggtccgttacgggtaccgttacggaaccgtaacgggaccgtaaggggtacgtaacggtaaccaaacggtacgttggtacggtacgcgtaccaaccgttacgttcgttacgttccttacg

SEQ ID NO: 78138 - DNA, 874 bp, Homo sapiens
  misc_feature: GYAE6OF02JQ85Z.22.29.C07.1.454.CMB.1.raw
  modified_base (201)..(201): a, c, t, g, unknown or other
  misc_feature (201)..(201): n is a, c, g, or t
  modified_base (856)..(856): a, c, t, g, unknown or other
  misc_feature (856)..(856): n is a, c, g, or t
tcagacatacgcgtcacgaccggtgctcgatttagagtgctacgaagggaaaggggaggaactgctcagttaggaccagacggaaccatggaagcccagcgcagcttctcttcctcctgctactctggctcccaggtgccagtgcagaacgtagtgatgacgcagtctccaggcaccctgtctgtgtctccgaggggaaanacgccaccctctcctgcacgggccagtcagagttatagcaactactagccgtagtaccagctagacgtaccgtggccaggtcctaccccgagggtcctacccgttacaacgtttctacgttcggtttacgacctattcccgaggtcgaacggggtcccctaacggtccggggtaaccccccaggtcccgtaacgggtttccgaagggttcgggacccttagggggttacggggtccgttaacgggggaacccgtaaggggttaccgttttacccgtaaccgttacccgtacccgtaaccgtaacgttacccgaacggtacccgtaacggtccccgtaggtaccccgaaagggtttccgtaaccgggttaaaacgggttttctttttaccggggaacctttttaaacggggttttttaactttaacccgtttaaggggttaccctaagggtttaacccgaaagggtttttaaaccttaaacggttttaaacccggttccgggttccccgggttttaacggtaccgggttttacccgggaacccggttaaacggggaaccggttaacggggtaacgtaaacgggtaaccctaaacggggtaacctttacgggacggttccgtacgggtaaccccggttcgttaacgttaccggtttnttacccgttttaacccgg

SEQ ID NO: 78139 - DNA, 837 bp, Homo sapiens
  misc_feature: GYAE6OF02FHK35.22.29.C07.1.454.CMB.1.raw
  modified_base (170)..(170): a, c, t, g, unknown or other
  misc_feature (170)..(170): n is a, c, g, or t
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (326)..(326): a, c, t, g, unknown or other
  misc_feature (326)..(326): n is a, c, g, or t
tcagacatacgcgtcacgaccggtgctcgatttagagtgctacgaagggaaagggggtagggaactgctccagttaggacccagacggaaccatggaagccccagcgcacgcttctcttcctcctgctactctggctcccaggtgcccagtgcagaagtagtgatgacgntagtcctccaggccaccctgtcctgtntctccaggggaangccaccctctcgtgccagggccagtcagagtatagcaacacttagcctggtaccagcagacgtacctggccaggcctacccgaggtcctcctaccactcgtatggtttcgactacnccgtagccgacgggtaccacgttcgggtaccccagcccgtaagggttccgtaacggtcgggacgtaaggggtttcggggtacgttacggggggaactaagggtacggttttaccaaccgtttcccgttaaccggaaccctacgttaaccgtacggacccgtaacggcccgttacggaccctaaggttacccgtaagggtaaacgttaccgttttacggaaccgtttaaagttttttaaccgttaccgtttaacggttaccttaaacgggttaacccgtttaaaggtttaaacgttaaacgttttaccgtaccggggttaacccgtttacggggttaaacccggtttacccgggtaacccgggtaaacccggggtaaccggttaacggggtaaccgggttaaccggtttaacccgggaaaccggggttaaacccggttaacggtttacgggtaccgggttacccgttacggtaaccccgttaaccgtacgtttcccgttaagtttaccccgg

SEQ ID NO: 78140 - DNA, 530 bp, Homo sapiens
  misc_feature: GYAE6OF02GW7ZM.22.29.C07.1.454.CMB.1.raw
  modified_base (202)..(202): a, c, t, g, unknown or other
  misc_feature (202)..(202): n is a, c, g, or t
  modified_base (404)..(404): a, c, t, g, unknown or other
  misc_feature (404)..(404): n is a, c, g, or t
  modified_base (432)..(432): a, c, t, g, unknown or other
  misc_feature (432)..(432): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaanagccaccctctcctgcagggccagtcagagtattagcaacaacttagcctggtaccagcagacgacctggccaggctcccaggctcctcatctatgttgcatccagcagggccacgtcggtaccccagccaggttcagtgcaggtgggtctgggacaggtagttcactctcacctatcagcagtcctgctagtctagaagtntttcgacttagtttacttactgtcagtntaagttattaattcgtggtccgttcggtacgtcggaccgtaagggacgtaggtcgaagtaccaagtacgtgtcgactcgaccactactctcgtcttac

SEQ ID NO: 78141 - DNA, 805 bp, Homo sapiens
  misc_feature: GYAE6OF02JZ086.22.29.C07.1.454.CMB.1.raw
  modified_base (371)..(371): a, c, t, g, unknown or other
  misc_feature (371)..(371): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcgtagtctccgaggcaccctgtcctgtcgtctccgaaggggaatacgcctaacccttctaccctgccgtaacggggccccaggttccgaggtaacgttaagttagaacctaacctaaacgtttaggccccttaggtaccaggaccaggtacgtaccgtggaccaggtcctaccccgaggcctacccgtcaacttccgtatggttaccnctaactccacggcgacgggtccccagttacccgggaaccccctgacccgtaacgggtttccagggttacccggtagtacgggtttacggggtccgtaccgggggtaaataacgggttccgtttcccggtacttacccgtaccgaaaccccgtcgttaccgaacgtcccgtaacgtcccgttcgacgttcgtagttcgggaaagtttcgtttatacgttaacggttttactacgttcgggtacaacgtacgttaagtttaacttaaacgtttaccggtcggttaaccgttaccgttaaccgggtttaccggaacgtaacccgggtaacggttaaccggtacgggttaaaccggtaaaccgggtaaacgtacgttaaccgggtcgtacggtttacgaacccggtaatacgttacccgtttagttaccgtttacccg

SEQ ID NO: 78142 - DNA, 817 bp, Homo sapiens
  misc_feature: GYAE6OF02JU726.22.29.C07.1.454.CMB.1.raw
  modified_base (143)..(143): a, c, t, g, unknown or other
  misc_feature (143)..(143): n is a, c, g, or t
  modified_base (515)..(515): a, c, t, g, unknown or other
  misc_feature (515)..(515): n is a, c, g, or t
  modified_base (586)..(586): a, c, t, g, unknown or other
  misc_feature (586)..(586): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggcctcccagggtcnccagtgcagtaaggtgtgagtgacgcgtagtccgtccgaggtccctaccgttgtaccgtggtcgtaccgtaccgggaaagggaacgacgccctacccttccttaccgcgaaccggtacggacccgtacggtacgtaaacggtagtttaaacgtaccgacgtaaaacccgtaacggtttaccgaccggttaccggaaacgtacgcggaaacggtaccgacccggttacgggaccggttaccgtaccgtaccccggtaaccggcccttaccccgttaaggtacccttcggtacgtttcgaccgactaccgtccgaacgggaaccctcggacctaccggttaaccccggcccgtacggtcccttaaggggttacnggttaccggaggtacggtcgggtacggtcggaacgtgtacgttccgaacttcgcctaacacgtcacgcgcnccgtatacctgtactaggtacttcgtaacgttacgtttacgttacgtcgtacgtacgttacgtaacgttagttaacgtccgttacggttacgttaaccgtcgggttaacccgtaacggaaccgggtacgtaccggttaagggtacgtttaaacggaaccgttaacgacggtaccggttaaggtcccttaacgtacgtaaccgtcggtttacctttacgtacccctttacgg

SEQ ID NO: 78143 - DNA, 583 bp, Homo sapiens
  misc_feature: GYAE6OF02IUQ5A.22.29.C07.1.454.CMB.1.raw
  modified_base (306)..(306): a, c, t, g, unknown or other
  misc_feature (306)..(306): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccagccaccctgtctgtcgtactccgaggggaaagagccacactcgtcctgcagggccagtcagagtgtagctagcagcttagcctggtaccagacagaaacctggccaggctcccaggcctcgtcatctatcggtncatcgacgacggccaacgtggtactacccgagccgtaggttcacgggtcggctaggtacgggtcgtagggtacaggtacgttccgacctctaccgacatacagtacacgctacgctagtcgtagtaacgttatttcgacttagtttacttacgtgttacaagtctaacgtactaactaacgttcgttaccgtccgttaactcgtttacgaccgtacgggtaacgaacggtcgtagaacggactaacgtaacgaccgttagcgtacgtacggctaccg

SEQ ID NO: 78144 - DNA, 639 bp, Homo sapiens
  misc_feature: GYAE6OF02HBQEH.22.29.C07.1.454.CMB.1.raw
  modified_base (207)..(207): a, c, t, g, unknown or other
  misc_feature (207)..(207): n is a, c, g, or t
  modified_base (310)..(310): a, c, t, g, unknown or other
  misc_feature (310)..(310): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaangccacactctcctgcagggccagtcagagtgttagcagcagtcttagcctggtaccagcaacgaacctggcccaggcctcccaggcctcctcatctagtggtncatcgacggacggcccacgttggtactcccagtcctacggttcaggtcgcgaggtcgggtcgtggggacaggtcgtttcacgtcctaccacctagtccagctacgccgtgacctacgtcgtaagtaacgttcgtttacgagtttaccgtttacttaccgttcgttacgtacgtactaacgttaaagttaacttaccggtaccgttcccttaccggttagttacggtttccgggaacccggtagggtaacccgtaggttacccgtaggggaaccttaaccggtaaccgtaaaccggtaccgttcgggtacggttacctccggtaaacccg

SEQ ID NO: 78145 - DNA, 651 bp, Homo sapiens
  misc_feature: GYAE6OF02JWIGO.22.29.C07.1.454.CMB.1.raw
  modified_base (190)..(190): a, c, t, g, unknown or other
  misc_feature (190)..(190): n is a, c, g, or t
  modified_base (419)..(419): a, c, t, g, unknown or other
  misc_feature (419)..(419): n is a, c, g, or t
  modified_base (641)..(641): a, c, t, g, unknown or other
  misc_feature (641)..(641): n is a, c, g, or t
tcagacatacgcgtcacgaccggtgctcgatttagagtgctacgaagggaaagggaggaacgtgctcagttaggacccagacggaaccatggaagccccagcgcagcttcctcttcctcctgctactctggctcccaggtcgccagtgcagaagtagtgatgacgcagtctccaggcaccctgtctggtntctccgaggggaaacacgccaccctctcctgccgagggcccaggtccaagtacgtaacttgaccaacgtaacttacgccgtgtaaccagcgagacgacgtcgccgaggcctccaggccttcctcaactcgtatgttcgactacgcctaggccgtacgggccctacgtccggacccgtacgaccgtagtcgagttccggtcaggttcgggtagcgggtacagtcgttacncgttaccgctaccgatccgacgtcacgtcctagccgtgtacgtaggtaacttagtttcacgtttaatttcttaaccgttgtctaacgtacgtaggttaacttagttaccgtccggctttacccgggtagttacccggacgtaacgggtacctacggaggttaacggtaaccgtaaacgtaacggttcgtacgtacgtaccgttacaccgtactacccggttnttcccttacg

SEQ ID NO: 78146 - DNA, 824 bp, Homo sapiens
  misc_feature: GYAE6OF02H4CLJ.22.29.C07.1.454.CMB.1.raw
tcagacatacgcgtcacgaccggtgctcgatttagagtgctacgaagggaaaggggaggaactgctcagttaggacccagacggaaccatggaagccccagcgcagcttctcttcctcctgcctactctggctcccaggtcgccagtgacagaagtagtgatgaacgcacgtcctccagggtcctacccgtggtcctaggtcgttcctaccggaagggggaaaagcgccccgtaacccgttctaccgtcgacgaacggggtccctaacggttccaaggaagtttaaacgttaacgaccctaaaacttaaccgttacggcccggttaggttaaccaggtaccgaacggtacgaacccgttgggacctaacgggtccctacccgaggtacctacctactacttaccgtattcggttacgctactaccgagaccgacgggtaccctaccggttacggtaccccgagtaccgtaggtttaccacgggttcggaacggtggtttacgggccgtaagggaaccgtagttaccggttaccaccggtacctaccgaaccgtacgtacggaacgtccgaaccgggtcctacggactacgtcgtaacgtagtttactttcggacgtttaacgtttacgttacgttcgaaccgtaagtacgttaatttaaacgtacgttactaccgggtaccgttacgggttaccggtacggaacccggttaagaaccggttaacgggtcggtaaaccgttaccggaaaaccggtaggttaccgggttagaaccggtacgtacccgtaaacgttaccggtttacgtttacggttccttaacccgg

SEQ ID NO: 78147 - DNA, 746 bp, Homo sapiens
  misc_feature: GYAE6OF02G2SCP.22.29.C07.1.454.CMB.1.raw
  modified_base (143)..(143): a, c, t, g, unknown or other
  misc_feature (143)..(143): n is a, c, g, or t
  modified_base (166)..(166): a, c, t, g, unknown or other
  misc_feature (166)..(166): n is a, c, g, or t
  modified_base (174)..(174): a, c, t, g, unknown or other
  misc_feature (174)..(174): n is a, c, g, or t
  modified_base (211)..(211): a, c, t, g, unknown or other
  misc_feature (211)..(211): n is a, c, g, or t
  modified_base (240)..(240): a, c, t, g, unknown or other
  misc_feature (240)..(240): n is a, c, g, or t
  modified_base (290)..(290): a, c, t, g, unknown or other
  misc_feature (290)..(290): n is a, c, g, or t
  modified_base (358)..(358): a, c, t, g, unknown or other
  misc_feature (358)..(358): n is a, c, g, or t
  modified_base (453)..(453): a, c, t, g, unknown or other
  misc_feature (453)..(453): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctcggctcccagggtcnccagtgcagaagtagtgatgacncgagtccncgaggccacctgtctgtgacctacggaagggaaacgngaccctacctcgttcgcgacgacgggccngtaccgaagtaacgttgtacgaccaaacgtactacgccgtacggtaaccncggacagacgaccgtcggacctacggccgtcccgaggccctccttcattccttaagtgttcgcctacnccacggcgacgggaccccgtacgttaccggaccccaggtaccgtaggttcgaggttcggacggtacggtcggggtactacggggaatacggggtntttaccacgttccggtccaacgtacgtaccaacggctacgaccgtcgaccgttagacgttacgggtaacgttatttcggaacgtttttacgtttacgttaacgttcgggttacacgggtaactttaacgggtaactttaaacgttttccggacccggttacgttacgggtaccggttacgaccggggtaaacggttaaccgacggttaacgggtaacgtaaacccggtaagtaccggttacggtacggttacgcggtacccaacgttccgtaaccggttgttaaccgttcccg

SEQ ID NO: 78148 - DNA, 691 bp, Homo sapiens
  misc_feature: GYAE6OF02JNHIB.22.29.C07.1.454.CMB.1.raw
  modified_base (365)..(365): a, c, t, g, unknown or other
  misc_feature (365)..(365): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggcctcccaggtgccagtgcagaagtagtgagtagccgggtcctagtcgtccacgtcaccctgtctcgtcgacggtaccgagggacacgccctaccctcgtcctggcctagggccaaggtcagtagtactaacgactaacgacttgacctaggaccagctacgagaccctaggggcccctacggaccgtcccctaggtcctacgttcaattcccggttatcgttacccgtttaacgnccgacgtcgaccggacgtaccgtaccggtacccgacgtaccgtacggtacggacggtcggtacggtacggtacggtacggtacggtacgtacgtacgtacctaccgtcgtccactacgcgacgacgtacgtacgtacgtacgttacgtacgtacgttacgttacgttacgttacgttacgttacttacgtagtacgtacgtacgtacgttagttacgtacgtacgtaccgtaccggtacggtacgtacgtacgtacggtacggtacggtacggtaacgtgaacgtacgtacgacgtacgttcgtaccgtaccgtactcgtcgttcc

SEQ ID NO: 78149 - DNA, 683 bp, Homo sapiens
  misc_feature: GYAE6OF02HAYIO.22.29.C07.1.454.CMB.1.raw
  modified_base (209)..(209): a, c, t, g, unknown or other
  misc_feature (209)..(209): n is a, c, g, or t
tcagacatacgcgtcacgaccggtgctcgatttagagtgctacgaagggaaaggggaggaactgctcagttaggacccagacggaaccatggaagccccagcgcagcttctcgttcctcctgctacctctggcctcccaggtgccagtcgcaggaagtagtgatcgacggcagtctccgaggccacctgtctgtgtctcgaggggaaancgcccacctctcctggcagggccagtcagagtatagacaacacttgcctggtaccagcagacgaccgtggccaggcctcccgaggtcctcctacacttaccgtagttcgttcgacctactaccgagccgacgggccctacgtaccggtaccccagtcccgtaaggttccgaggttcggacgtaggttcggggtaccgtagggaacgtaggtacgtttacccgaacttcccgtacaacccgtagtacacggtccaacggtctacggacttaggtcgtaacgtaagttcgtttacgacgtttagtttacttagttacgtacaggtactaagttaacttagttaccgtcggtaccgttacgggtaccgttaccggaaccggtaacggtaccggtaacgggtacggtaacgttaaccgaaacgggtacttagggttaccggacgtacggctaaccgtcgttacttcggttacttaccg

SEQ ID NO: 78150 - DNA, 565 bp, Homo sapiens
  misc_feature: GYAE6OF02IB4EV.22.29.C07.1.454.CMB.1.raw
  modified_base (483)..(483): a, c, t, g, unknown or other
  misc_feature (483)..(483): n is a, c, g, or t
  modified_base (535)..(565): a, c, t, g, unknown or other
  misc_feature (535)..(565): n is a, c, g, or t
tcagacatacgcgtcacgaccggtgctcgatttagagtgctacgaagggaaaggggctggagtgggtctcaggtattagtgataatgcttttagcacaaactacgcagactccgtgaagggccggttcaccatctccagagacaattccaagaacacgctgtattttgacaaatgaacagcctgagagccgaagaccacggccgtctattactgtcgcgagacttaccgcatacgggtgaccttaccttactttcctcgacgtggggccgagggtaacccctggtaccaccgtcctcctcgacgccctacccaccgaacgggcccacgttcccggttccttccccccgtcggcccgtccccgtcgcctcccgaggacgcctacccgtccggacgacgtccaaccgacggcccgggtaccccgtcggggtcctcggcccggtggtaccgaaaacggaccttaccctccgaacggtcgttacggngttaccgtcggaggtccgggtcgtcgggaacgacgggcgtacgactaaggcnnnnnnnnnnnnnnnnnnnnnnnnnnnnnnn

SEQ ID NO: 78151 - DNA, 638 bp, Homo sapiens
  misc_feature: GYAE6OF02FMNTK.22.29.C07.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (256)..(256): a, c, t, g, unknown or other
  misc_feature (256)..(256): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (383)..(383): a, c, t, g, unknown or other
  misc_feature (383)..(383): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaangccaccctntcctgcagggccagtcagagtgttagcagcagctagcctggtacngcaagaacctggccaggcctccngctcncatcgtagtggncactcgtacggacggtcctacgtgtactccgagccgtaggttccaggtcgacgtagggtcggtacgtgggaactacggtacttaccnccttccaacgtaccacgttaccgaggtaccgaacggtccgtacgtacgtacgttacgtacggtaacgtttagttttaccgagttttaacgtttacgttacgtagtaccgtagaacctaatttaacgtacgttaaccgtcgtacccgttaccgtacgttacgggtttccggaaccggtacggtacgtaacggttcgtaacggtacgtaactaaccggtaaacgtacgtcggttaccgtacgacttaccgacgttcg

SEQ ID NO: 78152 - DNA, 626 bp, Homo sapiens
  misc_feature: GYAE6OF02GG66I.22.29.C07.1.454.CMB.1.raw
  modified_base (202)..(202): a, c, t, g, unknown or other
  misc_feature (202)..(202): n is a, c, g, or t
  modified_base (258)..(258): a, c, t, g, unknown or other
  misc_feature (258)..(258): n is a, c, g, or t
  modified_base (292)..(292): a, c, t, g, unknown or other
  misc_feature (292)..(292): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaancgccaccctctcctgcagggccagtcagagtatgacaactaactgcctaggtaccnggacagcgacctggccaggcctccaggcctcctnactctagtgttgaccatccagcgagggtcccaacgtccggtaaccccagccgtaaggttcacggtggtacagggttcgggtcgtacggggaacctagtaacgttcccgaacttacctaccgaacctactcgaacgtaccgacgtccgtacgctagtacgtaggtaaattagtttacgacttaagtttattacgtgtactagacgttaagtactttaacgtacgtacggtacgtcgggtacgtaccggaccgtaacgggacgtaggtacggtaacgtaacgaaaacggttagtacgttacggcgtacgaccgtaccgaatcgtacgtacttaccg

SEQ ID NO: 78153 - DNA, 704 bp, Homo sapiens
  misc_feature: GYAE6OF02FL7WK.22.29.C07.1.454.CMB.1.raw
  modified_base (204)..(204): a, c, t, g, unknown or other
  misc_feature (204)..(204): n is a, c, g, or t
  modified_base (284)..(284): a, c, t, g, unknown or other
  misc_feature (284)..(284): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (440)..(440): a, c, t, g, unknown or other
  misc_feature (440)..(440): n is a, c, g, or t
tcagacatacgcgtcacgaccggtgctcgatttagagtgctacgaagggaaaggggaggaactgctcagttaggacccagacggaacccatggaagccccagcgcagcttctcttcctcctgctactctggctcccaggtgccagtgcagagtagtgatgacgcagtctccaggccaccctgtctgtgtctaccgaggggaaancgcccacccgtctccgtgccgacgggaccagttccgaagagttaacttacgacgaaacaacttagtcccgtggtaacccngcgagacgtacctcggccacggcctcccgagcctccacgtactctatgttacnctcnccagcgacggcctacgtccggtaccccagcctacggtctagtcggatacggtcggcgtggacgtgtacgttacacctcgtacctacctacgtacacggnacgtccgtacgtacgtcgtacgttacgtaacgttgttttaacgtcgttaacggtttttactaccggttcgtaccgtaggaccttaaagggttaactttaaggttaccccgttcggttacccgttccgggttaaccgtttacccgggaacggtaaacccggggtaacgtaacggggttacggaaccggtttaaacgaacccgttaacggtccgggtacgtaccgtacggtaccctaacccggtatccggtttccttaccgttacc

SEQ ID NO: 78154 - DNA, 613 bp, Homo sapiens
  misc_feature: GYAE6OF02G561P.22.29.C07.1.454.CMB.1.raw
  modified_base (346)..(346): a, c, t, g, unknown or other
  misc_feature (346)..(346): n is a, c, g, or t
  modified_base (383)..(383): a, c, t, g, unknown or other
  misc_feature (383)..(383): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
  modified_base (458)..(458): a, c, t, g, unknown or other
  misc_feature (458)..(458): n is a, c, g, or t
tcagacatacgcgtcacgaccggtgctcgatttagagtgctacgaagggaaaggggaggaactgctcagttaggacccagacggaaccatggaagccccagctcagcttctcttcctcctgctactctggcctcccagagaccaccggagaagttgtgttgacacagtttccagcccaccctgtctttgtctccaggagagcgggccaccctctcctgcgagggccaatgacgtagtatagcgactattacgtcctggtaaccaacgacgacggccgtgacctaggaccctccgacgcctccctcgagtgtactgagtgtaccttaccgaaacggccagtcggacnctcccagccgagttcagtgcgtaggtggtctaggganacgtacttcactctcactatacacgacaccgagtacnctgacgtnttcgcgtcgttacgtttatacttgacgttnacgtcgactaccgaaggtccgtaccgtccggtacgtttcggaccggggtagggccctaagttcggtacgagttcgtaacgacgtacggtacgtgtacgggcctaggaccctcgaccgtttacgttccggttatacccgtcgttacccggttcccc

SEQ ID NO: 78155 - DNA, 719 bp, Homo sapiens
  misc_feature: GYAE6OF02HNAYF.22.29.C07.1.454.CMB.1.raw
  modified_base (204)..(204): a, c, t, g, unknown or other
  misc_feature (204)..(204): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccgaggtgccagtgcagaagtagtgatgacgcagtctccaggcaccctgtctgtgtctaccgaggggaaanacgccaccctctctgcagggccagtcagtagtatacgacaactaacttagcctggtaccagacagagaccgtggccaggcctcccgacgggcctccctacgtacttaccgttagttcgttcgactactaccgacgcggaccgggaccctaccgtaccggtaccccagcccgtacggtttcgacggtcggcgtacggttgggtaccgtggggtacgaggtacgtttctaaccgtcgtaaccactacgtacgacggaccgtacgtcccgtggacgtacgttcgtaaggttaacgtttacgttttacggtacgttttaacgttttacttacgttagttacgtacggtacttaagttaagtttaaacgttacgttccggtaccggtttacgggtaccggttaccggaaccgtaacggggaccggttagggtaccggttaacggtaaccggtaaacggtacgtaacggtacggcgttacggaccctaacgttaccgtacgtttacggttacgtttacccg

SEQ ID NO: 78156 - DNA, 719 bp, Homo sapiens
  misc_feature: GYAE6OF02GOWN9.22.29.C07.1.454.CMB.1.raw
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcacctgtctgtgtctccgaggggaaagagccaccctctcctgcgacggccagtcagtacgtatacgactaacgtaactagccgtaggtaaccagacaacggacgaccgtcggaccgaggccctacccgagggccttacctcgtacttcctagtgttcgacacgttccagcgacggcctacgtccggtaccccagccgtaggttacaggtcggacgtaggtcgggtacgtacgggactaggtacgttacctaccgtcctaccgaaccgtacgtaccgacgacaccggtccgtacgaccgttagttaaccttaagggtaacgtttacgttttacggacgtttaacgttttaagtttccgttaggtctacgggtactttaaggttaactttaacgttacggttccggtaaccgttacgggtaccggttacgggaccggtaacgggtaaccggtagggttaaccggaacggttaaccgaaaccgggtacttagggaccgtaccggtacgaccttaccggtaacgttaccgttacggttaccttaaccgg

SEQ ID NO: 78157 - DNA, 850 bp, Homo sapiens
  misc_feature: GYAE6OF02F25ZW.22.29.C07.1.454.CMB.1.raw
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
  modified_base (439)..(439): a, c, t, g, unknown or other
  misc_feature (439)..(439): n is a, c, g, or t
tcagacatacgcgtcacgaccggtgctcgatttagagtgctacgaagggaaaggggagaacgtgctcacgttaggacccagacggaaccatggaagccccagcgcagcttctcttcctctgctactctcggctcccaggtcgctagtgcagagtgtgatgacgctagtctccaggccacctgtcctagtcgtacgtcgagggaancggtccctacctctcccngccgggacggtccaggtccagacgttattacgacctaacggtaacttacgtccgtacggtaccaggtacctaaggaacgttacccgcgggaccgtacggcccgtcccgtaccgtcccgtcccgtaaccgtaacttggttaacggttgttacccgggacttaaaccgtccggacgtaccgggtaccgtacccgttacggttacccggttaaccccgnggtaaccccgttgggttacctaaggggtccgtacggtacgggttccggggtacgttacggggaacgtacggtaacgttttccccacgtttaccggtacccaacctagtaaccgtacggtaacccgtcgtcccgtaggtaaccccgtgttaaccgttacgggtaacgtttacgtttacgggttaacctttacggttttacgtaccggttaacgtaccggttacgtaactttacgggtaaactttaccggtttaccgggtacgttaccgggttaccggggtaaccttccgggaaaccgggttacgtaaccgggttacgtaacggtaccgggtaaaccggaacggttaacggtacccggtggtacccgtacgtacccgttacgttccgtaacctttcggtccctttaaccccgg

SEQ ID NO: 78158 - DNA, 766 bp, Homo sapiens
  misc_feature: GYAE6OF02F7R99.22.29.C07.1.454.CMB.1.raw
  modified_base (190)..(190): a, c, t, g, unknown or other
  misc_feature (190)..(190): n is a, c, g, or t
tcagacatacgcgtcacgaccggtgctcgatttagagtgctacgaagggaaaggggaggaactgctcagttaggacccagacggaaccatggaagcccagcgcagcttctcttcctcctgctactctggcctcccaggtgccagtgcagaagtagtgatgacgcagtctccaggcaccctgtctgtgtcnccgaaggggaaacagcccaacccttctacctgacgacgggccagtcagagttactagacaaactaacgttagccttaggtacccagccagtaacgaccgttaggaccgacggtacctcccaggccttaccctacgaacttacttagttacggttcgacctactaccgaggaccgttaagggaccccgtaacttacccgggtaacccccaagtacccgtaacgggttacctaggttacggaccggttaagggtcggggtacgtacgggaactaacgggtaagtttaccccaaacgttcccttaaccggaaccctaacgtaccgtagtacccaggtaccccgttagaccgttacgtaccgtaggtaacgtttagttttcgaaccgtttagtttacttaaccgtcgttaacgtagtaacttaagttaatttaacgttaacgtacggtaccgttaccggttaacgtacgggtaaccgtaacgggaccgaaggttacggtaacgtaacgtaaaccggtaccgttagggtacggtacttcggaaccccgttactaccgttcgttaccgttacgtttaacccg

SEQ ID NO: 78159 - DNA, 718 bp, Homo sapiens
  misc_feature: GYAE6OF02FUXSC.22.29.C07.1.454.CMB.1.raw
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggccaccctgtactgtcgtctccgaggggaaacagcccacccgtctcctgcgagggcccagtccgagacgttattagacctaactaacttacgtccctaggtaccaagcgtaaggacgtaacctggacctaggccctacccgaggtccctcctacacgttactatcggtttcgacctaacggtccctagccgtacggacctaccggtaccggtacccccaggtccgtaaggttccgagttacggcgtagggtcggtacgtagggactacgtagtttccacgtccgtaccacggtactacacggtcctaacgtcctggactacggttacgtagtaacgttgtttacgtacgtttaacgttttatcttacggtccagggtaccttaaaggttatttaacgtaccgggttcgtaccggttaccgggtaacccgttcggtaaaccgtacgggtaaccgtaagggtacggtaacggtccgtaaaacggtacggttaacggtcggtacgtacggtaacccgtaccttacggtcgtttaccacgttttacccg

SEQ ID NO: 78160 - DNA, 745 bp, Homo sapiens
  misc_feature: GYAE6OF02GXNM7.22.29.C07.1.454.CMB.1.raw
  modified_base (141)..(141): a, c, t, g, unknown or other
  misc_feature (141)..(141): n is a, c, g, or t
  modified_base (201)..(201): a, c, t, g, unknown or other
  misc_feature (201)..(201): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgcctactctggctcccaggtnccagtgcagaagtagtgatgacgcagtctccaggcaccctgtctgtgtctccgagggaanacgccaccctctcctgcgagggccagtcagagtattagctaacacttagcctaggtaccagcagacgaccgtggaccagggtcctacccgagggtccttcccgtactaagttccttaacgtcggtttacggccaacttcccgaaggtaccgaacggggtacccctaccgttccgggtaacccccctacggtaccggtaggggtttaccaggggttacgggtccgtaacggggttcgggggtttacgtacgggggaaacctagggttaacggttcccgaacgttccgtacccgaacccttatcgaacgtcgaaccggcctacggactacgttaccgtaggtaacgttcgtttacggtacgtttaagttttaccgttaccgtagttaccgaagttacgttaagttaacgtttaacgttaccgtaccggttcgttaaccgggttaccggtacggtaaaccggacgggttaacgacgggtacgtaaccggtaacgtaacggtacgtcgtacggtactacgacgtaccgtcgttacgtcgtacttaccg

SEQ ID NO: 78161 - DNA, 805 bp, Homo sapiens
  misc_feature: GYAE6OF02H8FMY.22.29.C07.1.454.CMB.1.raw
tcagacatacgcgtcacgaccggtgctcgatttagagtgctacgaaggggaaagggggaggaactgctcagttaggacccaaacggaaccatggaagccccagcgcagcttctcttcctcctgctactctggctcccaggtgccagtgcaggaaagtagtgatgacgcagtctccaggccacctgtctggtgtctccgaaggggaaagacgcccaccctctccgtgccgacgggccagtcagtagtacagactaaacaacttagccgtaggtaccagacgagacgaccgtggacccgaggccttacccgacggtcctacccgtactaatcccttaagttcggttacgacctaacgttcccgaacggtccgaacggggtcccctaaccggtttacccgggaaaccccctacggaccgtaacgggtttacgaaggttcgggactaaggggtcggggttcggtacgggaacaggttacgttacctacgttcccgtaaccgtaacccgaaccgacgaccgacggtacccgttcggacgtacgttaccgtaaggtaacgtttacttttcggtatttaaacggttttaatttaccgttggttacgtagttaactaaacgtttaattaaccgtttacggttaccgtacccgggttaacggttaccgggttaaccgtaaccggtaaacgggtaccgtaaagggggtaacggtaacggtaaccgtaaacggtacggttacggtacggtaccgttacgaaccgttaccttaacgttacccggttaacgtttaccgttaccctcgtttaacccccg

SEQ ID NO: 78162 - DNA, 778 bp, Homo sapiens
  misc_feature: GYAE6OF02FGOT3.22.29.C07.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
tcagacatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaanagccaccctntcctgcagggccagtccagagtattagacaacaacttagccttaggaccagacagacgtacctggaccaggctccccgaaggcctcccgtacataccgttaattgttacggtcaactccgagccgaaggggtccccaacggtacccgggttaacccccaggtacccctaaaggggtttcccaaggggttccgggacgtaccggggttaagggggtcccttaggggggaaccctaaggggtaaccggtttacctaaaccgtttcccgtaacaaaccccgtagttacccgtaaacggtaccgaaccgccgtttacgggcgtaacgttaccggttaaggaaaccgttagtttttaggacctatttttaacgttacgttacgtacgtagtacgtaacggttaattaacgtttaccgtacggtccgttaaccggttaccggttaccgggtaccgtaaaccgggtaaccggtaagggtaaccgggtaaccgttaacgggaaaccgtaaaccggttacggtacggacgttaccgaaccggttacccgaatttacccggttacgttcgttaacccc

SEQ ID NO: 78163 - DNA, 773 bp, Homo sapiens
  misc_feature: GYAE6OF02HFDVX.22.29.C07.1.454.CMB.1.raw
  modified_base (143)..(143): a, c, t, g, unknown or other
  misc_feature (143)..(143): n is a, c, g, or t
  modified_base (161)..(161): a, c, t, g, unknown or other
  misc_feature (161)..(161): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
tcagacatacgcgtcacgaccggtgctcgatttagagtgctacgaaggggaaaggggaggaactgctcagttaggacccagacggaaccagtggaacgccccagcgcagcttctcttcctcctgctactctggctcccaggtnccagtcgcagaagtagtnatgacgcagtcctccaggccacctgtcctgtactctccgaaggggaacncgcccacccgtctacccgnggcgaacgggccctaggtaccgagtacgttactaacgaccaactaactagcctacggtaccagaccaggtaaccgaccgtggacccaaggtcccgacccccgtagggtcccttaccgtataaccgttaccttaacggttgtacccggactaacctcccggaacggttacggaccgggtacccgaacggttacccgggttaacccccaggtaccccggtttaaggtccggaaacggttcggtaaccgtacgggggtttcgggtaaccggttagggacccggttatacggttaaccctccggttacctaccgtacctaacgtacgacggaacctacggtaccctaggtacgacgttacgtacgtaacgttacgttttagacgtttacgtttacctagttacacgtaacgtctaaggtaactacgttagtacccggtacttaccgggtacgtaacccgtaacggaaccggtaccggtaagtacggaacgtaaccgaaaccggttacgtcggacgtacggactacgtaccagtctaccgtctaacccg

SEQ ID NO: 78164 - DNA, 800 bp, Homo sapiens
  misc_feature: GYAE6OF02I2HN3.22.29.C07.1.454.CMB.1.raw
  modified_base (139)..(139): a, c, t, g, unknown or other
  misc_feature (139)..(139): n is a, c, g, or t
  modified_base (220)..(220): a, c, t, g, unknown or other
  misc_feature (220)..(220): n is a, c, g, or t
tcagacatacgcgtcacgaccggtgctcgatttagagtgctacgaagggaaaggggaggaactgctcagttaggacccagacggaaccatggaagccccagcgcagcttctcttcctcctagctactctgctccaggtncagtgcagaagtagtgatgacgctacggtctaccgaggcctacccgtgttctaggttcgttccgtaccggaaggggaaacnccgacccctacccgttctaccggtacgaccgggtaacgggcccaagtttaccgaaggtagttaaccttagaacccgtaaaactaaaccgtttacggacccgtttacgggtaaccaaggacccgaagggtaaccgttacggtaccgggacccgtaacggttcccctaaccccgggtagggtaccttaccccttacggtaaacgtttctaagtttccggttagacgttaccaccgtaaggaccgttacgggaccccttacgggtaccggtaaccccaggtccggtaacggttgacggtaggtacgagggttgggtacgtacggacgtagtacgtacttacgactacccaagtcgttacgacggtacacgtccgtacggactacgtacgtacgtacgtagtttaggtacgtttacgtttacgttacgtacgtagtaacgttagtaacgttagttaacgtacggtacgtaccgtacggtaccgttacggaccggtaaggtaacgtacggtaacggtacggtaaaccttaacggaacggttacgtacggagtacgacgttacgtacgtacgttagtaccgttacg

SEQ ID NO: 78165 - DNA, 253 bp, Homo sapiens
  misc_feature: GYAE6OF01EVWHX.34.53.E09.1.454.CMB.1.raw
  modified_base (245)..(253): a, c, t, g, unknown or other
  misc_feature (245)..(253): n is a, c, g, or t
tcagtacacgtgatcacgaccggtgctcgatttagagagagtgtggttgggtttgggggtgtggtggtctccactcccgccttgacgaggctgactactactgtcagtcttatgataatgacaatcatgtgatattcggcggagggaccaaactgaccgtcctgagtcagcccaaggctgcccctcggtcactctgttcccgcctcctcatcacgtgtactgagcgggctggcaaggcgcatagnnnnnnnnn

SEQ ID NO: 78166 - DNA, 258 bp, Homo sapiens
  misc_feature: GYAE6OF01B3SIL.34.53.E09.1.454.CMB.1.raw
  modified_base (246)..(258): a, c, t, g, unknown or other
  misc_feature (246)..(258): n is a, c, g, or t
tcagtacacgtgatcacgaccggtgctcgatttagagagagtgtggttgggtttgggggtgtggtggtctccactcccgccttgacgaggctgactactactgtcagtcttatgataatgacaatcatgtgatattcggcggagggaccaaactgaccgtcctgagtcagcccaaggctgccccctggtcactctgttcccgccctcctcatcacgtgtactgagcgggctggcaaggcgcatagnnnnnnnnnnnnn

SEQ ID NO: 78167 - DNA, 288 bp, Homo sapiens
  misc_feature: GYAE6OF01D0WY9.34.53.E09.1.454.CMB.1.raw
  modified_base (249)..(250): a, c, t, g, unknown or other
  misc_feature (249)..(250): n is a, c, g, or t
  modified_base (252)..(252): a, c, t, g, unknown or other
  misc_feature (252)..(252): n is a, c, g, or t
  modified_base (254)..(288): a, c, t, g, unknown or other
  misc_feature (254)..(288): n is a, c, g, or t
tcagtacacgtgatcacgaccggtgctcgatttagagagagtgtgttgggtttgggggtgtggtggtctccactcccgccttgacgaggctgactacgtacctgtcagtcttatggataatgacaatcatgtgatattcggcggagggaccaaactgaccgtcctgagtcacgcccaaggctgccccctcggtcactctgttcccgcctcctcatcacgtgtactgagcgggctggcaaggcgcatagnnangnnnnnnnnnnnnnnnnnnnnnnnnnnnnnnnnnnn

SEQ ID NO: 78168 - DNA, 272 bp, Homo sapiens
  misc_feature: GYAE6OF01B97BP.34.53.E09.1.454.CMB.1.raw
  modified_base (247)..(272): a, c, t, g, unknown or other
  misc_feature (247)..(272): n is a, c, g, or t
tcagtacacgtgatcacgaccggtgctcgatttagagagagtgtgttgggtttgggggtgttgtggtctccactcccgccttgacgaggctgactactactgtcagtcttatgataatgacaatcatgtgatattcggcggagggaccaaacgtgaccgtcctaggtcacgcccaaggctgccccctggtcactctgttcccaccctcctcatcacgtgtactgagcgggctggcaaggcgcatagnnnnnnnnnnnnnnnnnnnnnnnnnn

SEQ ID NO: 78169 - DNA, 247 bp, Homo sapiens
  misc_feature: GYAE6OF01A2VYC.34.53.E09.1.454.CMB.1.raw
  modified_base (246)..(247): a, c, t, g, unknown or other
  misc_feature (246)..(247): n is a, c, g, or t
tcagtacacgtgatcacgaccggtgctcgatttagagagagtgtgttgggtttgggggtgtggtggtctccactcccgccttggcgaggctgactactactgccagtcttatgataatgacaatcatgtgatattcggcggagggaccaaactgaccgtcctgagtcagcccaaggctgccccctcggtcactctgttcccgccctcctcatcacgtgtactgagcgggctggcaaggcgcatagnn

SEQ ID NO: 78170 - DNA, 248 bp, Homo sapiens
  misc_feature: GYAE6OF01DLSUS.34.53.E09.1.454.CMB.1.raw
  modified_base (246)..(248): a, c, t, g, unknown or other
  misc_feature (246)..(248): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccgccctcctcatcacgtgtactgagcgggctggcaaggcgcatagnnn

SEQ ID NO: 78171 - DNA, 248 bp, Homo sapiens
  misc_feature: GYAE6OF01D2NEV.34.53.E09.1.454.CMB.1.raw
  modified_base (246)..(248): a, c, t, g, unknown or other
  misc_feature (246)..(248): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatatttggcggagggaccaaactgaccgtcctgagtcagcccaaggctgccccctcggtcactctgttcccaccctcctcatcacgtgtactgagcgggctggcaaggcgcatagnnn

SEQ ID NO: 78172 - DNA, 248 bp, Homo sapiens; identical to SEQ ID NO: 78170
  misc_feature: GYAE6OF01DFGGZ.34.53.E09.1.454.CMB.1.raw
  modified_base (246)..(248): a, c, t, g, unknown or other
  misc_feature (246)..(248): n is a, c, g, or t

SEQ ID NO: 78173 - DNA, 248 bp, Homo sapiens
  misc_feature: GYAE6OF01CK6Y1.34.53.E09.1.454.CMB.1.raw
  modified_base (245)..(248): a, c, t, g, unknown or other
  misc_feature (245)..(248): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctggtcactctgttcccgccctcctcatcacgtgtactgagcgggctggcaaggcgcatagnnnn

SEQ ID NO: 78174 - DNA, 247 bp, Homo sapiens
  misc_feature: GYAE6OF01AXSSS.34.53.E09.1.454.CMB.1.raw
  modified_base (244)..(247): a, c, t, g, unknown or other
  misc_feature (244)..(247): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctggtcactctgttcccgccctctcatcacgtgtactgagcgggctggcaaggcgcatagnnnn

SEQ ID NO: 78175 - DNA, 246 bp, Homo sapiens
  misc_feature: GYAE6OF01CYQPI.34.53.E09.1.454.CMB.1.raw
  modified_base (245)..(246): a, c, t, g, unknown or other
  misc_feature (245)..(246): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctggtcactctgttcccaccctcctcatcacgtgtactgagcgggctggcaaggcgcatagnn

SEQ ID NO: 78176 - DNA, 248 bp, Homo sapiens
  misc_feature: GYAE6OF01D68O8.34.53.E09.1.454.CMB.1.raw
  modified_base (246)..(248): a, c, t, g, unknown or other
  misc_feature (246)..(248): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccaccctcctcatcacgtgtactgagcgggctggcaaggcgcatagnnn

SEQ ID NO: 78177 - DNA, 246 bp, Homo sapiens
  misc_feature: GYAE6OF01BIQGL.34.53.E09.1.454.CMB.1.raw
  modified_base (246)..(246): a, c, t, g, unknown or other
  misc_feature (246)..(246): n is a, c, g, or t
tcagtacacgtgatcacgaccggtgctcgatttagagagagtgtgttgggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagn

SEQ ID NO: 78178 - DNA, 247 bp, Homo sapiens
  misc_feature: GYAE6OF01CD36I.34.53.E09.1.454.CMB.1.raw
  modified_base (246)..(247): a, c, t, g, unknown or other
  misc_feature (246)..(247): n is a, c, g, or t
tcagtacacgtgatcacgaccggtgctcgatttagagagagtgtgttgggtttgggggtgtggtggtctccactcccgccttgacgaggctgactactactgtcaatcttatgataatgacaatcatgtgatattcggcggagggaccaaactgaccgtcctgagtcagcccaaggctgccccctcggtcactctgttcccgccctcctcatcacgtgtactgagcgggctggcaaggcgcatagnn

SEQ ID NO: 78179 - DNA, 246 bp, Homo sapiens
  misc_feature: GYAE6OF01BKYT3.34.53.E09.1.454.CMB.1.raw
  modified_base (246)..(246): a, c, t, g, unknown or other
  misc_feature (246)..(246): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccaccctcctcatcacgtgtactgagcgggctggcaaggcgcatagn

SEQ ID NO: 78180 - DNA, 261 bp, Homo sapiens
  misc_feature: GYAE6OF01CEWSL.34.53.E09.1.454.CMB.1.raw
  modified_base (246)..(261): a, c, t, g, unknown or other
  misc_feature (246)..(261): n is a, c, g, or t
tcagtacacgtgatcacgaccggtgctcgatttagagagagtgtgttgggtttgggggtggtggtggtctccactcccgccttgacgaggctgactactactgtcaatcttatgataatgacaatcatgtgatattcggcggagggaccaaactgaccgtcctgagtcagcccaaggctgcccctcggtcactctgttcccgccctcctcatcacgtgtactgagcgggctggcaaggcgcatagnnnnnnnnnnnnnnnn

SEQ ID NO: 78181 - DNA, 253 bp, Homo sapiens
  misc_feature: GYAE6OF01CU9OH.34.53.E09.1.454.CMB.1.raw
  modified_base (247)..(253): a, c, t, g, unknown or other
  misc_feature (247)..(253): n is a, c, g, or t
tcagtacacgtgatcacgaccggtgctcgatttagagagagtgtggttggggtttgggggtgtggtggtctccactcccgccttgacgaggctgactactactgtcagtcttatgataatgacaatcatgtgatattcggcggagggaccaaactgaccgtcctgagtcagcccaaggctgccccctggtcactctgttcccgccctcctcatcacgtgtactgagcgggctggcaaggcgcatagnnnnnnn

SEQ ID NO: 78182 - DNA, 250 bp, Homo sapiens
  misc_feature: GYAE6OF01ECHYS.34.53.E09.1.454.CMB.1.raw
  modified_base (246)..(250): a, c, t, g, unknown or other
  misc_feature (246)..(250): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccgccctcctcatcacgtgtactgagcgggctggcaaggcgcatagnnnnn

SEQ ID NO: 78183 - DNA, 249 bp, Homo sapiens
  misc_feature: GYAE6OF01DQYSI.34.53.E09.1.454.CMB.1.raw
  modified_base (246)..(249): a, c, t, g, unknown or other
  misc_feature (246)..(249): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccaccctcctcatcacgtgtactgagcgggctggcaaggcgcatagnnnn

SEQ ID NO: 78184 - DNA, 247 bp, Homo sapiens
  misc_feature: GYAE6OF01CHARO.34.53.E09.1.454.CMB.1.raw
  modified_base (246)..(247): a, c, t, g, unknown or other
  misc_feature (246)..(247): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccgccctcctcatcacgtgtactgagcgggctggcaaggcgcatagnn

SEQ ID NO: 78185 - DNA, 247 bp, Homo sapiens
  misc_feature: GYAE6OF01AKP12.34.53.E09.1.454.CMB.1.raw
  modified_base (245)..(247): a, c, t, g, unknown or other
  misc_feature (245)..(247): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctggtcactctgttcccaccctcctcatcacgtgtactgagcgggctggcaaggcgcatagnnn

SEQ ID NO: 78186 - DNA, 246 bp, Homo sapiens
  misc_feature: GYAE6OF01BMYNJ.34.53.E09.1.454.CMB.1.raw
  modified_base (246)..(246): a, c, t, g, unknown or other
  misc_feature (246)..(246): n is a, c, g, or t
tcagtacacgtgatcacgaccggtgctcgatttagagagagtgtgttgggtttgggggtgtggtggtctccactcccgccttgacgaggctgactactactgtcaatcttatgataatgacaatcatgtgatattcggcggagggaccaaactgaccgtcctgagtcagcccaaggctgccccctcggtcactctgttcccgccctcctcatcacgtgtactgagcgggctggcaaggcgcatagn

SEQ ID NO: 78187 - DNA, 247 bp, Homo sapiens; identical to SEQ ID NO: 78185
  misc_feature: GYAE6OF01DLD3Y.34.53.E09.1.454.CMB.1.raw
  modified_base (245)..(247): a, c, t, g, unknown or other
  misc_feature (245)..(247): n is a, c, g, or t

SEQ ID NO: 78188 - DNA, 262 bp, Homo sapiens
  misc_feature: GYAE6OF01BP9J8.34.53.E09.1.454.CMB.1.raw
  modified_base (246)..(262): a, c, t, g, unknown or other
  misc_feature (246)..(262): n is a, c, g, or t
tcagtacacgtgatcacgaccggtgctcgatttagagagagtgtgttgggtttgggggtgtggtggtctcccactcccgccttgacgaggctgactactactgtcagtcttatgataatgacaatcatgtgatattcggcggagggaccaaactgaccgtctgagtcagcccaaggctgccccctggtcactctgttcccgccctcctcagtcacgtgtactgaggcgggctggcaaggcgcatgnnnnnnnnnnnnnnnnn

SEQ ID NO: 78189 - DNA, 248 bp, Homo sapiens
  misc_feature: GYAE6OF01EJPYH.34.53.E09.1.454.CMB.1.raw
  modified_base (245)..(248): a, c, t, g, unknown or other
  misc_feature (245)..(248): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccacctcctcatcacgtgtactgagcgggctggcaaggcgcatagnnnn

SEQ ID NO: 78190 - DNA, 248 bp, Homo sapiens; identical to SEQ ID NO: 78176
  misc_feature: GYAE6OF01A5Q26.34.53.E09.1.454.CMB.1.raw
  modified_base (246)..(248): a, c, t, g, unknown or other
  misc_feature (246)..(248): n is a, c, g, or t

SEQ ID NO: 78191 - DNA, 243 bp, Homo sapiens
  misc_feature: GYAE6OF01DWDSO.34.53.E09.1.454.CMB.1.raw
  modified_base (241)..(243): a, c, t, g, unknown or other
  misc_feature (241)..(243): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctggtcactctgttcccgcctcctcatcacgtgtactgagcggctggcaggcgcatgnnn

SEQ ID NO: 78192 - DNA, 251 bp, Homo sapiens
  misc_feature: GYAE6OF01EDVL1.34.53.E09.1.454.CMB.1.raw
  modified_base (247)..(251): a, c, t, g, unknown or other
  misc_feature (247)..(251): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctcgccccctcggtcactctgttcccaccctcctcatcacgtgtactgagcgggctggcaaggcgcatagnnnnn

SEQ ID NO: 78193 - DNA, 248 bp, Homo sapiens
  misc_feature: GYAE6OF01CJ3YR.34.53.E09.1.454.CMB.1.raw
  modified_base (241)..(241): a, c, t, g, unknown or other
  misc_feature (241)..(241): n is a, c, g, or t
  modified_base (247)..(248): a, c, t, g, unknown or other
  misc_feature (247)..(248): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctcgccccctcggtcactctcgttcccgccctcctcatcacgtgtactgagcggctggcaaggcncatagnn

SEQ ID NO: 78194 - DNA, 246 bp, Homo sapiens
  misc_feature: GYAE6OF01CKLZJ.34.53.E09.1.454.CMB.1.raw
  modified_base (221)..(221): a, c, t, g, unknown or other
  misc_feature (221)..(221): n is a, c, g, or t
  modified_base (242)..(246): a, c, t, g, unknown or other
  misc_feature (242)..(246): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtctgagtcagcccaaggctgccccctggtcactctgttcccaccctcctcatcacgtgtacgngcggcgtgcgacgcgcatagnnnnn

SEQ ID NO: 78195 - DNA, 264 bp, Homo sapiens
  misc_feature: GYAE6OF01C7IN9.34.53.E09.1.454.CMB.1.raw
  modified_base (244)..(246): a, c, t, g, unknown or other
  misc_feature (244)..(246): n is a, c, g, or t
  modified_base (248)..(264): a, c, t, g, unknown or other
  misc_feature (248)..(264): n is a, c, g, or t
tcagtacacgtgatcacgaccggtgctcgatttagagagagtgtgttgggtttgggggtagtggtggtctccactcccgccttgacgaggctgactactactgtcagtcttatgataatgacaatcatgtgatattcggcggagggaccaaactgaccgtcctgagtcagcccaaggctgcccctggtcactctgttcccaccctctcatcacgtgtactgagcgggctggcaaggcgcatagnnnannnnnnnnnnnnnnnnn

SEQ ID NO: 78196 - DNA, 254 bp, Homo sapiens
  misc_feature: GYAE6OF01EE4H5.34.53.E09.1.454.CMB.1.raw
  modified_base (233)..(233): a, c, t, g, unknown or other
  misc_feature (233)..(233): n is a, c, g, or t
  modified_base (249)..(254): a, c, t, g, unknown or other
  misc_feature (249)..(254): n is a, c, g, or t
tcagtacacgtgatcacgaccggtgctcgatttagagagagtgtgttgggtttggggggtgtggtggtctccactcccgccttgacgaggctgactactactgtcagtcttatgataatgacaatcatgtgatattcggcggagggaccaaactgaccgtcctgagtcagcccaaggctcgccccctcggtcactctcgttcccgccctcctcatcacgtgtactgagcgggntggcaaggcgcatagnnnnnn

SEQ ID NO: 78197 - DNA, 252 bp, Homo sapiens
  misc_feature: GYAE6OF01AOCY0.34.53.E09.1.454.CMB.1.raw
  modified_base (247)..(252): a, c, t, g, unknown or other
  misc_feature (247)..(252): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctcggtcactctcgttcccaccctcctcatcacgtgtactgagcgggctggcaaggcgcatagnnnnnn

SEQ ID NO: 78198 - DNA, 248 bp, Homo sapiens
  misc_feature: GYAE6OF01DZPLC.34.53.E09.1.454.CMB.1.raw
  modified_base (247)..(248): a, c, t, g, unknown or other
  misc_feature (247)..(248): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctcgccccctggtcactctcgttcccgccctcctcatcacgtgtactgagcgggctggcaaggcgcatagnn

SEQ ID NO: 78199 - DNA, 257 bp, Homo sapiens
  misc_feature: GYAE6OF01BIC5N.34.53.E09.1.454.CMB.1.raw
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (251)..(257): a, c, t, g, unknown or other
  misc_feature (251)..(257): n is a, c, g, or t
tcagtacacgtgatcacgaccggtgctcgatttagagagagtgtgttgggtttgggggtgtggtggtctccactcccgccttgacgaggctgactactactgtcagtcttatgataatgaacaatcatgtgatattcggcggagggaccaaactgaccgtcctgagtcagcccaaggctcgccccctcggtcactctcgttcccgccctcctcatcacgtgtactgacgcgggctggacaaggcgnanagnnnnnnn

SEQ ID NO: 78200 - DNA, 251 bp, Homo sapiens
  misc_feature: GYAE6OF01CTTXV.34.53.E09.1.454.CMB.1.raw
  modified_base (249)..(251): a, c, t, g, unknown or other
  misc_feature (249)..(251): n is a, c, g, or t
tcagtacacgtgatcacgaccggtgctcgatttagagagagtgtgttgggtttggggggtgtggtggtctccactcccgccttgacgaggctgactactactgtcagtcttatgataatgacaatcatgtgatattcgggcggagggaccaaactgaccgtcctgagtcagcccaaggctcgccccctcggtcactctcgttcccaccctctcatcacgtgtactgagcgggctggcaaggcgcatagnnn

SEQ ID NO: 78201 - DNA, 249 bp, Homo sapiens; identical to SEQ ID NO: 78183
  misc_feature: GYAE6OF01E06KT.34.53.E09.1.454.CMB.1.raw
  modified_base (246)..(249): a, c, t, g, unknown or other
  misc_feature (246)..(249): n is a, c, g, or t

SEQ ID NO: 78202 - DNA, 252 bp, Homo sapiens
  misc_feature: GYAE6OF01BELF6.34.53.E09.1.454.CMB.1.raw
  modified_base (246)..(252): a, c, t, g, unknown or other
  misc_feature (246)..(252): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagtccaaggctcgccccctggtcactctcgttcccaccctcctcatcacgtgtactgagcggctggcaaggcacatagnnnnnnn

SEQ ID NO: 78203 - DNA, 273 bp, Homo sapiens
  misc_feature: GYAE6OF01DGDTW.34.53.E09.1.454.CMB.1.raw
  modified_base (258)..(273): a, c, t, g, unknown or other
  misc_feature (258)..(273): n is a, c, g, or t
tcagtacacgtgatcacgaccggtgctcgatttagagagagtgtgttgggtttggggggtgtggtggtctccactcccgccttgacgaggctgactactactgtcagtcttatgataatgacaatcatgtgatattcgggcggagggaccaaactgaccgtcctgagtcagcccaaggcctcgccccctcggtcactctcgttccccaccctcctcatccgacgtgtactgaggcgggctggacaagggcgacatagnnnnnnnnnnnnnnnn

SEQ ID NO: 78204 - DNA, 278 bp, Homo sapiens
  misc_feature: GYAE6OF01BJQ6D.34.53.E09.1.454.CMB.1.raw
  modified_base (255)..(278): a, c, t, g, unknown or other
  misc_feature (255)..(278): n is a, c, g, or t
tcagtacacgtgatcacgaccggtgctcgatttagagagagtgtggttgggtttggggggtgtggtggtctccactcccgccttgacgaggctgactactactgtcagtcttatgataatgacaatcatgtgattattcggcggagggaccaaactgaccgtcctgagtcacgcccaaggttcgcccccgtcggtcactcgttcgttccccgccctcctcatcagtgtactgagcgggctggcaaggcgacatannnnnnnnnnnnnnnnnnnnnnnn

SEQ ID NO: 78205 - DNA, 272 bp, Homo sapiens
  misc_feature: GYAE6OF02IFPWW.34.53.E09.1.454.CMB.1.raw
  modified_base (244)..(272): a, c, t, g, unknown or other
  misc_feature (244)..(272): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccggtcctgagtcagccaaggctgcccctcggtcactctgttcccgcctcctcatcacgtgtactgagcgggctggcaaggcgcatagnnnnnnnnnnnnnnnnnnnnnnnnnnnnn

SEQ ID NO: 78206 - DNA, 246 bp, Homo sapiens
  misc_feature: GYAE6OF02H16X8.34.53.E09.1.454.CMB.1.raw
  modified_base (245)..(246): a, c, t, g, unknown or other
  misc_feature (245)..(246): n is a, c, g, or t
tcagtacacgtgatcacgaccggtgctcgatttagagagagtgtgttgggtttggggtgtggtggtctccactcccgccttgacgaggctgactactactgtcagtcttatgataatgacaatcatgtgatattcggcggagggaccaagttgaccgtcctcagtcagcccaaggctgccccctcggtcactctgttcccaccctcctcatcacgtgtactgagcgggctggcaaggcgcatagnn

SEQ ID NO: 78207 - DNA, 246 bp, Homo sapiens
  misc_feature: GYAE6OF02IWKSI.34.53.E09.1.454.CMB.1.raw
  modified_base (245)..(246): a, c, t, g, unknown or other
  misc_feature (245)..(246): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccaccctctcatcacgtgtactgagcgggctggcaaggcgcatagnn

SEQ ID NO: 78208 - DNA, 242 bp, Homo sapiens
  misc_feature: GYAE6OF02FGBNR.34.53.E09.1.454.CMB.1.raw
  modified_base (241)..(242): a, c, t, g, unknown or other
  misc_feature (241)..(242): n is a, c, g, or t
tcagtacacgtgatcacgaccggtgctcgatttagagagagtgtgttgggtttgggtgtggtggtctccactccgccttgacgaggctgactactactgtcagtcttatgataatgacaatcatgtgatattcggcggagggaccaaactgaccgtcctgagtcagcccaaggctgcccctcggtcactctgttcccaccctcctcatacgtgtactgagcgggctggcaaggcgcatagnn

SEQ ID NO: 78209 - DNA, 246 bp, Homo sapiens
  misc_feature: GYAE6OF02JBCM5.34.53.E09.1.454.CMB.1.raw
  modified_base (246)..(246): a, c, t, g, unknown or other
  misc_feature (246)..(246): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccgccctcctcatcacgtgtactgagcgggctggcaaggcgcatagn

SEQ ID NO: 78210 - DNA, 249 bp, Homo sapiens
  misc_feature: GYAE6OF02F8SDY.34.53.E09.1.454.CMB.1.raw
  modified_base (246)..(249): a, c, t, g, unknown or other
  misc_feature (246)..(249): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccgccctcctcatcacgtgtactgagcgggctggcaaggcgcatagnnnn

SEQ ID NO: 78211 - DNA, 247 bp, Homo sapiens
  misc_feature: GYAE6OF02HZDSQ.34.53.E09.1.454.CMB.1.raw
  modified_base (246)..(247): a, c, t, g, unknown or other
  misc_feature (246)..(247): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccaccctcctcatcacgtgtactgagcgggctggcaaggcgcatagnn

SEQ ID NO: 78212 - DNA, 248 bp, Homo sapiens; identical to SEQ ID NO: 78176
  misc_feature: GYAE6OF02GU7QR.34.53.E09.1.454.CMB.1.raw
  modified_base (246)..(248): a, c, t, g, unknown or other
  misc_feature (246)..(248): n is a, c, g, or t

SEQ ID NO: 78213 - DNA, 246 bp, Homo sapiens; identical to SEQ ID NO: 78186
  misc_feature: GYAE6OF02JE3UF.34.53.E09.1.454.CMB.1.raw
  modified_base (246)..(246): a, c, t, g, unknown or other
  misc_feature (246)..(246): n is a, c, g, or t

SEQ ID NO: 78214 - DNA, 247 bp, Homo sapiens; identical to SEQ ID NO: 78184
  misc_feature: GYAE6OF02GMONY.34.53.E09.1.454.CMB.1.raw
  modified_base (246)..(247): a, c, t, g, unknown or other
  misc_feature (246)..(247): n is a, c, g, or t

SEQ ID NO: 78215 - DNA, 248 bp, Homo sapiens; identical to SEQ ID NO: 78170
  misc_feature: GYAE6OF02F6LZV.34.53.E09.1.454.CMB.1.raw
  modified_base (246)..(248): a, c, t, g, unknown or other
  misc_feature (246)..(248): n is a, c, g, or t

SEQ ID NO: 78216 - DNA, 260 bp, Homo sapiens
  misc_feature: GYAE6OF02IUDHA.34.53.E09.1.454.CMB.1.raw
  modified_base (247)..(260): a, c, t, g, unknown or other
  misc_feature (247)..(260): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccaccctcctcactcacgtgtactgagcgggctggcaaggcgcatagnnnnnnnnnnnnnn

SEQ ID NO: 78217 - DNA, 245 bp, Homo sapiens
  misc_feature: GYAE6OF02HC7LU.34.53.E09.1.454.CMB.1.raw
  modified_base (245)..(245): a, c, t, g, unknown or other
  misc_feature (245)..(245): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctggtcactctgttcccaccctcctcatcacgtgtactgagcgggctggcaaggcgcatagn

SEQ ID NO: 78218 - DNA, 251 bp, Homo sapiens
  misc_feature: GYAE6OF02I2J0U.34.53.E09.1.454.CMB.1.raw
  modified_base (248)..(251): a, c, t, g, unknown or other
  misc_feature (248)..(251): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctcgccccctcggtcactctcgttcccgccctcctcatcacgtgtactgagcgggctggcaaggcgcatagnnnn

SEQ ID NO: 78219 - DNA, 247 bp, Homo sapiens; identical to SEQ ID NO: 78211
  misc_feature: GYAE6OF02G1HSI.34.53.E09.1.454.CMB.1.raw
  modified_base (246)..(247): a, c, t, g, unknown or other
  misc_feature (246)..(247): n is a, c, g, or t

SEQ ID NO: 78220 - DNA, 247 bp, Homo sapiens; identical to SEQ ID NO: 78184
  misc_feature: GYAE6OF02HUR92.34.53.E09.1.454.CMB.1.raw
  modified_base (246)..(247): a, c, t, g, unknown or other
  misc_feature (246)..(247): n is a, c, g, or t

SEQ ID NO: 78221 - DNA, 249 bp, Homo sapiens; identical to SEQ ID NO: 78183
  misc_feature: GYAE6OF02FRNV3.34.53.E09.1.454.CMB.1.raw
  modified_base (246)..(249): a, c, t, g, unknown or other
  misc_feature (246)..(249): n is a, c, g, or t

SEQ ID NO: 78222 - DNA, 248 bp, Homo sapiens; identical to SEQ ID NO: 78170
  misc_feature: GYAE6OF02IMNJW.34.53.E09.1.454.CMB.1.raw
  modified_base (246)..(248): a, c, t, g, unknown or other
  misc_feature (246)..(248): n is a, c, g, or t

SEQ ID NO: 78223 - DNA, 263 bp, Homo sapiens
  misc_feature: GYAE6OF02IVTZP.34.53.E09.1.454.CMB.1.raw
  modified_base (243)..(263): a, c, t, g, unknown or other
  misc_feature (243)..(263): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctggtcactctgttcccgcctctcatcacgtgtactgagcgggctggcaaggcgcatagnnnnnnnnnnnnnnnnnnnnn

SEQ ID NO: 78224 - DNA, 249 bp, Homo sapiens
  misc_feature: GYAE6OF02G2ZS2.34.53.E09.1.454.CMB.1.raw
  modified_base (247)..(249): a, c, t, g, unknown or other
  misc_feature (247)..(249): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctcgccccctcggtcactctgttcccaccctcctcatcacgtgtactgagcgggctggcaaggcgcatagnnn

SEQ ID NO: 78225 - DNA, 246 bp, Homo sapiens; identical to SEQ ID NO: 78175
  misc_feature: GYAE6OF02H2ZEA.34.53.E09.1.454.CMB.1.raw
  modified_base (245)..(246): a, c, t, g, unknown or other
  misc_feature (245)..(246): n is a, c, g, or t

SEQ ID NO: 78226 - DNA, 247 bp, Homo sapiens; identical to SEQ ID NO: 78211
  misc_feature: GYAE6OF02HNI8G.34.53.E09.1.454.CMB.1.raw
  modified_base (246)..(247): a, c, t, g, unknown or other
  misc_feature (246)..(247): n is a, c, g, or t

SEQ ID NO: 78227 - DNA, 272 bp, Homo sapiens
  misc_feature: GYAE6OF02GSNL1.34.53.E09.1.454.CMB.1.raw
  modified_base (248)..(272): a, c, t, g, unknown or other
  misc_feature (248)..(272): n is a, c, g, or t
tcagtacacgtgatcacgaccggtgctcgatttagagagagtgtgttgggtttggggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccgccctcctcatcacgtgtactgagcgggctggcaagggcgcatagnnnnnnnnnnnnnnnnnnnnnnnnn

SEQ ID NO: 78228 - DNA, 248 bp, Homo sapiens; identical to SEQ ID NO: 78170
  misc_feature: GYAE6OF02FGB87.34.53.E09.1.454.CMB.1.raw
  modified_base (246)..(248): a, c, t, g, unknown or other
  misc_feature (246)..(248): n is a, c, g, or t

SEQ ID NO: 78229 - DNA, 249 bp, Homo sapiens; identical to SEQ ID NO: 78183
  misc_feature: GYAE6OF02FMWS3.34.53.E09.1.454.CMB.1.raw
  modified_base (246)..(249): a, c, t, g, unknown or other
  misc_feature (246)..(249): n is a, c, g, or t

SEQ ID NO: 78230 - DNA, 248 bp, Homo sapiens
  misc_feature: GYAE6OF02FNFZ0.34.53.E09.1.454.CMB.1.raw
  modified_base (247)..(248): a, c, t, g, unknown or other
  misc_feature (247)..(248): n is a, c, g, or t
tcagtacacgtgatcacgaccggtgctcgatttagagagagtgtgttgggtttggggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccaccctcctcatcacgtgtactgagcgggctggcaaggcgcatagnn

SEQ ID NO: 78231 - DNA, 272 bp, Homo sapiens
  misc_feature: GYAE6OF02HDYHD.34.53.E09.1.454.CMB.1.raw
  modified_base (251)..(272): a, c, t, g, unknown or other
  misc_feature (251)..(272): n is a, c, g, or t
tcagtacacgtgatcacgaccggtgctcgatttagagagagtgtgttggggtttgggggggtgtggtggtctccactcccgccttgacgacggctgacctactactagtcagtcttatggataatgacaatcatgtgatatcggcggagggaccaaatgaccgtctgagtcagcccaaggctgccccctggtcactctgttcccgccctctcatcacgttgtactggagcgggctaggcaaggcgcatagnnnnnnnnnnnnnnnnnnnnnn

SEQ ID NO: 78232 - DNA, 249 bp, Homo sapiens; identical to SEQ ID NO: 78210
  misc_feature: GYAE6OF02IGOFI.34.53.E09.1.454.CMB.1.raw
  modified_base (246)..(249): a, c, t, g, unknown or other
  misc_feature (246)..(249): n is a, c, g, or t

SEQ ID NO: 78233 - DNA, 286 bp, Homo sapiens
  misc_feature: GYAE6OF02JIV2M.34.53.E09.1.454.CMB.1.raw
  modified_base (245)..(250): a, c, t, g, unknown or other
  misc_feature (245)..(250): n is a, c, g, or t
  modified_base (252)..(253): a, c, t, g, unknown or other
  misc_feature (252)..(253): n is a, c, g, or t
  modified_base (255)..(256): a, c, t, g, unknown or other
  misc_feature (255)..(256): n is a, c, g, or t
  modified_base (259)..(286): a, c, t, g, unknown or other
  misc_feature (259)..(286): n is a, c, g, or t
tcagtacacgtgatcacgaccggtgctcgatttagagagagtgtgttgggtttggggggtggtggtggtctccactcccgccttgacgaggctgactactactgtcagtcttatgataatgacaatcatgtgatattcggcggagggaccaaactgaccgtctgagtcagcccaaggctgccccctgtcactctgttcccaccctctcagtcacgtgtactgagcgggctggcaaggcgcatagnnnnnntnntnntannnnnnnnnnnnnnnnnnnnnnnnnnnn

SEQ ID NO: 78234 - DNA, 249 bp, Homo sapiens; identical to SEQ ID NO: 78210
  misc_feature: GYAE6OF02HLXL8.34.53.E09.1.454.CMB.1.raw
  modified_base (246)..(249): a, c, t, g, unknown or other
  misc_feature (246)..(249): n is a, c, g, or t

SEQ ID NO: 78235 - DNA, 248 bp, Homo sapiens
  misc_feature: GYAE6OF02IFC8F.34.53.E09.1.454.CMB.1.raw
  modified_base (238)..(238): a, c, t, g, unknown or other
  misc_feature (238)..(238): n is a, c, g, or t
  modified_base (244)..(248): a, c, t, g, unknown or other
  misc_feature (244)..(248): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctgccccctggtcactctgttcccaccctctcatcacgtgtactgagcgggctggcaaggcncatagnnnnn

SEQ ID NO: 78236 - DNA, 251 bp, Homo sapiens
  misc_feature: GYAE6OF02HBDHK.34.53.E09.1.454.CMB.1.raw
  modified_base (247)..(251): a, c, t, g, unknown or other
  misc_feature (247)..(251): n is a, c, g, or t
tcagtacacgtgatcacgaccggtgctcgatttagagagagtgtgttgggtttggggggtgtggtggtctccactcccgccttgacgaggctgactactactgtcagtcttatgataatgacaatcatgtgatattcggcggagggaccaagttgaccgtcctcagtcagcccaaggctgccccctcggtcactctgttcccaccctcctcatcacgtgtactgagcgggctggcaaggcgcatagnnnnn

SEQ ID NO: 78237 - DNA, 249 bp, Homo sapiens
  misc_feature: GYAE6OF02IGO06.34.53.E09.1.454.CMB.1.raw
  modified_base (246)..(249): a, c, t, g, unknown or other
  misc_feature (246)..(249): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctcgccccctggtcactctgttcccaccctctcatcacgtgtactgagcgggctggacaaggcgcatagnnnn

SEQ ID NO: 78238 - DNA, 251 bp, Homo sapiens
  misc_feature: GYAE6OF02FUDAS.34.53.E09.1.454.CMB.1.raw
  modified_base (238)..(238): a, c, t, g, unknown or other
  misc_feature (238)..(238): n is a, c, g, or t
  modified_base (244)..(251): a, c, t, g, unknown or other
  misc_feature (244)..(251): n is a, c, g, or t
tcagtacacgtgatcacgaccggtgctcgatttagagagagtgtgttgggtttgggggtgtggtggtctccactcccgccttgacgaggctgactactactgtcaatcttatgataatgacaatcatgtgatattcggcggaggaccaaactgaccgtcctgagtcagcccaaggctgccccctggtcactctgttcccgccctcctcatcacgtgtactgagcgggctggcaaggcncatagnnnnnnnn

SEQ ID NO: 78239 - DNA, 259 bp, Homo sapiens
  misc_feature: GYAE6OF02FE9M8.34.53.E09.1.454.CMB.1.raw
  modified_base (211)..(211): a, c, t, g, unknown or other
  misc_feature (211)..(211): n is a, c, g, or t
  modified_base (246)..(259): a, c, t, g, unknown or other
  misc_feature (246)..(259): n is a, c, g, or t
tcagtacacgtgatcacgaccggtgctcgatttagagagagtgtgttgggtttgggggtgtggtggtctccactcccgccttgacgaggctgactactactgtcagtcttatgataatgacaatcatgtgatattcggcggagggaccaaactgaccgtcctgagtcagcccaaggctcgccccctcggtcactctgttcccgccctcctnatcacgtgtactgagcgggctggcaagcgcatagnnnnnnnnnnnnnn

SEQ ID NO: 78240 - DNA, 263 bp, Homo sapiens
  misc_feature: GYAE6OF02JDPUG.34.53.E09.1.454.CMB.1.raw
  modified_base (249)..(263): a, c, t, g, unknown or other
  misc_feature (249)..(263): n is a, c, g, or t
tcagtacacgtgatcacgaccggtgctcgatttagagagagtgtgttgggtttggggggtgtggtggtctccactcccgccttgacgaggctgactactactgtcagtcttatgataatgacaatcatgtgatattcgggcggagggaccaaactgaccgtcctgagtcagcccaaggctcgccccctggtcactctcgttcccgccctcctcatcacgtgtactgagcgggctggcaaggcgcatagnnnnnnnnnnnnnnn

SEQ ID NO: 78241 - DNA, 335 bp, Homo sapiens
  misc_feature: GYAE6OF01AO8FF.53.75.G09.1.454.CMB.1.raw
  modified_base (239)..(239): a, c, t, g, unknown or other
  misc_feature (239)..(239): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (311)..(335): a, c, t, g, unknown or other
  misc_feature (311)..(335): n is a, c, g, or t
tcagcgcgtatacacacgaccggtgctcgatttagtatagacatcagggccactggcatcccagacaggttcagtggcagtgggtttggggcaaacttctctctcaccatcagcagactggacgcccgaagtattttgcagtgtattactgtcatcagtatgctacatcctactctaaacggttcggaccgaagggaccaagggtggaatacaaacgaactggtagctgacacatcgtntctctactcctaccgctatcgtgactcggtactgcgtcaggtcggcgggtctggacgtcggcnctagangcnnnnnnnnnnnnnnnnnnnnnnnnn

SEQ ID NO: 78242 - DNA, 423 bp, Homo sapiens
  misc_feature: GYAE6OF01DLM3A.53.75.G09.1.454.CMB.1.raw
  modified_base (122)..(122): a, c, t, g, unknown or other
  misc_feature (122)..(122): n is a, c, g, or t
  modified_base (353)..(353): a, c, t, g, unknown or other
  misc_feature (353)..(353): n is a, c, g, or t
  modified_base (355)..(362): a, c, t, g, unknown or other
  misc_feature (355)..(362): n is a, c, g, or t
  modified_base (364)..(423): a, c, t, g, unknown or other
  misc_feature (364)..(423): n is a, c, g, or t
tcagcgcgtatacacacgaccggtgctcgatttagtatagacatcagggccactggcatcccagacaggttcagtggcagtgggtttggggcaaacttctctctcaccatcagcagactggncccgaagattttgcagtgtattactgtcatcagtatgactacatcacctcaaacggttcggaccgaaagggaccaagggtggaaactacgaaaacgactggtggctgccaccatcctgttcttctatccctttccccgccctaatccgtgtacgttacccgtacgtcggccgtactacgggacgggccccgggtggtacgggacgaaacggggccgaaccgtagtagacgngnnnnnnnncnnnnnnnnnnnnnnnnnnnnnnnnnnnnnnnnnnnnnnnnnnnnnnnnnnnnnnnnnnnn

SEQ ID NO: 78243 - DNA, 289 bp, Homo sapiens
  misc_feature: GYAE6OF02I5LQP.53.75.G09.1.454.CMB.1.raw
  modified_base (282)..(289): a, c, t, g, unknown or other
  misc_feature (282)..(289): n is a, c, g, or t
tcagcgcgtatacacacgaccggtgctcgatttagtatagacatcagggccactggcatcccagacaggttcagtggcagtgggtttggggcaaacttctctctcaccatcagcagactggagcccgaagattttgcagtgtattactgtcatcagtatgctacatcacctcaaacgttcggccaagggaccaaggtggaagtcaaacgaactgtggctgcaccatctgtctcatctccgcatctgatcgtactgcgctgagcggctggcaaggcgcatagnnnnnnnn

SEQ ID NO: 78244 - DNA, 316 bp, Homo sapiens
  misc_feature: GYAE6OF02HA11S.53.75.G09.1.454.CMB.1.raw
  modified_base (296)..(316): a, c, t, g, unknown or other
  misc_feature (296)..(316): n is a, c, g, or t
tcagcgcgtatacacacgaccggtgctcgatttagtatagacatcagggccactggcatcccagacaggttcagtggcagtgggtttggggcaaacttctctctcaccatcagcagactggagcccgaagattttgcagtgtattactgtcatcagtatgctacatcacctcaaaacgttcggccaagggaccaaggtggaaagtcaaaacgaactgtggctgcaccatctgtcttcatcttcccgcatcctgactcgtactgcgctggagcggggctgggacaaggcgcaatagnnnnnnnnnnnnnnnnnnnnn

SEQ ID NO: 78245 - DNA, 295 bp, Homo sapiens
  misc_feature: GYAE6OF02HTZKT.53.75.G09.1.454.CMB.1.raw
  modified_base (285)..(285): a, c, t, g, unknown or other
  misc_feature (285)..(285): n is a, c, g, or t
  modified_base (290)..(295): a, c, t, g, unknown or other
  misc_feature (290)..(295): n is a, c, g, or t
tcagcgcgtatacacacgaccggtgctcgatttagtatagacatcagggccactggcatcccagacaggttcagtggcagtgggtttggggcaaacttctctctcaccatcagcagactggagcccgaagattttgcagtgtattactgtcatcagtatgctacatcacctcaaacgttcggccaagggaccaaggtggaagtcaaaacgaactgtggctgcaccatctgtcttcattccttcccgccatctgatccgtactgcgctgagcgggctggcaaggcncatgnnnnnn

SEQ ID NO: 78246 - DNA, 325 bp, Homo sapiens
  misc_feature: GYAE6OF02J0WX7.53.75.G09.1.454.CMB.1.raw
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (296)..(296): a, c, t, g, unknown or other
  misc_feature (296)..(296): n is a, c, g, or t
  modified_base (309)..(311): a, c, t, g, unknown or other
  misc_feature (309)..(311): n is a, c, g, or t
  modified_base (313)..(325): a, c, t, g, unknown or other
  misc_feature (313)..(325): n is a, c, g, or t
tcagcgcgtatacacacgaccggtgctcgatttagtatagacatcagggccactggcatcccagacaggttcagtggcaggtgggtttggggcaacttctctctcaccatcagcagtactgggacgccgaagtagtttgctagtgttacttactgtcatcagtatgactacactacctactacgaacggttcgacgaacggacaggtaggaagtacaaacgtacgtgtcgctcgactactntctgtccttacactcctccgntatncgtagcgtagtcgcgngtgacggtcggcgnggacgtttagcgnnngnnnnnnnnnnnnn

SEQ ID NO: 78247 - DNA, 304 bp, Homo sapiens
  misc_feature: GYAE6OF02FIWXX.53.75.G09.1.454.CMB.1.raw
  modified_base (288)..(304): a, c, t, g, unknown or other
  misc_feature (288)..(304): n is a, c, g, or t
tcagcgcgtatacacacgaccggtgctcgatttagtatagacatcagggccactggcatcccagacaggttcagtggcagtgggtttggggcaaacttctctctcaccatcagcagactggagcccgaagattttgcagtgtattactgtcatcagtatgctacatcacctcaaacgttcggccaagggaccaaggtggaagtcaaacgaactgtggctgcaccatctgtcttcatccttcccgccatctgatcgtactgcgctgagcgggctggcaaggcgcatagnnnnnnnnnnnnnnnnn

SEQ ID NO: 78248 - DNA, 348 bp, Homo sapiens
  misc_feature: GYAE6OF02GYN6C.53.75.G09.1.454.CMB.1.raw
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
  modified_base (316)..(348): a, c, t, g, unknown or other
  misc_feature (316)..(348): n is a, c, g, or t
tcagcgcgtatacacacgaccggtgctcgatttagtatagacatcagggccactggcatcccagacaggttcagtggcagtgggtttggggcaaaacttctctctcaccatcagcagactggagcccgaagattttgcagtgtattactgtcatcagtatgctacatcacctactaaacgttcggaccgaagggaccaaagggtggaacgtacgaaaacgaactggtggctgccaccatctgtcttcattcctccgctatcgtnatcgtactcgcgtctaggngccggctggacgacggtcgacctagtagcagtnnnnnnnnnnnnnnnnnnnnnnnnnnnnnnnnn

SEQ ID NO: 78249 - DNA, 115 bp, Homo sapiens
  misc_feature: GYAE6OF01D2X2Z.51.60.F05.1.454.CMB.1.raw
tcagcgatcgtatacacgaccggtgctcgatttagtacgtcatcagggaaaggcagcgtcactctgttcccgccctcctctcgtagcactctgagcgggctggcaaggcgcatag

SEQ ID NO: 78250 - DNA, 486 bp, Homo sapiens
  misc_feature: GYAE6OF01BM450.51.60.F05.1.454.CMB.1.raw
  modified_base (463)..(463): a, c, t, g, unknown or other
  misc_feature (463)..(463): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagatgcattgccaaaccgatatgcttattggtaccagcagaagccgggccaggcccctgtgttggtgatgtataaagacactgagaggccttcagggatccctgagcgattctctggctccaggtcagggacaacggtcacattggcatcagtggagtccaggcagaggacgaggctgactattatgtacaatcaacagacacattggtacttatgtctcggaactgcgacaggtcaccgtcnggtcacgcccaagccaaccctcg

SEQ ID NO: 78251 - DNA, 920 bp, Homo sapiens
  misc_feature: GYAE6OF01D88BY.51.60.F05.1.454.CMB.1.raw
tcagcgatcgtatacacgaccggtgctcgatttagtacgtcatcagggaaaggggctgggcctcaggagcagcatcggaggtgcctcagccatggcatggactccctctccttcctcggcgtccttgcttactgcacgaggtatttgcgcctctatggagctgtacttccgacgcccaacccgtcgtacggttcggtcccgtccgtacccccgaaggaaccaaaccgcggccagtacctaactcctacccgtgccgttacgtagggaacttaacgttaaagttcggaaccggtaagttaaaattaaaacgttacgttcgtacccgttacggtacccgttaggttaactccggaacggtaccgaaacggaaccggcccgaaccgggtaccccgtaccgggttccccgttgggttcgggttacgtacgtactacgtactacgaacgaaccctacggaccggtccccggtacccggtacgggaaccgtacgtaggaccgtacgttacgttaccgttcggccggttaccccttacccgacccgttacggtaacccgggaaaccgtacccaccgttaccgtacccgttaccgtacccggtaaccgtcggttaaccgggaccggggtacccgggtaaccgtcggggtaccgtttcggggtaaggtacgggacggtttaccgggacggtttaaccgttttacggtttaacccgtttacggccgggttacccgggtaaggggttcccggggttaaccggacgttaccggaaccgggtaccctacgggttacccgggttaccgggttcccggggtaacggggtaacccggggacccggtaacccgtacgggtcccggtaaacccggttccggttacccgggtaccggtcccgaacgggtaccccgtcccgggcccttaaccccccgggg

SEQ ID NO: 78252 - DNA, 840 bp, Homo sapiens
  misc_feature: GYAE6OF01AN6NZ.51.60.F05.1.454.CMB.1.raw
tcagcgatcgtatacacgaccggtgctcgatttagtacgtcatcagggaaaggggctgggcctcaggaagcagcatcggaggtgcctcagccatggcatggactccctctcttcctcggccgtccttgcttactgcacgaggtatttgtcggcctcctatgagctgattcacgcccacctgagtcgtccgtcgtacccaggaacaaacgcgaccacgcactcaccgtgcctcgtaggtaataagttaacgtggacgaagtaaattaaagtatcgcgttcgtccgttaggtactacggacgacgaacggacgtacccggaccggacccgttacccggttcccggttcgggttacggggtccgtacgttaacttaccggtaacttaaccggaaaccgtacccgaaacccgggtacccggtaccccggggacccgggttaaccgggtaaccgttaacccggtacgggtaccgttacccgtttaacggttcccttaccgggttaccggtacccctttaccccgtaaccgggttaccggttaaacccggggaaacccctacggacccgttacccctaccgttaccgtaccgtaaccgttacgacccgggaaccgggtaccggggaccgaccggtcggtacggttcgggtaacggtacggtacggaccggtttacgttacgttttaaccgttacgtacggtacgggtacgggtacgggtacgacgtaccgcgtaccggtacgtccgggtacggtccgggaccgggtacgggaccggtacgaccggtccgtacggtacccggtccgtaccggtaccggaccgtacccggtccgtccccggtacccgg

SEQ ID NO: 78253 - DNA, 694 bp, Homo sapiens
  misc_feature: GYAE6OF01E3WJ8.51.60.F05.1.454.CMB.1.raw
  modified_base (145)..(145): a, c, t, g, unknown or other
  misc_feature (145)..(145): n is a, c, g, or t
  modified_base (211)..(211): a, c, t, g, unknown or other
  misc_feature (211)..(211): n is a, c, g, or t
  modified_base (403)..(403): a, c, t, g, unknown or other
  misc_feature (403)..(403): n is a, c, g, or t
tcagcgatcgtatacacgaccggtgctcgatttagtacgtcatcagggaaagggctgggcctcaggaagcagcatcggaggtgcctcagccatggcatggatccctctcttcctcggctccttgcttactgcacaggtattttgnggccttcctatgacgctgtacttcacgcccaaccctcaggtcgtccgtcgtccccaaggacaaacncgccagcatcctaccgtgcctcgtaggacgtaattaatgacgaagaattaaatagtcgtctcgtccgtggtatcacgacgacggaacgccgtacggcccgtaccgttcccgtggtcggtcgtcgtactacgtactacgaacgacctaccgaacggccggtacccgtcgggactaccgtgacgtcgtacttcncgtcgccctaccgtctacggtacgacgtaccgcctaccctactccgtacctacctacgtccggaacggccgggacgacgtacggtcgtagggtggtacgccgggtatccgtttagttaccgttttcggcggttacgtacgggtcgggttcggaaccgtacgtacccgacgttcccgcgggttacccggttcggggtaccggacggggccgtaaccgacggttccggtacccggaccccggtttcgtccggacccgacccgtacccgggtacccgtcccggtaccccccggg

SEQ ID NO: 78254 - DNA, 502 bp, Homo sapiens
  misc_feature: GYAE6OF02FGO5N.51.60.F05.1.454.CMB.1.raw
  modified_base (334)..(334): a, c, t, g, unknown or other
  misc_feature (334)..(334): n is a, c, g, or t
  modified_base (411)..(411): a, c, t, g, unknown or other
  misc_feature (411)..(411): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggataccgtgagcgattcnctggctccacctcgtgggaaccacacgccactctgaccatcagcgggacgcaggctgtgatgaggctgtacttttangtcaggcgttgggacagcgacacgtcgccgtgtcgggcggtaagggaccaaggctcggaccgtccgtcggtccaggcccaaggcctcccgg

SEQ ID NO: 78255 - DNA, 497 bp, Homo sapiens
  misc_feature: GYAE6OF02HW4D8.51.60.F05.1.454.CMB.1.raw
  modified_base (411)..(411): a, c, t, g, unknown or other
  misc_feature (411)..(411): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggcccgtcgggatacctgagcgattctctggctccacctctgggaacacacgccactctgaccatcagcgggacgcaggctggtggatgaggctgtacttttacngtcaggcgtgggacagcgacacgtgccgtgttcggcggagggaccaagcgtacgaccgtccgtcggtcacggcccgaggctcccgg

SEQ ID NO: 78256 - DNA, 520 bp, Homo sapiens
  misc_feature: GYAE6OF02I4EZ7.51.60.F05.1.454.CMB.1.raw
  modified_base (415)..(415): a, c, t, g, unknown or other
  misc_feature (415)..(415): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctggtggtggtcatctatcaagacacaagcggcctcgggactacctgagcgattctctggctccacctcgtagggaacacagccactctcgaccatcaggcgggacgcgaggctggtgatggaggtctgtacttttacngtcgaggcgtgggacacgcgacacgtgtccgtggttcgggcgggacgggaccaaggtcgtacggacccggttccgtcggtccacggcccgacgggcctaccccgg

SEQ ID NO: 78257 - DNA, 411 bp, Homo sapiens
  misc_feature: GYAE6OF02G3D2U.51.60.F05.1.454.CMB.1.raw
  modified_base (239)..(239): a, c, t, g, unknown or other
  misc_feature (239)..(239): n is a, c, g, or t
  modified_base (404)..(411): a, c, t, g, unknown or other
  misc_feature (404)..(411): n is a, c, g, or t
tcagcgatcgtatacacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggaccaaggtggaaatcaaacgaactgtggctgcaccatctgtcttcatcttcccgcatctgatcgtagcactctgagcgggctgggcaagggcgcatagnnnnnnnn

SEQ ID NO: 78258 - DNA, 615 bp, Homo sapiens
  misc_feature: GYAE6OF02GJBX5.51.60.F05.1.454.CMB.1.raw
  modified_base (499)..(499): a, c, t, g, unknown or other
  misc_feature (499)..(499): n is a, c, g, or t
tcagcgatcgtatacacgaccggtgctcgatttagtacgtcatcaaggggaaaagggggcctaacgggcctcccacggtaaggcaagcccaatcggaggtgcctcacgccaactggcgaatgggaacttccccgtctccttccttccggttccgttccgtttggccttaactgcacaacgggatttcgtggccctccgtatgagcgtgattcagccgaaccctcagtgtccgtagtccccaggacgaaacagccagcatccacctgactctggagtattaaatttgaccgagtagtaaaatatacgcgtgcctggtactccaggcaagaagtccaggccagtcccgtgtggtgtcatctatcaagacaaccaagaccgcctcgggactaccgtagaagtcgattcgtctcggcctaccacctcgtacgggaacacacgccactcgcaccatccagcgggacgcgacggcgtgcggagtcgacgtctagtacctttacgngtacgaggtcgtgggacagcgaacgacgtcgccgttggttccggacgggtacgggaacctaggccgtacggaccggtaccgtccgggtacccgaggcccgtacggtcctaccccgg

SEQ ID NO: 78259 - DNA, 808 bp, Homo sapiens
  misc_feature: GYAE6OF02GTDUA.51.60.F05.1.454.CMB.1.raw
  modified_base (245)..(245): a, c, t, g, unknown or other
  misc_feature (245)..(245): n is a, c, g, or t
tcagcgatcgtatacacgaccggtgctcgatttagtacgtcatcagggtaaagggggtcggtcgggcctcacggaaggctacgcatcggtaggtgccttcagccatggcgatggatccctctcttcctcggcgtccttcgcttacgtggtccacgaggtatttggtggtcccgtttcccttattggagtctttaaggatttccagcctaccctcgagtgtccgtgtccccgaggtaccggaaacngtcctagcacttcgacctcgctcgtggatacttaagttggacgtagtataaagtattgacttgaccttcggttattcgagtcagaacgtccgtacggcccaacgtcccccgtaggtagggtcggtcgagtcgtatcaagtacaccaaagtccggcctcggggactaccgtaggacggtacgaatttacgtcgtcggtcctcccgtaccgtacggtcgggaaacctaccgaacggaccctaacgttcctaccggaacccgtaacgtaccgaacgggaccggggaaaccggaccgtaacgggtccgttcgggttacggtaacgttacgggaacgggtaccgttaacggtaaaccgttttttaccgtagggttaccgtaacggggtccgggttacggggtaaccgtacgggtaccggtaccgttaaccgttcgggtcccgttagggtttccggggtccgggttaaccggggtaacccgttaacggtcccgttacgggaccccggtttaccggttaccgggttacccgtaccgggtaccccggtaacgggtccccgttacccccggg

SEQ ID NO: 78260 - DNA, 488 bp, Homo sapiens
  misc_feature: GYAE6OF02FIASA.51.60.F05.1.454.CMB.1.raw
  modified_base (200)..(200): a, c, t, g, unknown or other
  misc_feature (200)..(200): n is a, c, g, or t
  modified_base (332)..(332): a, c, t, g, unknown or other
  misc_feature (332)..(332): n is a, c, g, or t
  modified_base (426)..(426): a, c, t, g, unknown or other
  misc_feature (426)..(426): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggtatcagcagaagccagccagtcccctgtggtggtcatctatcaagacaccaagcggcctcggggactacctgagcgattcnctggctccactctgggacacagccactctgaccatcagcggacgcaggctgtggatgaggctgtacttttactgtcaggcgtgggacagcgacncgtgccgtgtcggcggagggaccaagctcgaccgtccgtcggtccacgcccgaggctcccgg

SEQ ID NO: 78261 - DNA, 414 bp, Homo sapiens
  misc_feature: GYAE6OF02F41X0.51.60.F05.1.454.CMB.1.raw
  modified_base (406)..(414): a, c, t, g, unknown or other
  misc_feature (406)..(414): n is a, c, g, or t
tcagcgatcgtatacacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctcgacgttcggccaagggaccaaggtggaaatcaaacgaactgtggctgcacatctgtctcatcttcccgccatctgactcgtagctactctgacggcgggctgggcaaggcgcagtagnnnnnnnnn

SEQ ID NO: 78262 - DNA, 501 bp, Homo sapiens
  misc_feature: GYAE6OF02HH91D.51.60.F05.1.454.CMB.1.raw
  modified_base (380)..(380): a, c, t, g, unknown or other
  misc_feature (380)..(380): n is a, c, g, or t
  modified_base (411)..(411): a, c, t, g, unknown or other
  misc_feature (411)..(411): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcgccctcgggatacctgagcgattctctggctccacctctgggaacacacgccactctgaccatcgagcgggacncgaggctgtggatggagctgtacttttacgngtcaggtcgtgggactagcgacacgtgccgtgttcgggccggaggaccgaaggctcgaccgtccgtcggcacggaccctaggcctcccgg

SEQ ID NO: 78263 - DNA, 180 bp, Homo sapiens
  misc_feature: GYAE6OF02FFXJC.51.60.F05.1.454.CMB.1.raw
  modified_base (149)..(149): a, c, t, g, unknown or other
  misc_feature (149)..(149): n is a, c, g, or t
  modified_base (155)..(180): a, c, t, g, unknown or other
  misc_feature (155)..(180): n is a, c, g, or t
tcagcgatcgtatacacgaccggtgctcgatttagtacgtcatcagggaagggcacgaccggtgctcgatttagagtgctacgaagggaaggcagcgtcactctgttccccgccctctctcgtagcactctgagcgggctggcaaggcncatagnnnnnnnnnnnnnnnnnnnnnnnnnn

SEQ ID NO: 78264 - DNA, 682 bp, Homo sapiens
  misc_feature: GYAE6OF02JHJS0.51.60.F05.1.454.CMB.1.raw
  modified_base (245)..(245): a, c, t, g, unknown or other
  misc_feature (245)..(245): n is a, c, g, or t
  modified_base (268)..(268): a, c, t, g, unknown or other
  misc_feature (268)..(268): n is a, c, g, or t
tcagcgatcgtatacacgaccggtgctcgatttagtacgtcatcagggaaagggcgtgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagccatcacctgcctctggagattaaattgcgaagataaatntagctgcctggtatcagcagaanccaggccagtcccctgtcggtggtcagtctatcaagtaccaacaagtccggaccctaggggactaccgtgaacgtcggtaattcgtacttggccttacccaccgttaccgtcgggaaaccctcaacgccctacgtccgtacgacctacgtacacggtcggggacgaccgacggcgtggtaggtacgtaggaacggtcgtacgtaaccgttttacgtacggtacgtacgggtacgtacggggtaaccacgggtccggtaaccgtacgtacggtaccggttacgggtttaccgggaccggggtaaccggggaaccctaacggggtacccgttaccgggtaaaccccggtttcccggttaccgggttacccggaaccgggtttacccccggaacgggttccccggttaacccccggg

SEQ ID NO: 78265 - DNA, 578 bp, Homo sapiens
  misc_feature: GYAE6OF02GGKJZ.51.60.F05.1.454.CMB.1.raw
  modified_base (200)..(200): a, c, t, g, unknown or other
  misc_feature (200)..(200): n is a, c, g, or t
  modified_base (381)..(381): a, c, t, g, unknown or other
  misc_feature (381)..(381): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggtatcagcagaacgccaggccacgtcccctggtggtggtcatctatcaagacaccaacggccggcccgtacggggactaccgtgagcgtacttctctggctccacctcgtacgggaacacgacgccactcncgaccatcgacggccgggacgcgacggccgtaggtggatggacgcgtagttaccttttacgtgtaccgaggtcggtacgggacacggcgacgacgtgtcccggttggtccgggacgggtaaccgggacctaacgggccgtacggtacccgtcccggtcgggttaccgacccggacccgtaacggtccgtacccccgg

SEQ ID NO: 78266 - DNA, 666 bp, Homo sapiens
  misc_feature: GYAE6OF02I9LT5.51.60.F05.1.454.CMB.1.raw
  modified_base (133)..(133): a, c, t, g, unknown or other
  misc_feature (133)..(133): n is a, c, g, or t
  modified_base (250)..(250): a, c, t, g, unknown or other
  misc_feature (250)..(250): n is a, c, g, or t
  modified_base (330)..(330): a, c, t, g, unknown or other
  misc_feature (330)..(330): n is a, c, g, or t
  modified_base (419)..(419): a, c, t, g, unknown or other
  misc_feature (419)..(419): n is a, c, g, or t
  modified_base (435)..(435): a, c, t, g, unknown or other
  misc_feature (435)..(435): n is a, c, g, or t
  modified_base (462)..(462): a, c, t, g, unknown or other
  misc_feature (462)..(462): n is a, c, g, or t
  modified_base (502)..(502): a, c, t, g, unknown or other
  misc_feature (502)..(502): n is a, c, g, or t
  modified_base (572)..(572): a, c, t, g, unknown or other
  misc_feature (572)..(572): n is a, c, g, or t
  modified_base (590)..(590): a, c, t, g, unknown or other
  misc_feature (590)..(590): n is a, c, g, or t
  modified_base (659)..(659): a, c, t, g, unknown or other
  misc_feature (659)..(659): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactncacaggatttgtggcctcctatgagtctgacttcacgcccaccctcagtcgtcccgtgtccccaggacaacagccagcatccactgctactggagtataactgacgagtataaatcngctacgacctggtactcagaccagaaacgtccacggccgtacgtcccccttggtgggtagtccaacttctactaccgaanaacccgttaaccgaacggtccggggcccccggttaggggactttacccgagggcggtaaccgttcgtccgggtctcggggaccctaccnccgtaggtcggaaccngaacggtcccaacgtcctaagaccgtnccggtacggccgggtagcccggtagggtcttagggttcgngtcgtagggtacgttacgtaccgttttacgacggtcgaccgggtaggtcggacttcggaaggtacctcgngttacccggtcggttcgngggtccggggttaacacgggttctaccgggtacccgcggttaccgagtaccccgaccgggacggttccncccccgg

SEQ ID NO: 78267 - DNA, 745 bp, Homo sapiens
  misc_feature: GYAE6OF02JJZMK.51.60.F05.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttggtcggcctcctatgagctgattcagccaccctcagtcgtccgtcgtcccaaggacaaacgngccagcacncctacctgacctcgtgggaatagtaaattggacgaagaattaaactagtcggacgttcggtccgttaggttacgtcgaagacgaaggaacgcccgtacggacccgtaacccggttcccccgtaggttcgggttcggtaacctatttaccgttaaacgtcccgaaaacggaaccctaacccggaaacgggttccccgggaccccggttaacggggactacccggtagaaccgggtacgtacttcgtaccgccggtctacccggtacctcggtaaccgggaccaccgtcgacctaacgttcgacgtaccacgtacggacgaccgggactcgggaacgttcgtaggcggtacgtaggacggtcttaggttaacttttcggaccgttaggtaccgggtcggtacggggtacgacgtcggaacggtaccgttacgggcccggtttaggtcccgggaagggacccggtaacgacggttacccgacggtcccggtaccggttcggtaccgaccggaccggttcgcccggtaccccgg

SEQ ID NO: 78268 - DNA, 552 bp, Homo sapiens
  misc_feature: GYAE6OF01EUUO9.39.15.B04.1.454.CMB.1.raw
  modified_base (263)..(263): a, c, t, g, unknown or other
  misc_feature (263)..(263): n is a, c, g, or t
  modified_base (519)..(519): a, c, t, g, unknown or other
  misc_feature (519)..(519): n is a, c, g, or t
tcagtcgcactagtcacgaccggtgctcgatttagacagtatatatccgcggggtctgagagaggagcccagccctgggattttcaggtgttttcatttggtgatcaggactgaacagagagaggtcaccatggagtttgggctgagcggtgtgtttctaggtcggctattttaaaaggtgtccagtgtgaggtgcagctgttggagtctgggggaggcttggtacagcctggggggtccctgagactctcctgtgtcgcctntggattcacctttagcaactatgccatgagctgggtcccgccaggttccgaggggaaggggctgggagtgggtctcatctgttaacggtcctggttccaccacatactacgcagaaaacgtggacggggccgttacaccatctccagagacaagttccaggaacacactgatctgcatttcgaactagtctgacgcccgacgacgacgctaattctattgtactaaacgattctgacggcctacgtacaggtcggngtcgggtactggtaacctttcgagtccgtcggg

SEQ ID NO: 78269 - DNA, 781 bp, Homo sapiens
  misc_feature: GYAE6OF01CEXCR.39.15.B04.1.454.CMB.1.raw
tcagtcgcactagtcacgaccggtgctcgatttagacagtatatatccgcggggtctgagagaggagcccagccctgggattttcaggtgttttcatttggtgatcaggactgaacagagagaggtcaccatggagtttgggctgagcgtggtcttttcttaggtggctattttaaaaggtgtccagtgtgagtgcagctgttggagtcgtggggaggcttggtacagccgtggggggtccctggagactcgtcctgtgtcgcctctggtacttcacctttagctaactatcgcatgagtcgtcgggtccgccgggttaccgaggggtaacggggctgggtaggtcgggtctcgtaactcgttaggttaaccggttccttcgggttacccaaccgaactaagtaccgtaaccggacgaaacgtaaaaacggtcggtaacgggggtcccggttaccaaccgtaccgttcctaaccccgtaaggaacgtaccgtaaacttccgaaagggaaacctaaccgtaacgttcggggaacttacccgtaggtaccgttaacgttttacgaacgtaacgttccgtacggtaaccgggcccgtaaacggacgtaacccgggaccttaaactttaacgttacgtttacggttaacctaaacgtacggttacgttaacggaccggtaccccgttaccgtaaccggtacgggttccgggtacgttccggggtaaccgtttacgggttacccgttttacgggaaccggttcgggtaacccgggttcccgggggg

SEQ ID NO: 78270 - DNA, 742 bp, Homo sapiens
  misc_feature: GYAE6OF01AP4P0.39.15.B04.1.454.CMB.1.raw
tcagtcgcactagtcacgaccggtgctcgatttagacagtatatatccgcggggtctgagagaggagcccagccctgggattttcaggtgttttcatttggtgatcaggactgaacagagagaggtcaccatggagtttgggctgagctggtctttttcttgtggcttattttaaaaggtgtccagtgtgaggtgcagctggttggagtcgtgggggagtcgttggtacgagtccggtggggggtccctggacgtacctctccgtgtcgtccgcctcgtggtacttcacctttagactaactatcgcctatggacgtcgtcggggtcccgccgtacggttaccgaggggaggggcgtgggaggtagggtctcgagttcgtacggttacggtccttggttcccaacctactactacgtacgacgaaacggtaaacggtcgggtacggggtacccgttacaccgtactccgtaccgaaggacgtaacctaacgttaccgaaacggtaaacccactcgtaaggtacttctagtaccgtattaacggaactacgttactcgggaaccggacccgaacgacggaacccgtaaccttaacgtttaaccgttaacgttaccgtttaaaccgtaaaactcggttaacgtaccggtaccggtaccctacccggtaacggtcggttccggggacggtttaccggggtaacttcgggtttaaccgttacggtcggttcccggtacccgggggg

SEQ ID NO: 78271 - DNA, 805 bp, Homo sapiens
  misc_feature: GYAE6OF01CL2IL.39.15.B04.1.454.CMB.1.raw
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (305)..(305): a, c, t, g, unknown or other
  misc_feature (305)..(305): n is a, c, g, or t
  modified_base (757)..(757): a, c, t, g, unknown or other
  misc_feature (757)..(757): n is a, c, g, or t
tcagtcgcactagtcacgaccggtgctcgatttagacagtatatatccgcggggtctgagagaggagcccagccctgggattttcaggttgttttcatttggtgatcaggactgaacagagagaggtcaccatggtaggtttgggctgagcgtgtcttttctgtgtattaattttaaaggtgtcagtgtgaggtgcngntgtggagtcggnggggngtcgttggacncggtccggtcgggggtcctggacgacctctcgtgtcgtccgccgtgtgtacttccttaacctttagacctaaacttancgtacgtatacggacggtccggttcgggtaccccgaccggttaacgggtaccggaagggggaccgggtgtacggggtggttccggtactacgtaacgttccggttaacggttaacccggttccgttaccggttccccaaactaaccgtacgttaaaccgtaccggaaaccggtaaaaggggtaaaccggttggggtaacccggggtttacccgttaaccaacccttacgttcccgaaccgaacgtaaccggtaacctaaacccggttaacgacgggtaaaaccctaacgtcgtaacgtaccgttaggtactacgttaacttaacggtacgtaacgtaccgacggtaccggaaaccccgataaacccggtaccgttaacccttagtttaaccgtttagttacttaaacgtaaccgtcgttcccgtaggaccccgtacgttccaacggttcggnggttaccgtagggtcctttacggtaccgtacgtcggccggttccgggg

SEQ ID NO: 78272 - DNA, 196 bp, Homo sapiens
  misc_feature: GYAE6OF01A2QI1.39.15.B04.1.454.CMB.1.raw
  modified_base (170)..(170): a, c, t, g, unknown or other
  misc_feature (170)..(170): n is a, c, g, or t
  modified_base (178)..(178): a, c, t, g, unknown or other
  misc_feature (178)..(178): n is a, c, g, or t
  modified_base (180)..(180): a, c, t, g, unknown or other
  misc_feature (180)..(180): n is a, c, g, or t
  modified_base (182)..(196): a, c, t, g, unknown or other
  misc_feature (182)..(196): n is a, c, g, or t
tcagtcgcactagtcacgaccggtgctcgatttagacagtatatatccgcggggtctgagagaggagcccagccctgggattttcaggttgttttcatttggtgatcaggactgaacagagagaggtcaccagtggagtttgggctaggagcgggctaggcgaaggccgntaagtgcntncnnnnnnnnnnnnnnn

SEQ ID NO: 78273 - DNA, 630 bp, Homo sapiens
  misc_feature: GYAE6OF01DXY7M.39.15.B04.1.454.CMB.1.raw
  modified_base (109)..(109): a, c, t, g, unknown or other
  misc_feature (109)..(109): n is a, c, g, or t
  modified_base (218)..(218): a, c, t, g, unknown or other
  misc_feature (218)..(218): n is a, c, g, or t
  modified_base (326)..(326): a, c, t, g, unknown or other
  misc_feature (326)..(326): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
  modified_base (434)..(434): a, c, t, g, unknown or other
  misc_feature (434)..(434): n is a, c, g, or t
  modified_base (475)..(475): a, c, t, g, unknown or other
  misc_feature (475)..(475): n is a, c, g, or t
  modified_base (566)..(566): a, c, t, g, unknown or other
  misc_feature (566)..(566): n is a, c, g, or t
tcagtcgcactagtcacgaccggtgctcgatttagacagtatatatccggcggggtctgagagaggacgcccagcccgtgggtattttcgaggttgttttcagtttggngactcgaggactagaacagagagagtacaccagtggtagttggctgagtcggtcgttacgtttcgaggtcgacttaaagtttaaaggctacgagtgaggcgtcgatcgngttaggtggaccgtggtggggacgtcgttgaaccgcgccgggtccggggtaacctgacgtctccgtgtgttcgaacctccgtgtcgtagtacctacttgaacctaatncgcagtcggtacgcgtggtccgacgtaggcgacggtagcgtgaggtgtactgacttcgtacgtacgtgtacactanaacngaacagagtacgaaagtcggacggtacncactcgagcgagtaactaccagtaaccaggactacgtaagnactcgctaaagccgttagactacgtcaacggaaccggcgttaacgaccggtaccgtaaactccggttaactagttaccgtaattaaccggntacgacgtcgtacgaatcgggtaatccggaccgaggttacgtactagacggtcgtaacggtcgg

SEQ ID NO: 78274 - DNA, 783 bp, Homo sapiens
  misc_feature: GYAE6OF02I7WUO.39.15.B04.1.454.CMB.1.raw
tcagtcgcactagtcacgaccggtgctcgatttagacagtatatatccgcggggtctgagagaggagcccagccctgggattttcaggtgttttcatttggtgatcaggactgaacagagagaggtcaccatggagtttgggctgagcgtggtcgttttctggtggctaattttaaaaggtgtccagtgtgaggtgcagctgttggagtcgtgggggaggcttggtacagccgtgggggtccctgagactctcctgtgtcgcctctgattcactttagcaactatcgccatgagctcgggtcccgcctaggttccgaggggaaggggctgggagtcgggtctcgagtcttaggttaaccgtccttcggttacccaccgactactactacgacaacggaaaacgtcgggacggggtcccggttacaaccgtacttaccgtaccgaacgaacgaaccgtaaattccccgaaagggtaaacccaaccgtaacgttacgggaacttacctacggtaaccttaagttttacggaaaacctacggttaccgtaacgggaacccggtaacccccggaaccggtaacccgtaaacccgggttaacccttaaaacgttttaacccgttaaagttttaccggtttaaacccttaaaaacgttccggttaccgttaagggtacccgggtaccccttaacccgggaaccgttacggggttaccgggtaccggttacggggtaccctttaaccggggttaacccgtttacgggtaaccgttcccgggtaccggggg

SEQ ID NO: 78275 - DNA, 775 bp, Homo sapiens
  misc_feature: GYAE6OF02G3DT6.39.15.B04.1.454.CMB.1.raw
  modified_base (293)..(293): a, c, t, g, unknown or other
  misc_feature (293)..(293): n is a, c, g, or t
  modified_base (324)..(324): a, c, t, g, unknown or other
  misc_feature (324)..(324): n is a, c, g, or t
tcagtcgcactagtcacgaccggtgctcgatttagacagtatatatccgcggggtctgagagaggagcccagccctgggattttcaggtgttttcatttggtgatcaggactgaacagagagaggtcaccatggagtttgggctgagctggctttttcttgtggctattttaaaaggtgtccagtgtgtaggtgcaggctgttggagtctgggggagcttggtacagccgtgggggtccctgagacctctcctggttgtcgcctcgtggacttcaccttttaggcctaaactntggtacccaagtgcggtcgtcggggtacccncccgtaaggttcccgaaggggaacggggtctgggaggttcgggtctcacgttcgtacgttaccggtccgttcggttacccacctacgtagtaaccgtacgtacgtaacggaaaaacgtgggaacggggtccgttacgaaccctagttaccgttcccgaaggtaacgaaccgttaacgttacccgtaagggtaaacctaaccgtacgtaacgggtactacgtacgtacttacggtttacgaacgtacgttaccgtaggaccggtacccgtaccggtaaccgaacccggtaacctaaccgtttaaccgttaacggtttactttaaccgttaaaccggtacgttacccgttacggtacccggtcccggttaccgaacggttacggtccggttaccggttacgggttaaccggttacggttacccggtttaccggtaacgtccggttaaccgggg

SEQ ID NO: 78276 - DNA, 173 bp, Homo sapiens
  misc_feature: GYAE6OF01AK5PY.37.26.C04.1.454.CMB.1.raw
  modified_base (173)..(173): a, c, t, g, unknown or other
  misc_feature (173)..(173): n is a, c, g, or t
tcagtagtgtagatcacgaccggtgctcgatttagtctagcgactttgggtttgggggaagaggaagactgacggtcccccaggagttcaggtgctgggcacagcggccctgggctgcctggtcaaggactacttccatctacactactgagcgggctggcaaggcgcatagn

SEQ ID NO: 78277 - DNA, 190 bp, Homo sapiens
  misc_feature: GYAE6OF01CV8J8.37.26.C04.1.454.CMB.1.raw
  modified_base (173)..(190): a, c, t, g, unknown or other
  misc_feature (173)..(190): n is a, c, g, or t
tcagtagtgtagatcacgaccggtgctcgatttagtctagcgactttgggtttgggggaagaggaagactgacggtccccaggagttcaggtgctgggcacagcggccctgggctgcctggtcaaggactacttccatctacactactgagcgggtctggcaaggcgcatagnnnnnnnnnnnnnnnnnn

SEQ ID NO: 78278 - DNA, 534 bp, Homo sapiens
  misc_feature: GYAE6OF01DB7J9.37.26.C04.1.454.CMB.1.raw
  modified_base (530)..(531): a, c, t, g, unknown or other
  misc_feature (530)..(531): n is a, c, g, or t
tcagtagtgtagatcacgaccggtgctcgatttagtctagcgactttgggtttggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctggaaatgaacagcctgagagccgaggacacggccctctattactgtgcgagagatcagacggagtatagcagcagctctgactacgtggggccacggaaccctggtcaccgtctcctcagcctccaccaacggcccatcggtccttcccctcggccaccctccctccaagacgccacctcgtggggcacgacgcggcccgtgggctcgcctggtcaaggactactccatctacactactgagcggctggacaaggcgnntag

SEQ ID NO: 78279 - DNA, 171 bp, Homo sapiens
  misc_feature: GYAE6OF01ES6NK.37.26.C04.1.454.CMB.1.raw
  modified_base (171)..(171): a, c, t, g, unknown or other
  misc_feature (171)..(171): n is a, c, g, or t
tcagtagtgtagatcacgaccggtgctcgatttagtctagcgactttgggtttggggaagaggaagactgacggtccccaggagttcaggtgctgggcacagcggccctgggctgcctggtcaaggactacttccatctacactactgagcgggctggcaaggcgcatagn

SEQ ID NO: 78280 - DNA, 173 bp, Homo sapiens; identical to SEQ ID NO: 78276
  misc_feature: GYAE6OF01D2B02.37.26.C04.1.454.CMB.1.raw
  modified_base (173)..(173): a, c, t, g, unknown or other
  misc_feature (173)..(173): n is a, c, g, or t

SEQ ID NO: 78281 - DNA, 163 bp, Homo sapiens
  misc_feature: GYAE6OF01CESZM.37.26.C04.1.454.CMB.1.raw
  modified_base (163)..(163): a, c, t, g, unknown or other
  misc_feature (163)..(163): n is a, c, g, or t
tcagtagtgtagatcacgaccggtgctcgattagtctagcgacttggttgggaagaggaagactgacggtcccaggagttcaggtgctggcacagcggccctgggctgcctggtcaaggactacttccatctacactactgagcggctggcaaggcgcatagn

SEQ ID NO: 78282 - DNA, 173 bp, Homo sapiens; identical to SEQ ID NO: 78276
  misc_feature: GYAE6OF01B76XS.37.26.C04.1.454.CMB.1.raw
  modified_base (173)..(173): a, c, t, g, unknown or other
  misc_feature (173)..(173): n is a, c, g, or t

SEQ ID NO: 78283 - DNA, 551 bp, Homo sapiens
  misc_feature: GYAE6OF01DPQMM.37.26.C04.1.454.CMB.1.raw
  modified_base (547)..(547): a, c, t, g, unknown or other
  misc_feature (547)..(547): n is a, c, g, or t
tcagtagtgtagatcacgaccggtgctcgatttagtctagcgacttttggggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccggttcaccgtctccagagacaattccaagaatacggtctatctggaaatgaacagcctgagagccgaggacacggcctctattactgtgcgagagatcagacggagtatagcagcagctctgactacgtggggccacggaacctggtcaccgtctcctcagcctccaccaaggcccatcggtcttcccctggctaccctcctccaagacgcacctcgtggggcacgacgccggcccgtgggccgtcggccgtggtacgaacggtaccttactccatccgtacactactcgacgtcggcgtcggcgaaggccgcgntacg

SEQ ID NO: 78284 - DNA, 173 bp, Homo sapiens; identical to SEQ ID NO: 78276
  misc_feature: GYAE6OF01D1H45.37.26.C04.1.454.CMB.1.raw
  modified_base (173)..(173): a, c, t, g, unknown or other
  misc_feature (173)..(173): n is a, c, g, or t

SEQ ID NO: 78285 - DNA, 559 bp, Homo sapiens
  misc_feature: GYAE6OF01CWLAD.37.26.C04.1.454.CMB.1.raw
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggcctctattactgtgcgagagatcagacggagtatagcagcagctctgactacgtggggccacggaaccctggtcaccgtctcctcacgccctccaccgaacgggcccacgtccggtccttcccccgtcggccctaccctccctacctaacgacgccacctcgtcggggccacgacgccggcccgtcgggctcgcctcggtcaacggactactccatctacactactcgacgcggctcggacaggcncgngtacg

SEQ ID NO: 78286 - DNA, 547 bp, Homo sapiens
  misc_feature: GYAE6OF01D221Q.37.26.C04.1.454.CMB.1.raw
  modified_base (454)..(454): a, c, t, g, unknown or other
  misc_feature (454)..(454): n is a, c, g, or t
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgacgacacggccatatattattgtgacgaaaagaccccaacggtgaccacattggagtcttttgacttctggggccaagggacaacggtcaaccgtctcttcagcctccaccaagggcccatccggtccttccccctggccgcccctgcctccaggacnccacctccgagagcacgagccggcccgtgggctcgcccgtggtccaaggctacttccatctacactactgagcgggctggacaaggcanatgn

SEQ ID NO: 78287 - DNA, 527 bp, Homo sapiens
  misc_feature: GYAE6OF01DEUT5.37.26.C04.1.454.CMB.1.raw
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
tcagtagtgtagatcacgaccggtgctcgatttagtctagcgactttgggtttggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcacccgtctcctcagcctccaccaagggcccatcgtcttcccctggcaccctcctccaagacgcacctcgtggggcacgagcggccctgggctcgcctggtcaacggctactccatcctacactactgagcggctggacaaggcncntag

SEQ ID NO: 78288 - DNA, 174 bp, Homo sapiens
  misc_feature: GYAE6OF01AGUVE.37.26.C04.1.454.CMB.1.raw
  modified_base (173)..(174): a, c, t, g, unknown or other
  misc_feature (173)..(174): n is a, c, g, or t
tcagtagtgtagatcacgaccggtgctcgatttagtctagcgactttgggtttgggggaagaggaagactgatggtcccccaggagttcaggtgctgggcacagcggccctgggctgcctggtcaaggactacttccatctacactactgagcgggctggcaaggcgcatagnn

SEQ ID NO: 78289 - DNA, 531 bp, Homo sapiens
  misc_feature: GYAE6OF01CVY9B.37.26.C04.1.454.CMB.1.raw
  modified_base (527)..(527): a, c, t, g, unknown or other
  misc_feature (527)..(527): n is a, c, g, or t
tcagtagtgtagatcacgaccggtgctcgatttagtctagcgactttgggtttgggaggcttggtacagcctggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcctctattactgtgcgagagatcagacggagtatagcagcagctctgactactggggccacggaaccctggtcaccgtctcctcacgcctccaccaacgggcccatccggtcttcccctcggccaccctccctccaacgacgcacctctggggcacgacgccggccctgggctcgcctcggtcaaggactactccatctacactactgagcggctggcaggcgcngtag

SEQ ID NO: 78290 - DNA, 549 bp, Homo sapiens
  misc_feature: GYAE6OF01DZF0O.37.26.C04.1.454.CMB.1.raw
  modified_base (454)..(454): a, c, t, g, unknown or other
  misc_feature (454)..(454): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccaacggaaccctggtcaccgtctccctcacgccctccaccaacgggcccactccggtccttcccctcggccaccctcctccaacgacncacctcgtcggggcacgacgccggcccgtcgggctcggcctggtcaaggactacgttccatctacactactgagcggctcggacaggcgcgatag

SEQ ID NO: 78291 - DNA, 550 bp, Homo sapiens
  misc_feature: GYAE6OF01AQFN7.37.26.C04.1.454.CMB.1.raw
tcagtagtgtagatcacgaccggtgctcgatttagtctagcgactttgggtttggggaggcttggtacagcctgggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttccccctcggccaccctccctcccaagacgccaccctctcgggggccaccgagccggccccgtggggcctcggccctgggtcaacgggactacttcccatccgtacactactgagcgggctggcaaggcgcagtag

SEQ ID NO: 78292 - DNA, 577 bp, Homo sapiens
  misc_feature: GYAE6OF01B9L94.37.26.C04.1.454.CMB.1.raw
tcagtagtgtagatcacgaccggtgctcgatttagtctagcgactttgggtttggggaggcttggtacagcctggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaagaatacggtctatctaggaaatgaacagcctgagagccgaggacacggccctctattactgtgcgagagatcagacggagtatagcagcagctctgactacgtggggccacggaacctggtcaccgtctcctcacgcctccaaccgacgggcccagtccggttcccttccccgtcggccacccctccctaccaacgacgccacctcggtggggccacgacgccggcccgtgggcctcggccgtggtacaacgggaccttaccgttccaactcctaaccaccttacgtggacggccgggctcgggacgaagggccgcgagtacg

SEQ ID NO: 78293 - DNA, 171 bp, Homo sapiens
  misc_feature: GYAE6OF01D65UY.37.26.C04.1.454.CMB.1.raw
  modified_base (170)..(171): a, c, t, g, unknown or other
  misc_feature (170)..(171): n is a, c, g, or t
tcagtagtgtagatcacgaccggtgctcgatttagtctagcgactttgggtttgggaagaggaagactgacggtccccaggagttcaggtgctgggcacagcggccctgggctgcctggtcaaggactacttccatctacactactgagcgggctggcaaggcgcatagnn

SEQ ID NO: 78294 - DNA, 531 bp, Homo sapiens
  misc_feature: GYAE6OF01EC95B.37.26.C04.1.454.CMB.1.raw
  modified_base (439)..(439): a, c, t, g, unknown or other
  misc_feature (439)..(439): n is a, c, g, or t
  modified_base (452)..(452): a, c, t, g, unknown or other
  misc_feature (452)..(452): n is a, c, g, or t
  modified_base (517)..(517): a, c, t, g, unknown or other
  misc_feature (517)..(517): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattggactggtacttcgatctctggggccgtggcaccctggtcactgtctcctcagcctcaccaagggcccatccggtccttcccctggcnccctgcctcaggngcacctccgagagcacagccggccctgggctgcctggtccaaggactacttccatctacactacngacgcgggctcggg

SEQ ID NO: 78295 - DNA, 527 bp, Homo sapiens
  misc_feature: GYAE6OF01BMDMB.37.26.C04.1.454.CMB.1.raw
  modified_base (520)..(520): a, c, t, g, unknown or other
  misc_feature (520)..(520): n is a, c, g, or t
  modified_base (523)..(527): a, c, t, g, unknown or other
  misc_feature (523)..(527): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaacacgctctatctgcaaatgaacagcctgagagccgaagacacggccgtatattactgtgtgaaaggctggggatggggggactactggggccagggaacctggtcaccgtctcctcagcctccaccaagggcccatccggtcttccccctggccaccctcctccaagacgccacctcgtgggggccacgagccggccctgggctcgcctggtcaaggactacttccatctacactactgagcggctggcaaggcgcanagnnnnn

SEQ ID NO: 78296 - DNA, 603 bp, Homo sapiens
  misc_feature: GYAE6OF01D3KQT.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggttcatctttagcaactacgccatgagctgggtccgccaggctccgagggaaggggctgggagtgggtctcaaggtattactggtagtggtaataccgacatactacgcagactccgtgacgggccgttcaccgtctccagagacaattccaagaatacggtctatcttggaaatgaaacagcctgagagccgaggacaacggcccctcgtattactgtgtcgagagatcagacggagtatagcagcagctcgtgactactggggccacggaaccctggtcaccgtctcctcacgcctccaccaacggcccatccgtcttcccctggccaccctcctcccaacgacgcaccctcgtcggggccacgacggccggccccgtgggcctcgacccgttggtacctaacgggtaccttaccgttcccaacttcccgtaactaaccgttaccgttcggaacggccgggacgttcgggacctaaagggccgacacgtaagg

SEQ ID NO: 78297 - DNA, 174 bp, Homo sapiens
  misc_feature: GYAE6OF01BCW6F.37.26.C04.1.454.CMB.1.raw
  modified_base (173)..(174): a, c, t, g, unknown or other
  misc_feature (173)..(174): n is a, c, g, or t
tcagtagtgtagatcacgaccggtgctcgatttagtctagcgactttgggtttgggggaagaggaagactgacggtcccccaggagttcaggtgctgggcacagcggccctgggctgcctggtcaaggactacttccatctacactactgagcgggctggcaaggcgcatagnn

SEQ ID NO: 78298 - DNA, 173 bp, Homo sapiens; identical to SEQ ID NO: 78276
  misc_feature: GYAE6OF01BV1ZK.37.26.C04.1.454.CMB.1.raw
  modified_base (173)..(173): a, c, t, g, unknown or other
  misc_feature (173)..(173): n is a, c, g, or t

SEQ ID NO: 78299 - DNA, 551 bp, Homo sapiens
  misc_feature: GYAE6OF01DN2ZL.37.26.C04.1.454.CMB.1.raw
  modified_base (544)..(544): a, c, t, g, unknown or other
  misc_feature (544)..(544): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctggaaatgaacagcctgagagccgaggacacggccctctattactgtgcgagagatcagacggagtatagcagcagctctgactacgtggggccacgggaaccctggtccaccgtctcctcacgcctccaccaagggcccatccggtccttccccctcggccacccctcctacccaacgacgccaccctcgtcgggggccacgacgccggccctggggcctgcctggtcaaggctacttccatctacactactgacgcggctggcaaggcncagtacg

SEQ ID NO: 78300 - DNA, 560 bp, Homo sapiens
  misc_feature: GYAE6OF01E0DQB.37.26.C04.1.454.CMB.1.raw
  modified_base (557)..(557): a, c, t, g, unknown or other
  misc_feature (557)..(557): n is a, c, g, or t
tcagtagtgtagatcacgaccggtgctcgatttagtctagcgactttggggtttgggggaggcttggtacagcctcggggggtccctggagactctcctcgtgcagcctctggtttcatctttagcaactacgccatgagctgggtccgccaggcttccagggaaggggctggagtgggtctcaggtatttactggtagtgggtaaataccgcatactacgcagactccgtgacgggccggttcaccgtctccagagacaaattccaaggaatacggtctaatctgggaaatgaacagcctgagagccgaggacacggccctctattacgtgtgcgagagactcagacggagtatagcagcagctctgactactggggccacggaaccctggtccaccgtctcctcagcctccaccaacggccctatcggtctttcccctcgccaccctcctccaagacgcacctcgtcggggcacgacgccgggcccgtcggggctcggccgtcggtcaacggactacttccagtctacactactgacgcggctcggcaaggcgcntag

SEQ ID NO: 78301 - DNA, 565 bp, Homo sapiens
  misc_feature: GYAE6OF01C9RC6.37.26.C04.1.454.CMB.1.raw
  modified_base (561)..(561): a, c, t, g, unknown or other
  misc_feature (561)..(561): n is a, c, g, or t
  modified_base (565)..(565): a, c, t, g, unknown or other
  misc_feature (565)..(565): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacgggaaccctggtccaccgtctccctcacgccctccaccaacgggcccagtccggtcccttcccccgtcggccacccctccctaccaacgacgtaccctcgtcggggcacgacggccggcccgtgggcctcgcctggtaccaacggacctacctccactctacactactggacgcgggctcggacaaggcgcngtgn

SEQ ID NO: 78302 - DNA, 173 bp, Homo sapiens; identical to SEQ ID NO: 78276
  misc_feature: GYAE6OF01B4H47.37.26.C04.1.454.CMB.1.raw
  modified_base (173)..(173): a, c, t, g, unknown or other
  misc_feature (173)..(173): n is a, c, g, or t

SEQ ID NO: 78303 - DNA, 537 bp, Homo sapiens
  misc_feature: GYAE6OF01BR8I5.37.26.C04.1.454.CMB.1.raw
  modified_base (534)..(534): a, c, t, g, unknown or other
  misc_feature (534)..(534): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcagttattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctgggtcaccgtctcctcagcctccaccaacggcccatcggtcttccccctcggccaccctcctccaacgacgcaccctctgggggccacgagccggcccgtgggctgcctggtcaaggactacttccatctacactactgagcgggctggcaaggcgcntag

SEQ ID NO: 78304 - DNA, 173 bp, Homo sapiens; identical to SEQ ID NO: 78276
  misc_feature: GYAE6OF01C1ZHA.37.26.C04.1.454.CMB.1.raw
  modified_base (173)..(173): a, c, t, g, unknown or other
  misc_feature (173)..(173): n is a, c, g, or t

SEQ ID NO: 78305 - DNA, 176 bp, Homo sapiens
  misc_feature: GYAE6OF01DOJ43.37.26.C04.1.454.CMB.1.raw
  modified_base (173)..(176): a, c, t, g, unknown or other
  misc_feature (173)..(176): n is a, c, g, or t
tcagtagtgtagatcacgaccggtgctcgatttagtctagcgactttgggtttgggggaagaggaagactgacggtcccccaggagttcaggtgctgggcacagcggccctgggctgcctggtcaaggactacttccatctacactactgagcgggctggcaaggcgcatagnnnn

SEQ ID NO: 78306 - DNA, 534 bp, Homo sapiens
  misc_feature: GYAE6OF01D9MQA.37.26.C04.1.454.CMB.1.raw
  modified_base (530)..(531): a, c, t, g, unknown or other
  misc_feature (530)..(531): n is a, c, g, or t
tcagtagtgtagatcacgaccggtgctcgatttagtctagcgactttgggtttggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggtcggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcacgcctccaccaacgggcccatccggtccttcccctggccaccctccctccaagacgcacctcgtgggggcacgagccggcccgtgggcctgcctggtcaaggctactccatctacactactgagcgggctggacaaggcnntag

SEQ ID NO: 78307 - DNA, 176 bp, Homo sapiens; identical to SEQ ID NO: 78305
  misc_feature: GYAE6OF01BYHOF.37.26.C04.1.454.CMB.1.raw
  modified_base (173)..(176): a, c, t, g, unknown or other
  misc_feature (173)..(176): n is a, c, g, or t

SEQ ID NO: 78308 - DNA, 591 bp, Homo sapiens
  misc_feature: GYAE6OF01BVLE3.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtccaccgtctcctcacgccctccaccaagggcccatccggtccttcccctggccacccctcctccaacgacgccacctcgtcggggccacgacgccggcccgtggggcctcggcccgttcgggtaccgaaacgggtaccttaccgttcccaagttcctaaccgaccttaaccgtggacggccggggcgtcgggaccgaagggccgcgagtacg

SEQ ID NO: 78309 - DNA, 174 bp, Homo sapiens; identical to SEQ ID NO: 78297
  misc_feature: GYAE6OF01BF7UK.37.26.C04.1.454.CMB.1.raw
  modified_base (173)..(174): a, c, t, g, unknown or other
  misc_feature (173)..(174): n is a, c, g, or t

SEQ ID NO: 78310 - DNA, 544 bp, Homo sapiens
  misc_feature: GYAE6OF01BQBK2.37.26.C04.1.454.CMB.1.raw
  modified_base (540)..(541): a, c, t, g, unknown or other
  misc_feature (540)..(541): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcccctctattactgtgcgagagatcagacggagtatagcagcagctctgactactggggccacggaaccctggtccaccgtctcctcagcctccaccaacgggcccatccggtccttcccccgtggccacccctcctaccaacgacgccacctcgtcggggcacgacgccggcccgtcgggctcgcctggtccaagctacttccatctacactactgacgcggctggacaggcnntag

SEQ ID NO: 78311 - DNA, 538 bp, Homo sapiens
  misc_feature: GYAE6OF01AGQT0.37.26.C04.1.454.CMB.1.raw
  modified_base (317)..(317): a, c, t, g, unknown or other
  misc_feature (317)..(317): n is a, c, g, or t
tcagtagtgtagatcacgaccggtgctcgatttagtctagcgactttgggtttggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattacngtgcgagagatcagacggagtatagcagcagctctgactactggggccacggaaccctggtcaccgtctcctcagcctccaccaacgggcccatcggtccttccccgtggccaccctcctcccaagacgcacctctggggccacgcgccggcccgtgggctcgccgtggtcaaggcctacttccatctacactactgacgcgggctcggcaggcgcagtag

SEQ ID NO: 78312 - DNA, 537 bp, Homo sapiens
  misc_feature: GYAE6OF01C1WFQ.37.26.C04.1.454.CMB.1.raw
  modified_base (533)..(533): a, c, t, g, unknown or other
  misc_feature (533)..(533): n is a, c, g, or t
tcagtagtgtagatcacgaccggtgctcgatttagtctagcgactttgggtttgggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcagcctccaccaacgggcccatccggtcctttccccctggccacccctccctccaacgacgccacctcgtcggggcacagccggcccgtgggctgcctggtcaagactactccatctacactactgagcggctggacaggcnatag

SEQ ID NO: 78313 - DNA, 635 bp, Homo sapiens
  misc_feature: GYAE6OF01B7AG3.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctaatctggaaatgaacagcctgagagccgaggacacggccctctattactgtgcgagagatcagacggagtatagcagcagctctgactacgtggggccaacgggaaccctggtccacccgtctccctcacgccctccaccgaacgggcccagtccggtccttcccccgtcggcccaccctccctaccaacgacgccaccgtcgtcgggggaccacgacggcccgggccccgtcggggcctcggcccgttcgggtaccgaaacgggtaccttaacccgttaccctaacttaccctaacctaacccttaaccgtcggaacgggccggggaccgttacgggacccgaaagggccgaccgtaagtacgg

SEQ ID NO: 78314 - DNA, 538 bp, Homo sapiens
  misc_feature: GYAE6OF01BCU8P.37.26.C04.1.454.CMB.1.raw
  modified_base (535)..(535): a, c, t, g, unknown or other
  misc_feature (535)..(535): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcccctctattactgtgcgagagatcagacggagtatagcagcagctctgactactggggccacggaaccctggtcaccgtctcctcagcctccaccaacgggcccatcggtccttccccctcggccaccctccctccaacgacgccacctcgtcgggggcacacgcggccctgggctgcctggtcaaggactacttccatctacactactgagcggctggcaaggcgcntag

SEQ ID NO: 78315 - DNA, 173 bp, Homo sapiens; identical to SEQ ID NO: 78276
  misc_feature: GYAE6OF01CX8R5.37.26.C04.1.454.CMB.1.raw
  modified_base (173)..(173): a, c, t, g, unknown or other
  misc_feature (173)..(173): n is a, c, g, or t

SEQ ID NO: 78316 - DNA, 173 bp, Homo sapiens; identical to SEQ ID NO: 78276
  misc_feature: GYAE6OF01DXF52.37.26.C04.1.454.CMB.1.raw
  modified_base (173)..(173): a, c, t, g, unknown or other
  misc_feature (173)..(173): n is a, c, g, or t

SEQ ID NO: 78317 - DNA, 173 bp, Homo sapiens; identical to SEQ ID NO: 78276
  misc_feature: GYAE6OF01DJJKT.37.26.C04.1.454.CMB.1.raw
  modified_base (173)..(173): a, c, t, g, unknown or other
  misc_feature (173)..(173): n is a, c, g, or t

SEQ ID NO: 78318 - DNA, 559 bp, Homo sapiens
  misc_feature: GYAE6OF01C2WAY.37.26.C04.1.454.CMB.1.raw
  modified_base (323)..(323): a, c, t, g, unknown or other
  misc_feature (323)..(323): n is a, c, g, or t
  modified_base (362)..(362): a, c, t, g, unknown or other
  misc_feature (362)..(362): n is a, c, g, or t
  modified_base (554)..(554): a, c, t, g, unknown or other
  misc_feature (554)..(554): n is a, c, g, or t
tcagtagtgtagatcacgaccggtgctcgatttagtctagcgactttgggtttgggggtagggcttggtacagccgtggggggtcccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccgttcaccgtctccagagacaattccaaagaatacggtctatctaggaaatgaacagctgagagcgaggacacggcctctatactgtncgagagatcagacgagtatagcagcagctctgactacgnggggccacggtaaccctggtaccaccgtctccctcacgccctccaaccgaacgggcccactccggtccttccccgtcggccacccctcctaccaagacgcaccgtcgtggggccacgacgccggcccgtcgggctcgcctggtacaacggactactccatctacactactgacgcggcgtcggacgaaggcncagtg

SEQ ID NO: 78319 - DNA, 564 bp, Homo sapiens
  misc_feature: GYAE6OF01DK92C.37.26.C04.1.454.CMB.1.raw
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcacgccctccaccaacgggcccagtccggtccctttcccccgtcggccacccctccctccaacgacgccaccctcgtcggggccacgacgccggcccgtgggcctgcccgtggtcgaacggactaccttccactcctactactacgtgacgcgggctcggacaggcngntacg

SEQ ID NO: 78320 - DNA, 554 bp, Homo sapiens
  misc_feature: GYAE6OF01BOTLJ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtccaccgtctcctcacgcctccaccaacggcccagtcgtccttccccctcggccacccctcctaccaacgacgcacctcgtcggggccacgacgccggcccgtgggctcgccgtggtcaacggacctaccgttccactctaccactacgtgacgcgggctcggcaaggcgcgagtag

SEQ ID NO: 78321 - DNA, 539 bp, Homo sapiens
  misc_feature: GYAE6OF01AIUX0.37.26.C04.1.454.CMB.1.raw
  modified_base (536)..(536): a, c, t, g, unknown or other
  misc_feature (536)..(536): n is a, c, g, or t
  modified_base (539)..(539): a, c, t, g, unknown or other
  misc_feature (539)..(539): n is a, c, g, or t
tcagtagtgtagatcacgaccggtgctcgatttagtctagcgactttgggtttgggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcggactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaacggcccatcggtccttccccctggccaccctcctccaacgacgccacctcgtcggggcacgacgccggccctgggcctgcctggtccaaggactacttccactctacactactggacgcggctggcaaggcgcntgn

SEQ ID NO: 78322 - DNA, 174 bp, Homo sapiens; identical to SEQ ID NO: 78297
  misc_feature: GYAE6OF01COLGI.37.26.C04.1.454.CMB.1.raw
  modified_base (173)..(174): a, c, t, g, unknown or other
  misc_feature (173)..(174): n is a, c, g, or t

SEQ ID NO: 78323 - DNA, 598 bp, Homo sapiens
  misc_feature: GYAE6OF01C311Y.37.26.C04.1.454.CMB.1.raw
  modified_base (268)..(268): a, c, t, g, unknown or other
  misc_feature (268)..(268): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaaagaatacggtntatctggaaatgaacagcctgagagccgaggacacggcctctattactgtgcgagagatcagacgagtatagcagcagctctgactacgtggggaccacggaaccctggtccaccgtctcctcacgccctccaccgaacggcccagtccggtcccttccccgtcggcctaccctccctaccaacgacgccacccgtcgtcgggggaccacgacgccggcccgtcgggcgtcggcccgtcggtaccgaacggtaccttaccgttcctacttcctaacctacctaaccgtcggtaacggcgggtccgtcgggacgaagggccgcgaagtacg

SEQ ID NO: 78324 - DNA, 575 bp, Homo sapiens
  misc_feature: GYAE6OF01CL11T.37.26.C04.1.454.CMB.1.raw
tcagtagtgtagatcacgaccggtgctcgatttagtctagcgactttgggtttggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcagccctccaccaagggcccatccggtccttccccctggccaccctccctccaacgacgccaccctcgtggggccacgacgccggcccgtgggcctcggccgtcggtaccgaacggtaccttaccgttccctactaccgtaccaccttaacctcggacgcgggctcgggacaaggcgcgagtacg

SEQ ID NO: 78325 - DNA, 524 bp, Homo sapiens
  misc_feature: GYAE6OF01DIZ4X.37.26.C04.1.454.CMB.1.raw
  modified_base (520)..(521): a, c, t, g, unknown or other
  misc_feature (520)..(521): n is a, c, g, or t
tcagtagtgtagatcacgaccggtgctcgatttagtctagcgactttgggtttggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcctctattactgtgcgagagatcagacggagtatagcagcagctctgactactggggccacggaaccctggtcaccgtctcctcagcctccaccaacgggcccatcggtcttcccctcggcaccctcctccaagacgcacctctggggcacagcggccctgggctgcctgtcaaggactacttccatctacactactgacgcggctcggcaggcgnntag

SEQ ID NO: 78326 - DNA, 547 bp, Homo sapiens
  misc_feature: GYAE6OF01ECXSU.37.26.C04.1.454.CMB.1.raw
  modified_base (543)..(543): a, c, t, g, unknown or other
  misc_feature (543)..(543): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcacgcctccaccaacggcccatccggtccttcccctcggccaccctccctcccaagacgcacctcgtggggccacacgccggcccgtcgggctcgcctcggtacaaggactacttccatcctacactacgtgagcgggctggcaaggcgcgntacg

SEQ ID NO: 78327 - DNA, 562 bp, Homo sapiens
  misc_feature: GYAE6OF01C9KHS.37.26.C04.1.454.CMB.1.raw
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (315)..(315): a, c, t, g, unknown or other
  misc_feature (315)..(315): n is a, c, g, or t
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (454)..(454): a, c, t, g, unknown or other
  misc_feature (454)..(454): n is a, c, g, or t
  modified_base (484)..(484): a, c, t, g, unknown or other
  misc_feature (484)..(484): n is a, c, g, or t
  modified_base (549)..(549): a, c, t, g, unknown or other
  misc_feature (549)..(549): n is a, c, g, or t
tcagtagtgtagatcacgaccggtgctcgatttagtctagcgactttgggttggggaggcttggtacaggccgtggggggtccctgagactctcctgtgcagcctctggtttcatctttagcaactacgccatcccgagctgggtccgccaggctcgagggaaggggctggagtgggtctcaggtattactggtagtggtaaataccgnatactacgcagactcgngacgggccgtcacgtncaganacaatccaaagatacggtctatcaggaaatgaacagcctgagagccgaggacacggcctctattacgngtgcgagagatcagaggatanagcagcagctcngactacgtggggccaacgggtaacctggtcaccgtctcctcacgccctaccacgaacggcccagtccggtccttcccccgtggccgccctcgcctaccgaggaccnccaccgcgagacgccacgcggccggtccgnggctcgcgtcggtacaacgtaccttacctacctactacctaactacgtacgtagacgggcggcgnggacgaaggcgac

SEQ ID NO: 78328 - DNA, 561 bp, Homo sapiens
  misc_feature: GYAE6OF01DW110.37.26.C04.1.454.CMB.1.raw
  modified_base (557)..(557): a, c, t, g, unknown or other
  misc_feature (557)..(557): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcacgcctccaccaacgggcccatcggtccttccccgtcggccacccctcctcccaacgacgccacccgtcgtcgggggccacgacgccggcccgtcggggcctcgcccgtggtccgaacggacctaccttccatcctacactactgagcgggctggacaaggcgcgngtag

SEQ ID NO: 78329 - DNA, 546 bp, Homo sapiens
  misc_feature: GYAE6OF01D20ZS.37.26.C04.1.454.CMB.1.raw
  modified_base (543)..(543): a, c, t, g, unknown or other
  misc_feature (543)..(543): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcccctctattactgtgcgagagatcagacggagtatagcagcagctctgactactggggccacggaaccctggtcaccgtctcctcacgcctccaccaacgggcccatccggtccttccccctcggccacccctcctccaacgacgccaccctcgtgggggccacgacgccggcccgtgggctcgcctggtcaacggactactccatctacactactgagcggctcggacaggcgcntag

SEQ ID NO: 78330 - DNA, 568 bp, Homo sapiens
  misc_feature: GYAE6OF01B6CMJ.37.26.C04.1.454.CMB.1.raw
  modified_base (346)..(346): a, c, t, g, unknown or other
  misc_feature (346)..(346): n is a, c, g, or t
  modified_base (379)..(379): a, c, t, g, unknown or other
  misc_feature (379)..(379): n is a, c, g, or t
tcagtagtgtagatcacgaccggtgctcgatttagtctagcgactttgggtttggggaggcttggtacagcctgggggtccctgagactctcctgtgcagcctctggtttcatctttagcaactacgccatgagctgggtccgccaggctccagggaagggtctggagtgggtctcatccatcagttacaatggtcaaaccatatactacgcagattttatgaagggccgcttcaccatctccagagacaaagccaaagagctctctgtttctgcatatggacagcctgagagccgacgacgcggctctatattactgtgcgagatgggacggcggtggctgggtnactcggtcgactcttaacgactactatcgcttnatggacgtcgtggggcaaagggaccacggtcaccgtctcctccgcctccaccaacggcccatccggtccttcccccgtggccacccgtccctccaacgacgccaccgtccgtcgggggccacgacggccgggccctgggcctcggcccgtcgggttaccaaacgggtacctaaccttcccgagttaccc

SEQ ID NO: 78331 - DNA, 609 bp, Homo sapiens
  misc_feature: GYAE6OF01AD90O.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgccctccaccaacgggcccatccggtcccttccccgtcggcccacccctccctcccaacgacgccaccgtccgtcgggggccacgacggccgggccccgtcggggcctcggcccgttcgggtaccgaaacgggtacctaccgttacccacttacctaccgtaaccttacgtcggacggtccgggccgtcgggaccgaaagggccgcgaagtacg

SEQ ID NO: 78332 - DNA, 591 bp, Homo sapiens
  misc_feature: GYAE6OF01E2TZT.37.26.C04.1.454.CMB.1.raw
  modified_base (376)..(376): a, c, t, g, unknown or other
  misc_feature (376)..(376): n is a, c, g, or t
tcagtagtgtagatcacgaccggtgctcgatttagtctagcgactttgggtttgggggaggcttggtacagcctggggggtccctgagactctcttgtgcagcctctggtttcatctttagcaactacgccatgagctgggtccgccaggctccgaggggaaggggctggagtgggtctcaggtattactggtagtggtaataccgcatactacgcagactccgtgacgggccggttcaccgtctccagagacaattccaagaatacggtctatctaggaaatgaacagcctgagagccgaggacacggccctctattactgtgcgagagatcagacggagtatagcagcagctctgactacggggggggggggtnccgacggaaccctggtccaccgtctcctcacgccctccaccgacgggcccagtccggtcccttcccccgtggccgccctcgcctcccgaggacgccaccctccgagacgcacgacgccggcccgtgggcctcggccgtggtaccaacgggtaccttaccttccacttcctaaccaccttacgtggacggccgggcgtagggaccgaagggcgacg

SEQ ID NO: 78333 - DNA, 532 bp, Homo sapiens
  misc_feature: GYAE6OF01ALOYM.37.26.C04.1.454.CMB.1.raw
  modified_base (529)..(529): a, c, t, g, unknown or other
  misc_feature (529)..(529): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttccccctcggccacccctccctcccaacgacgcaccctctgggggcacagcggccctgggctgcctggtcaggctacttccatctacactactgagcgggctggcaggcgcntag

SEQ ID NO: 78334 - DNA, 549 bp, Homo sapiens
  misc_feature: GYAE6OF01EPIRA.37.26.C04.1.454.CMB.1.raw
  modified_base (545)..(546): a, c, t, g, unknown or other
  misc_feature (545)..(546): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctgggtccaccgtctcctcacgcctccaccaacgggcccatccggtccttcccccgtcggccacccctcctccaagacgcaccctcgtcggggccacgacgccggcccgtgggctcgccgtggtcaaggactacttccatcctacactactgagcggcgtggacaaggcgnntag

SEQ ID NO: 78335 - DNA, 559 bp, Homo sapiens
  misc_feature: GYAE6OF01A5KOI.37.26.C04.1.454.CMB.1.raw
  modified_base (553)..(554): a, c, t, g, unknown or other
  misc_feature (553)..(554): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtggggtctcaggtattactggtagtggtaataccgcatactacgcagactccgtgacgggccggttcaccgtctccagagacaattccaagaatacggtctatctggaaatgaacagcctgagagccgaggacacggcctctattactgtgcgagagatcagacggagtatagcagcagctctgactacgtggggccacggaaccctggtcaccgtctcctcacgcctccaccgaacggcccacgtccgtccttcccctcggccacccctcctccaacgacgccacctcgtcggggcacgacgccggcccgtcgggctcggccgtggtaccaacggacctacgttccatcctacacctactgacgcgggctcggacaaggcgnngtacg

SEQ ID NO: 78336 - DNA, 173 bp, Homo sapiens
  misc_feature: GYAE6OF01CTES7.37.26.C04.1.454.CMB.1.raw
  modified_base (173)..(173): a, c, t, g, unknown or other
  misc_feature (173)..(173): n is a, c, g, or t
tcagtagtgtagatcacgaccggtgctcgatttagtctagcgactttgggtttgggggaagaggaagactgacggccccccaggagttcaggtgctgggcacagcggccctgggctgcctggtcaaggactacttccatctacactactgagcgggctggcaaggcgcatagn

SEQ ID NO: 78337 - DNA, 609 bp, Homo sapiens
  misc_feature: GYAE6OF01C406B.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcacccgtctcctcacgccctccaccgaacggcccagtccggtccttcccccgtggcccaccctccctaccaacgacgccaccctcgtcggggctacgacggccggcccgtggggcctcgcccgttgggtaccaacgggtaccttacccgttacctaacgttccctaaaccgtaccttaaccgttcggacggtccgggtcgtcgggaccgtaagggccgacgtagtaacg

SEQ ID NO: 78338 - DNA, 542 bp, Homo sapiens
  misc_feature: GYAE6OF01D18QV.37.26.C04.1.454.CMB.1.raw
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggcccctctatttactgtgcgagagatcagacggagtatagcagcagctctgactactggggccacggaaccctggtcaccgtctcctcagcctccaccaacgggcccatccggtcttcccctggccacccctcctccaacgacgcaccctcgtggggccacgacgccggcccgtggggcctgccgtggtcaaggacctactcccatctacactactgagcgggctggcaggcngntag

SEQ ID NO: 78339 - DNA, 580 bp, Homo sapiens
  misc_feature: GYAE6OF01C8LDM.37.26.C04.1.454.CMB.1.raw
  modified_base (216)..(216): a, c, t, g, unknown or other
  misc_feature (216)..(216): n is a, c, g, or t
  modified_base (327)..(327): a, c, t, g, unknown or other
  misc_feature (327)..(327): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
tcagtagtgtagatcacgaccggtgctcgatttagtctagcgactttgggtttgggggtaggcgttggtacagcctggggggtccctgagactctcctgtgcagcctctaggtttctatctttaagtcaactacgccatgagctaggtccgccagactccgagggaagggcgtggaggtgggtactcaaggtattacgtggtagtggtaataccgnatactacgcagacctccgtgacgggccggttcaccgtctccagagacaattccaaggaatacggtctaagtctaggaaatgaacagcctgagagccgaggacacggccctntattactgtgcgagagatcagacggagtatagcagcagctctgactacgtggggccacggaaccctggcaccgtctcctcacgccctaccaaccgaacgggcccacgtccggtcccttccccgtcggcccacccctccctaccgaacgacgcacccgtcgtcggggcacgacgccggcccgtcgggctcgccgtggtacaaggtacctactccatcctacactactgaggcgggcgtggacgaggcgngntag

SEQ ID NO: 78340 - DNA, 608 bp, Homo sapiens
  misc_feature: GYAE6OF01A0VLX.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtccaccgtctcctcacgccctccaccaacgggcccactcggtccttccccctcggccaccctccctccaacgacgccaccctcgtcgggggccacgacgccggccccgtcggggcctcggcccgttcgggtaccaacgggtaccttaccgttcccaacgttccgttaacctaccgttaaccgtcggacggtccggggccgtcgggaccgaaacgggccgcgtacgtacgg

SEQ ID NO: 78341 - DNA, 603 bp, Homo sapiens
  misc_feature: GYAE6OF01EH7M2.37.26.C04.1.454.CMB.1.raw
  modified_base (243)..(243): a, c, t, g, unknown or other
  misc_feature (243)..(243): n is a, c, g, or t
tcagtagtgtagatcacgaccggtgctcgatttagtctagcgactttgggtttgggggagggcttggtacagcctggggggtccctgagactctcctgtgcagcctctggtttcatctttagcaactacgccatgagctgggtccgccaggctccagggtaaggggctggagtgggtctcagccattagtagtagtggtggaagcacgtactacgctgactccgtgaagggccgttcgccctntccagagacaactccaacaacacgctgtactctgcaacttaacagcctgagagacgaggacacggccgtatattactggtgcgaaggaagggtctagcagtgcctggtactccatactatagtggacgtctggggacaaaggatcgcggtcaccgtctcctcagcctccaccgaacgggccctagtcggtcttccccctcggcctaccctcctaccaacgacgactaccgtcgtcggggccacgacggtccgggcccgtcggggccgtcggccgtcggtaccgaaacgggtaaccttaccgttccgtattccgtaacaccttacgtacggtacggcgggtactcgggcgaacgggtcccg

SEQ ID NO: 78342 - DNA, 545 bp, Homo sapiens
  misc_feature: GYAE6OF01C8GUE.37.26.C04.1.454.CMB.1.raw
  modified_base (388)..(388): a, c, t, g, unknown or other
  misc_feature (388)..(388): n is a, c, g, or t
  modified_base (540)..(541): a, c, t, g, unknown or other
  misc_feature (540)..(541): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggccaccgtcncctcagccctccaccaagggcccatccggtcttccccctggccaccctccctccaacgacgccaccctcgtcggggcacgagccggcccgtgggctcgccgtggtcaaggtactactccatctacactactgacgcggctcggacaaggcgnntacg

SEQ ID NO: 78343 - DNA, 577 bp, Homo sapiens
  misc_feature: GYAE6OF01EPZES.37.26.C04.1.454.CMB.1.raw
  modified_base (353)..(353): a, c, t, g, unknown or other
  misc_feature (353)..(353): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctggaaatgaacagcctgagagccgaggacacggccctctattactgtgcgagagatcagacggagtatagcagcagctcngactacgtgggccacggaaccctggtccaccgtctcctcacgccctccaccgacggcccactccggtccttccccgtcggccaccctcgcctccgacggacgccaccgtccgacgacgcacgacggccgggcccgtcgggcctcggcccgtcggtacgaacggtacctaccgttcccgactacctacctacttacgtgacggcgggacgtaggcgaaggcgacg

SEQ ID NO: 78344 - DNA, 653 bp, Homo sapiens
  misc_feature: GYAE6OF01BU0E7.37.26.C04.1.454.CMB.1.raw
tcagtagtgtagatcacgaccggtgctcgatttagtctagcgactttggtttggggaggcttggtaccagccctgggggtccctgagactcttcctgtgcagcctctggtttcatctttagcaacgtacgccatgagcgttgggtccgccaggcttccgtagggaagggtctggagtgggtctcaggtatttactggttagtggtaataccgctagtacgtacgcgagactcggtgacgggccgttcacgtctccagagacaattccaagactacggtctaatctggaaatgaactagcctgagagccgaggacacggcctcgtaagttacgtgtgcgagagatcagacggattacgtaggcagcagctcgtgacgtacgtggggcccacggtaaccctgggtaccgacccgttctcccgtacgacgtccctacccgaaccgaacggccccaacgtccggtacccttcccccgtcggtcccacccgtacccttcccgaacgacgccgacccgtcgtacggggtccacgacgcccggtcccgtacgggtccgtcgaccgttacggtaccgtaacggtacgttaccgtcccgtaacgtccgtaaccgtactaccgtcggacgtccgggtcgttcggacgtaggccgcgtgtacgg

SEQ ID NO: 78345 - DNA, 538 bp, Homo sapiens
  misc_feature: GYAE6OF01C5UGR.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcgggtattactggtagtggtaataccgcatactacgcagactccgtgacgggccggttcaccgtctccagagacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaacgggcccatcggtcttcccctggcgccctgctccagacgcacctccgagacgcacagccggccctgggcctgcctggtcaggactacgttccatctacactactgagcggctggcaggcg

SEQ ID NO: 78346 - DNA, 553 bp, Homo sapiens
  misc_feature: GYAE6OF01DT8S1.37.26.C04.1.454.CMB.1.raw
  modified_base (437)..(437): a, c, t, g, unknown or other
  misc_feature (437)..(437): n is a, c, g, or t
  modified_base (454)..(454): a, c, t, g, unknown or other
  misc_feature (454)..(454): n is a, c, g, or t
  modified_base (463)..(463): a, c, t, g, unknown or other
  misc_feature (463)..(463): n is a, c, g, or t
  modified_base (548)..(548): a, c, t, g, unknown or other
  misc_feature (548)..(548): n is a, c, g, or t
tcagtagtgtagatcacgaccggtgctcgatttagtctagcgactttgggttttggggggtaggggcgttggttacgagccgtcggggggtcccggtcgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctgggtccaccgtctcctcagcctccaccaaggcccatcgtcttccccncgcaccctcctcaacgnccacctcgnggggcacagccggccctgggctgcccgtggtcaacggtactaccttccgatcctaactactactgaggcggcgtggcgaaggcgnagtag

SEQ ID NO: 78347 - DNA, 557 bp, Homo sapiens
  misc_feature: GYAE6OF01BLIBW.37.26.C04.1.454.CMB.1.raw
  modified_base (553)..(553): a, c, t, g, unknown or other
  misc_feature (553)..(553): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaacgggcccatccggtccttccccctcggccacccctccctcccaacgacgccaccctcgtcgggggccacgacggccggccccgtggggcctcgcccgtggtccaaggacctacttccatcctacactactgagcgggctggcaaggcgcngtag

SEQ ID NO: 78348 - DNA, 571 bp, Homo sapiens
  misc_feature: GYAE6OF01CDR92.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggattcaactttggtagctattggatggactgggtccgccagtctccagggaaggggctggagtgggtggccaacatacagggaggtggtggtacgaaaaactatgtggactctgtgcggggccgattcaccatctccagagacaacgccaaaaactcactgtatctgcaaatggacggcctgagatccgaggacacggctgtgtattattgtgcgagagatttagactacaaagttttcgagtgactggtatgatgcttatgataccgtggggccaagggccatggtcaccgtctcttcacgcctccaccaacgggcccagtccggtccttccccgtggccgccctgcctccgaggacgccacctccgagacgcacgacgccggcccgtggggcctcggcccgttgggtccaagggaccttaccttcccgacttcctaaccaccttacctggacggcgggtcg

SEQ ID NO: 78349 - DNA, 521 bp, Homo sapiens
  misc_feature: GYAE6OF01BR7L8.37.26.C04.1.454.CMB.1.raw
  modified_base (439)..(439): a, c, t, g, unknown or other
  misc_feature (439)..(439): n is a, c, g, or t
  modified_base (454)..(454): a, c, t, g, unknown or other
  misc_feature (454)..(454): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
tcagtagtgtagatcacgaccggtgctcgatttagtctagcgactttgggtttgggggaggcttggtacagcctggggggtccctgagactctcctgtgcagcctctggattcaactttggtagctattggatggactgggtccgccagtctccagggaaggggctggagtgggtggccaacatacagggaggtggtggtacgaaaaactatgtggactctgtgcggggccgattcaccatctccagagacaacgccaaaaaactcactgtatctgcaaaatggacggcctgagatccgaggacacggctgtgtattattgtgcgagagatttagactaacaaagtttcgagtgactggtatgatgcttatgataccgtggggaccaaagggaccaatggtcaccgtctcttcagcctccacaaggccatcgtctcccngcgccctgctcagcncacctcgagacgcacacgcggccctgggctgcctggtcaaggctctccatctacactatgngcgggn

SEQ ID NO: 78350 - DNA, 173 bp, Homo sapiens; identical to SEQ ID NO: 78276
  misc_feature: GYAE6OF01AWAI8.37.26.C04.1.454.CMB.1.raw
  modified_base (173)..(173): a, c, t, g, unknown or other
  misc_feature (173)..(173): n is a, c, g, or t

SEQ ID NO: 78351 - DNA, 566 bp, Homo sapiens
  misc_feature: GYAE6OF01D95XW.37.26.C04.1.454.CMB.1.raw
  modified_base (561)..(561): a, c, t, g, unknown or other
  misc_feature (561)..(561): n is a, c, g, or t
tcagtagtgtagatcacgaccggtgctcgatttagtctagcgactttgggtttggggaggcttgggtacagcctggggggtccctgagactctcctgtgcagccttctggtttcatctttagcaactacgccatgagctggggtccgccaggctccagggaaggggcctggagtgggtctcaggtattactggtagtggtaataccggcatacctacgcagactccgtgacgggcggttcacgtctccagagacaacgccaagaactcaactgtattctgcaaatgaacagcctgagagccgaggacacggctgtgtatttactggtgcgagagccctccaccgtcagcagcagcggtgacttctgggggccaaggggaacccttggtccaccgttctcctcaacgcctccaaccaacggcccagtcggtcttccccgtcggtccaccctcctccaacgtacgtcacctcgtcggggcacaagccggcccttgggccttcgccgttcggtctaaggacctacgttccatcctacactactgacgcggcgtcggacaggcgnagtag

SEQ ID NO: 78352 - DNA, 601 bp, Homo sapiens
  misc_feature: GYAE6OF01EBHWA.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaagaatacggtctatctaggaaatgaacagcctgagagccgaggacacggcctctattactgtgcgagagatcagacggagtatagcagcagctcgtgactacgcggggccaacggaccctggtaccaccgtctccctcgacgccctccaccgacggccacgtccgtcccttccccgtcgtccacccctcctaccgaacgacgacctaccgtcgtcgggccacgcggccggcccgtcgggtccgtcgccgtcggtacgaacggtacctaccgttaccacttaccgtaccgtaacctacgtcggaccgggtccgggacgtcgggacggaacgggccgagtacgtacg

SEQ ID NO: 78353 - DNA, 548 bp, Homo sapiens
  misc_feature: GYAE6OF01BI02Y.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtccttccccctggccaccctccctccaacgacgccaccctcgtcgggggccacgagccggcccgtggggcctgccctgggtcaacggactacgttccatctacactactgagcgggctggcaaggcgcagtacg

SEQ ID NO: 78354 - DNA, 546 bp, Homo sapiens
  misc_feature: GYAE6OF01EJYUG.37.26.C04.1.454.CMB.1.raw
  modified_base (539)..(539): a, c, t, g, unknown or other
  misc_feature (539)..(539): n is a, c, g, or t
  modified_base (542)..(542): a, c, t, g, unknown or other
  misc_feature (542)..(542): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcccctctattactgtgcgagagatcagacggagtatagcagcagctctgactactggggccacggaaccctggtcaccgtctcctcagccctccaccaacggcccatccggtccttccccctcggccacccctccctccaacgacgcacctcgtcgggggcacgacgccggcccgtgggctcgcctggtcaacggactacttccatctacactactgagcggcgtggcaggcncgngtag

SEQ ID NO: 78355 - DNA, 524 bp, Homo sapiens
  misc_feature: GYAE6OF01EX4NZ.37.26.C04.1.454.CMB.1.raw
  modified_base (438)..(438): a, c, t, g, unknown or other
  misc_feature (438)..(438): n is a, c, g, or t
  modified_base (501)..(501): a, c, t, g, unknown or other
  misc_feature (501)..(501): n is a, c, g, or t
  modified_base (520)..(520): a, c, t, g, unknown or other
  misc_feature (520)..(520): n is a, c, g, or t
tcagtagtgtagatcacgaccggtgctcgatttagtctagcgactttgggtttggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcccctctattactgtgcgagagatcagacggagtatagcagcagctctgactactggggccacggaaccctggtcaccgtctcctcagcctccaccaaggcccatcggtcttcccctggcaccctcctccaanagcacctctggggcacacgcggccctgggctgcctggcaaggactacttccatctacactacngagcggctggcaaggcgcngtag

SEQ ID NO: 78356 - DNA, 585 bp, Homo sapiens
  misc_feature: GYAE6OF01A1NWM.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacgagtatagcagcagctctgactacgtggggccacggaaccctggtcaccgtctcctcacgcctccaccaacggcccagtcggtcccttcccccgtggccacccctccctaccaacgacgccacccgtcgtcggggcacgacgccggcccgtggggcctcgcccgtcgggtaccaacggtacttaccgttccctactccgtaaccaccttacgtcgacggccgggcgtcgggaccgaagggccgcgagtacg

SEQ ID NO: 78357 - DNA, 560 bp, Homo sapiens
  misc_feature: GYAE6OF01BEO6E.37.26.C04.1.454.CMB.1.raw
  modified_base (555)..(555): a, c, t, g, unknown or other
  misc_feature (555)..(555): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagccctccaccaacgggcccactccggtccttccccctcggccacccctccctcccaacgacgccaccctcgtcggggcacgacgccggcccgtcgggcctcgcctcgggtcaacggtacctacttccactcctacactactgacgcgggctggacaggcgcgngtacg

SEQ ID NO: 78358 - DNA, 535 bp, Homo sapiens
  misc_feature: GYAE6OF01EN1ZZ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggattcaactttggtagctattggatggactgggtccgccagtctccagggaaggggctggagtgggtggccaacatacagggaggtggtggtacgaaaaactatgtggactctgtgcggggccgattcaccatctccagagacaacgccaaaaactcactgtatctgcaaatggacggcctgagatccgaggacacggctgtgtattattgtgcgagagatttagactacaaagtttcgagtgactggtatgatgcttatgatacctggggaccaaagggaccagtggtcaccgtctcttcagcctcaccaaggcccatcggtcttcccctggccgccctgctccaggacgccacctccgagacgcacagccgcccgtgggcctgcctggtcaaggactaccttccatctacactactgagcgggcg

SEQ ID NO: 78359 - DNA, 571 bp, Homo sapiens
  misc_feature: GYAE6OF01AJZZ4.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggccacggaaccctgggtccaccgtctcctcacgcctccaccaagggcccatccggtcttccccctggccacccctcctccaacgacgccaccctcgtcggggccacgacggccggcccgtggggcctggcccgttggtccaaacgggtacctaccttccacttcctaccacctaacgtcgacgccgggctcggcgaaggccgcagtacg

SEQ ID NO: 78360 - DNA, 558 bp, Homo sapiens
  misc_feature: GYAE6OF01B7B1P.37.26.C04.1.454.CMB.1.raw
  modified_base (553)..(554): a, c, t, g, unknown or other
  misc_feature (553)..(554): n is a, c, g, or t
tcagtagtgtagatcacgaccggtgctcgatttagtctagcgactttgggtttgggggaggcttggtacagcctcggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcagcctccaccaacgggcccatccggtccttccccgtcggccaccctcctaccaacgacgcacctcgtcggggccacgacgccggcccgtggggtcctcggcctgggtaccgaacggacctacgttccatcctacactactcgagcggctcggcgaaggcgnngtag

SEQ ID NO: 78361 - DNA, 553 bp, Homo sapiens
  misc_feature: GYAE6OF01ETW2R.37.26.C04.1.454.CMB.1.raw
  modified_base (320)..(320): a, c, t, g, unknown or other
  misc_feature (320)..(320): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctatactgtncgagagatcagacggagtatagcagcagctctgactacgtggggtcacggaaccctggtccaccgtctcctcagccctccaccgaacggcccagtccggtcccttcccccgtcggccaacccctccctacccaacgacgcaccctcgtcgggggccacgacgccggcccgtgggcctgcctggtcaacggactacttccatctacactactgagcggctggcaaggcngntag

SEQ ID NO: 78362 - DNA, 593 bp, Homo sapiens
  misc_feature: GYAE6OF01C22R0.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctaatctaggaaatgaacagcctgagagccgaggacacggccctctattactgtgcgagagatcagacggagtatagcagcagctctgactacgtggggccaacggaacctggtccaccgtctcctcacgcctccaccgaacgggccccagtccggtcccttcccccgtcggccaccctccctaccaacgacgccacctcgtcggggccacgacgccggcccgtgggcctcgccgtggtaccgaacggtaccttaccgttacccactacctaaccaccttacgtggacggccggggccgtcgggaccgaagggccgcgaagtag

SEQ ID NO: 78363 - DNA, 549 bp, Homo sapiens
  misc_feature: GYAE6OF01BHQCJ.37.26.C04.1.454.CMB.1.raw
  modified_base (549)..(549): a, c, t, g, unknown or other
  misc_feature (549)..(549): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagatacggtctatctggaaatgaacagcctgagagccgaggacacggcccctctattactgtgcgagagatcagacggatatagcagcagctctgactactggggccacggaaccctggtccaccgtctcctcacgccctccaccaacgggcccatccggtccttcccccgtcggccacccctcctccaacgacgtacctcgtcggggcacgacgccggcccgtgggctcgcctggtcaacggacctaccttccatcctacactactgacgcgggctggcaaggcgcatgn

SEQ ID NO: 78364 - DNA, 568 bp, Homo sapiens
  misc_feature: GYAE6OF01A8X9R.37.26.C04.1.454.CMB.1.raw
  modified_base (561)..(561): a, c, t, g, unknown or other
  misc_feature (561)..(561): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgccctccaccaacggcccagtccggtccttcccccgtcggccacccctccctaccaacgacgccacctcgtcggggcacgacgccggcccgtgggcctcgccgtcggtacaacggacctacttaaccatcctactactacgtcgacgcgggcgtcggacaaggcgngagtacg

SEQ ID NO: 78365 - DNA, 586 bp, Homo sapiens
  misc_feature: GYAE6OF01AB9JC.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaaataccgcatactacgcagactccgtgacgggccggttcaccgtctccagagacaattccaagaatacggtctatctggaaatgaaacagcctgagagccgaggacacggcccctctattactgtgcgagagatcagacggagtatagcagcagctctgactacgtggggcccacgggaaccctggtccaccgtctcctcagcctccaccaacggcccatccggtccttcccctcggccacccctccctacccaacgacgccacctcgtcggggccacgacgccggccccgtggggcctcgccgtacggtcaacggtacctaccttaccactccgtaccaccttacgtcggacggccgggcgtcgggaccgaagggccgcgagtacg

SEQ ID NO: 78366 - DNA, 575 bp, Homo sapiens
  misc_feature: GYAE6OF01D2WMM.37.26.C04.1.454.CMB.1.raw
  modified_base (568)..(568): a, c, t, g, unknown or other
  misc_feature (568)..(568): n is a, c, g, or t
  modified_base (571)..(571): a, c, t, g, unknown or other
  misc_feature (571)..(571): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctaggaaatgaacagcctgagacgccgagacaccggcctctattactgtgcgagagatcgagacgagtatagcagcagctctagactacgtcggggcccaacggtaccctggacctaccgtcctcctacacgccctaccgaccgaacggccctacgtccgttcccttccccgtcgcccacccctcctaccaacgacgccaccgtcgtcggggacacgcgccggccgtcggctccgcgtcgtacgacgtactacctccactacctactactacgtggacgcggcgtacggacgaggcncgngtcg

SEQ ID NO: 78367 - DNA, 593 bp, Homo sapiens
  misc_feature: GYAE6OF01DHXNI.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctagactacgtggggcccaacggaaccctggtcacccgtctcctcacgccctaccaccgaacgggccccagtccggttcccttcccccgtcggccacccctccctaccaacgacgccacctcgtcggggccacgacgccggcccgtgggcctcggccgttcggtaccgaacgggtaccttaccttccgaattaccgttaaccaacttacgtgacggcgggcgtcgggacgaggcgcgagtacg

SEQ ID NO: 78368 - DNA, 535 bp, Homo sapiens
  misc_feature: GYAE6OF01CYN0E.37.26.C04.1.454.CMB.1.raw
  modified_base (530)..(530): a, c, t, g, unknown or other
  misc_feature (530)..(530): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgaagggccggttcaccatctccagggacaattccaagaacacactgtctctgcaaatgaacagcctgagagtcgaggacacggccttatattactgtgtgaagggacctctagccccttatagcagcgctggtcctggtacttgacgactggggccagggaaccctggtcaccgtctcctcagccctccaccaagggcccatcgtccttcccctggccgccctgctccagacgcacctcgagagcacagcggccctgggctcgcctggtcaaggacctactccatcctacactactgagcggctggnaacgg

SEQ ID NO: 78369 - DNA, 574 bp, Homo sapiens
  misc_feature: GYAE6OF01B90QO.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctggaaatgaacagcctgagagccgaggacacggcctctattactgtgcgagagatcagacggagtatagcagcagctctgactacgtggggccacggaaccctggtccaccgtctcctcacgccctccaccaacgggcccatccggtccttcccccgtcggccaccctcctaccaacgacgcaccctcgtcggggccacgacgccggcccgtcgggctcgccgtcggtacgaacggacctaccttccacttcctacctactacgtcggacggccgggcgtcgggacgaaggcgcgagtacg

SEQ ID NO: 78370 - DNA, 570 bp, Homo sapiens
  misc_feature: GYAE6OF01CPTP0.37.26.C04.1.454.CMB.1.raw
  modified_base (239)..(239): a, c, t, g, unknown or other
  misc_feature (239)..(239): n is a, c, g, or t
tcagtagtgtagatcacgaccggtgctcgatttagtctagcgactttggggttttggggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccgttnaccgtctccaagagacaattccaagaatacggtctaatctggaaatgaacagcctgagagccgaggacacggcctctatactgtgcgagagatcagacggagtatagcagcagctctgactaacgtggggaccacgggaaccctgggtccaacccgtctcctcacgccctaccaccgaacgggccccatcgggttcccttccccctcggacctaccctccctccaagacgccaccgtcgtggggccacgacgccggcccgtgggccgtcgcctggtacgaaggacttactccatctactactactgacgcgggctcggacaaggcgcatag

SEQ ID NO: 78371 - DNA, 540 bp, Homo sapiens
  misc_feature: GYAE6OF01A99MB.37.26.C04.1.454.CMB.1.raw
  modified_base (537)..(537): a, c, t, g, unknown or other
  misc_feature (537)..(537): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagccctccaccaacggcccatccggtcttccccctggccaccctcctcccaacgacgcaccctctcgggggcacgacgccgggccctgggcctgcctggtcaaggactacttccatctacactactgagcgggctggcaaggcgcntag

SEQ ID NO: 78372 - DNA, 592 bp, Homo sapiens
  misc_feature: GYAE6OF01C6813.37.26.C04.1.454.CMB.1.raw
  modified_base (583)..(583): a, c, t, g, unknown or other
  misc_feature (583)..(583): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccggttcaccgtctccagagacaattccaaagaatacggtctatctaggaaatgaacagcctgagagccgaggacacggcctctattactgtgcgagagatcagacggagtatagcagcagctctgactacgtggggaccacggaaccctggtcaccgtctcctcagcctccaccgacggcccatccggtcccttccccgtggccacccctcctaccaacgacgccaccgtccgtcggggccacgacgccggcccgtcgggcctcgcccgtggtaccgaacggtaccttaccgttcctacgtacctaccgtaacctacgtggaacggccgggcgttacgggacgtaagggcgngtaagtacg

SEQ ID NO: 78373 - DNA, 555 bp, Homo sapiens
  misc_feature: GYAE6OF01BJCDX.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggcccaacggaaccctgggtccaccgtctcctcagccctccaccaacgggcccatccggtcccttcccctcggccacccctcctacccaacgacgccaccctcgtcggggccacgacgccggcccgtgggcctgccgtggtcaaggacctactccatctacactactgacgcggctggacaggcgcagtacg

SEQ ID NO: 78374 - DNA, 539 bp, Homo sapiens
  misc_feature: GYAE6OF01A7PEF.37.26.C04.1.454.CMB.1.raw
  modified_base (515)..(515): a, c, t, g, unknown or other
  misc_feature (515)..(515): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagccctccaccaacggcccatccggtcttcccccgtggccaccctccctccaacgacgccacctcgtcggggcacacgcggcccgtgggctcgcctggcaacgactacttccatctacactacngacgcggctggacaggcncngtag

SEQ ID NO: 78375 - DNA, 641 bp, Homo sapiens
  misc_feature: GYAE6OF01CWN0H.37.26.C04.1.454.CMB.1.raw
  modified_base (315)..(315): a, c, t, g, unknown or other
  misc_feature (315)..(315): n is a, c, g, or t
tcagtagtgtagatcacgaccggtgctcgatttagtctagcgactttgggtttgggggagggcttggtacagcctggggggtccctgagactctctgtgcagcctctggtttcatctttagcaactacgccatgagctgggtccgccaggctccgagggaaggggctggagtgggtctcaggtattacgtggtacgtggtaataccgtcagtactacgcagactccgtgacgggcgttcacgtctcagagacaattcaaagaatacggtctatctaggaaatgaacagcctagagacgccgaggaccacggcctntattactgtgacgagagatcgagacggatactagcagcagctcgtagacgtacgtcggggaccaacggacctggtaccaccgtctacctacacgccctaccgaccgtaacggccctagttccggtaccctttccccgttcggtccctacccgtccctaccgaacgacgtaccaccgtcggtcggggaccaccgacggacccggtcccggtcgggccgtcggccgtacggtacgaacggtaccttaccgttacctagtaccgtacaccttacgtcggtacgggtccgggtacgttacgggacgtaaccgggccgtaccgaagtacgg

SEQ ID NO: 78376 - DNA, 595 bp, Homo sapiens
  misc_feature: GYAE6OF01DNI5E.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccgttcaccgtctccagagacaattccaaagaatacggtctaatctaggaaaatgaaacagcctgagagccgaggacacggcctctattactgtgcgagagatcagacggagtatagcagcagctctgactacgtcggggacccaacggaaccctgggtaccaccgtctccctcacgccctccaccgaacggcccacgtccggttcccttcccccgtcggccctacccctccctacccaacgacgacctaccgtcgtcgggggccacgacgccgggcccgtcgggccgtcgccgttcggtaccgaacggtaccttactccactcctacactacgtcggacggcggcgtggacaggcgcgagtacg

SEQ ID NO: 78377 - DNA, 604 bp, Homo sapiens
  misc_feature: GYAE6OF01AHLTB.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtcggggccacggaaccctggtccacccggttctcctcacgccctccgaccgaacgggcccagtccggtcccttccccgtcggcccaccctccctaccaacgacgccaccgtcgtcggggccacgacggccggcccgtcgggcctcgcccgtcggtaccaacgggtaccttaccgttcccgacttccgtaacctaccttaccgtcggacggccgggtaccgtcgggtacgaagggccgcgagtacg

SEQ ID NO: 78378 - DNA, 542 bp, Homo sapiens
  misc_feature: GYAE6OF01CTJIE.37.26.C04.1.454.CMB.1.raw
  modified_base (538)..(539): a, c, t, g, unknown or other
  misc_feature (538)..(539): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacgagtatagcagcagctctgactacgtggggacacggaaccctggtcaccgtctcctcagcctccaccaacggcccatccggtccttccccctcggccacccctcctaccaaccacgccacctcgtcggggccacgacgccggcccgtgggctgcctggtcaaggactacgtccatctacactactgacgcggctggacaggcnntag

SEQ ID NO: 78379 - DNA, 535 bp, Homo sapiens
  misc_feature: GYAE6OF01BKW3H.37.26.C04.1.454.CMB.1.raw
  modified_base (520)..(520): a, c, t, g, unknown or other
  misc_feature (520)..(520): n is a, c, g, or t
  modified_base (526)..(526): a, c, t, g, unknown or other
  misc_feature (526)..(526): n is a, c, g, or t
  modified_base (528)..(535): a, c, t, g, unknown or other
  misc_feature (528)..(535): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcggactccgtgacgggccggttcaccgtctccagagacaattccaagaatacggtctatctggaaatgaacagcctgagagccgaagacacggccgtatattactgtgtagaaaggcgtaggggatggggggactacgtggggccagggaaccctggtcaccgtctcctcagcctccaccaacgggcccatcgtccttccccctggccaccctcctccaacgacgccacctcgtcggggcacgacgccggcccgtgggctcgcctggtcaaggctactccatcacactactgagcggctggcaggcncatagncnnnnnnnn

SEQ ID NO: 78380 - DNA, 606 bp, Homo sapiens
  misc_feature: GYAE6OF01D9YN2.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtcggggccaacggaaccctggtccacccgtctcctcacgccctaccaccgaaacgggccccacgtccggttcccttcccccgtcggcccacccctccctacccgaacgacgccacccgtcgtcggggccacgacgcccggcccgtcggggtcctcgcccgtggtaccgaacggtaccttaccgttcccacttcctaacctacctaacgtcgacggccgggacgtgggaccgaagggcgcgagtacg

SEQ ID NO: 78381 - DNA, 543 bp, Homo sapiens
  misc_feature: GYAE6OF01D59YC.37.26.C04.1.454.CMB.1.raw
  modified_base (521)..(521): a, c, t, g, unknown or other
  misc_feature (521)..(521): n is a, c, g, or t
  modified_base (541)..(541): a, c, t, g, unknown or other
  misc_feature (541)..(541): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccaacgggaaccctggtccaccgtctcctcagcctccaccaacggccatcggtcttcccactcggccaccctcctccaacgacgccacctcgtcgggggcacgacggccggcccgtgggctcgcctggtcgaaggactacttccatctacactacngagcgggctggacaaggcgnag

SEQ ID NO: 78382 - DNA, 586 bp, Homo sapiens
  misc_feature: GYAE6OF01A6VSJ.37.26.C04.1.454.CMB.1.raw
  modified_base (311)..(311): a, c, t, g, unknown or other
  misc_feature (311)..(311): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctntattactgtgcgagagatcagacggagtatagcagcagctctgactacgtggggccaacggaaccctggtccaccgtctcctcacgccctccgaccaacgggcccacgtccggtcccttccccgtcggcctacccctcctacccaacgacgaccaccgtcgtcggggccacgacggccggcccgtcgggtcctcgccgtcggtacgaacggtacctacttccgacttccgtactactacgtcggacggccggcgtcggacgacggcgcgagtacg

SEQ ID NO: 78383 - DNA, 584 bp, Homo sapiens
  misc_feature: GYAE6OF01D5C11.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaaagaatacggtctatctggaaatgaacagcctgagagccgaggacacggccctctattactgtgcgagagatcagacgaagtatagcagcagctctgactacgtggggccaacggaaccctggtccaccgtctcctcacgccctccaccgaacggcccagtccggtccttcccccgtcggccacccctccctccaagacgcaccgtcgtcggggcacgacgccggcccgtgggcctcgcccgtggtaccgaaacggaccttaccttcccaacttccgtaacctactacgtcggacggccgggcgtcgggacgaagggccacgagtacg

SEQ ID NO: 78384 - DNA, 587 bp, Homo sapiens
  misc_feature: GYAE6OF01DZD16.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcagctattaatgggaatggtgataccacatactacgcagactccgtgaagggccggttcaccatctccagggacaattccaagaacacactgtctctgcaaatgaacagcctgagagtcggaggacacggccttatattactgtgtgaagggacctctacgccccttatacgcagcggctggtcctggtactttgacgtacgtggggccagggaaccctggtccaccgtctcctcacgcctccgaccaacgggcccactcggtccttcccctggccgccctcgctccgaggacgcacctccgagacgaccacgacgccggcccgtgggcctcggcccgttgggtaccgaacggtaccttaccttcccaacttccctaaccgtacctacgtaggaacgccggggctacggg

SEQ ID NO: 78385 - DNA, 525 bp, Homo sapiens
  misc_feature: GYAE6OF01BVRDI.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacgagtatagcagcagctctgactactggggccacggaaccctggtcaccgtctcctcagcctcaccaaggcccatcggtcttcccctgcaccctcctccaacgagcacctctggggcacagcgccctgggctgcctggtcaaggactacttccactctacactactgagcgggcgtggcgaaggcgcagtag

SEQ ID NO: 78386 - DNA, 606 bp, Homo sapiens
  misc_feature: GYAE6OF01BCJIM.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggccaacggaaccctggtcaccgtctccctcagccctccaccaacgggcccatcggtccttccccgtggccaccctcctccaacgacgccaccctcgtcgggggccacgacggccggccccgtggggccctcggcccgttcgggtaccgaacgggtacccttaaccttcccaacttacccgtaacctacttaccgtcggaacgggcccgggtacgtcggggaccaaaggggcccgcgaagtacg

SEQ ID NO: 78387 - DNA, 535 bp, Homo sapiens
  misc_feature: GYAE6OF01AST4G.37.26.C04.1.454.CMB.1.raw
  modified_base (533)..(535): a, c, t, g, unknown or other
  misc_feature (533)..(535): n is a, c, g, or t
tcagtagtgtagatcacgaccggtgctcgatttagtctagcgactttgggtttgggggaggcttggtacagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcacgcctccaccaacgggcccagtccggtccttccccctggccaccctcctccaacgacgccacctccgtcggggccacgagccggccctgggctgcctggtcaaggctactccatcctacactacgtggagcgggctgggcaacggcgcagtgnnn

SEQ ID NO: 78388 - DNA, 625 bp, Homo sapiens
  misc_feature: GYAE6OF01DAFK0.37.26.C04.1.454.CMB.1.raw
  modified_base (357)..(357): a, c, t, g, unknown or other
  misc_feature (357)..(357): n is a, c, g, or t
  modified_base (464)..(464): a, c, t, g, unknown or other
  misc_feature (464)..(464): n is a, c, g, or t
  modified_base (620)..(620): a, c, t, g, unknown or other
  misc_feature (620)..(620): n is a, c, g, or t
tcagtagtgtagatcacgaccggtgctcgatttagtctagcgactttgggtttgggggaggacttgggtacaggcctgggggggtccctgagaactctccgtgtgcagccctctggtttcattctttagctaactacgccagtgagctgggtccgccaggctccagggaagggctggagtgggtcctcaggtattactggttacgtgggtaataccggcatactacggcagacctccgtgacgggccgttacaccgtctaccagagacaattccaagtaatacggtctatctaggaaatgaactagtccttgagagcgaggacacggcccctgtactttaccagtcgcgagagattnaggacgagtatagcgagtcgacgctctgactacgtggggaccacgggaacctggtcaccgtctcctcacgcctaccaccaacggacccacgtccggtccttccccgnggccaccctactaccagacgccaccgtcgttacggggtcacgacgaccggccctagggtctcgtccgttacggttccgtaacggtaccttaccgttccgtacgtccgtaaccgtaaccgtacgtcggacggcgggcgtcggacgaagggacgtcgngtacg

SEQ ID NO: 78389 - DNA, 722 bp, Homo sapiens
  misc_feature: GYAE6OF01BPMV0.37.26.C04.1.454.CMB.1.raw
  modified_base (216)..(216): a, c, t, g, unknown or other
  misc_feature (216)..(216): n is a, c, g, or t
  modified_base (418)..(418): a, c, t, g, unknown or other
  misc_feature (418)..(418): n is a, c, g, or t
tcagtagtgtagatcacgaccggtgctcgatttagtctagcgacttttgggtttgggggaggcttggtacgagccgtgggggtccctgagactcgtcctgtgcagcctctggtttcatcttagcaactacgccatgagctggtccgcaggcttccgagggaaggggctggtaggttcgggtctcgaggttatttaacgtggtagtggtaataccgnatactacgcaggactccggtggacgggtccgttcaccgtctccgaggacacaacttccaagtatacggtctaatcctaggaaattcgaactagcctgagacgccgaggaccaccggcccttcgtagttaccgtggtcgccggtaggaagactcgaggtacgggtagtacgtagacgaagcgtaagctacgtaggtactacgnggggaccaacggaccttggtaccacccgtcgtcccgtacgacgacccgtccgaccgtaaccggcccctacgttccggttacccgttacccccgtcggtaccctaccccgtaccctacccgtaacggacgtacctaccgttcggtacggggtaccacgacgccgggtcccgtacgggtaccgtcggacccgtacggtaccgtaacggtaccttaccgttaccgtaacgtaccgtaaccgtacgttacggtacggtacggtaccgggtacggtacggacggtaacgggccggtacggtacgtacgg

SEQ ID NO: 78390 - DNA, 649 bp, Homo sapiens
  misc_feature: GYAE6OF01EVPJ3.37.26.C04.1.454.CMB.1.raw
  modified_base (380)..(380): a, c, t, g, unknown or other
  misc_feature (380)..(380): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtggcagttatatcagatgatggaagtgttgaggagtatgcagactccgtgaagggccgattcaccatctccagagacaattccaagaacacactctatctgacaaatgaacagcctgagaactgaggacacggctgtgtatcactgtgacgaacgtaaggggttgagatgcagcgtgggagggtgtagttggttttgagtttaggnggggaccaagggacaagttcggtacaccgttctcttacgacgtccctaccgaaccgaacgggtccctaacgttcccggttaccctttccccccgtacggcccctacccccgttcccgtacccgaaacggtaccgtacctaacccgttcggtacgggggacccaaccggacggcccgggtccccgtggggtcctcgggacccgttcgggtacccgaaacgggtaccttaacccgttcccaacgttaccctaacctaccgttacgtacggg

SEQ ID NO: 78391 - DNA, 559 bp, Homo sapiens
  misc_feature: GYAE6OF01DG2QA.37.26.C04.1.454.CMB.1.raw
  modified_base (555)..(555): a, c, t, g, unknown or other
  misc_feature (555)..(555): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattacgtggtagtggtaataccgcatactacgcagactccgtgacgggccgttcaccgtctccagagacaattccaaagaataccggtctatctaggaaatagaacagcctgagagccgaggacaccggcctctattactgtgcgagagatcagacggagtatagcagcagctctgactacgtgggccacggaacctggtcaccgtctctcccccagcctccaccaacggcccatccggtccttccccgtcggaccaccctccctaccaagacgcctacctcgtcggggcacgacgccggcccgtgggctacgccgtggtacgacggtactacgtccatcctaacactactgacgtcgggctcggacaggcgcngtag

SEQ ID NO: 78392 - DNA, 569 bp, Homo sapiens
  misc_feature: GYAE6OF01BUVZV.37.26.C04.1.454.CMB.1.raw
  modified_base (565)..(565): a, c, t, g, unknown or other
  misc_feature (565)..(565): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcccctctattactgtgcgagagatcagacgagtatagcagcagctctgactactggggccacggaaccctggtcaccgtctcctcacgcctccaccaacgggcccactccggtccttcccctcggccaccctccctcccaagacgccacctcgtcgggggccacgacgccggcccgtcggggccgtcgccgtcggtccgaacggacctaccttccacttaccgtactactactcgacgcgggcgtcggacaaggcgcgngtag

SEQ ID NO: 78393 - DNA, 551 bp, Homo sapiens
  misc_feature: GYAE6OF01DCOTD.37.26.C04.1.454.CMB.1.raw
  modified_base (546)..(546): a, c, t, g, unknown or other
  misc_feature (546)..(546): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaaggcccatccggtcttccccctcggccacccctcctccaacgacgccaccttcgtcgggggccacgacgccggcccgtgggcgtcgccgtggtcaaggactaccttccatcctacacctactcgacgcgggcgtcggacaggcgnagtag

SEQ ID NO: 78394 - DNA, 571 bp, Homo sapiens
  misc_feature: GYAE6OF01C7KAC.37.26.C04.1.454.CMB.1.raw
tcagtagtgtagatcacgaccggtgctcgatttagtctagcgactttgggtttgggggaggcttggtacagcctgggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactactggggccacggaacctggtccaccgtctcctcacgccctccaccgaacggcccacgtccggtccttccccgtcggcccaccctccctccaacgacgccaccgtcgtgggggccacgacgccggcccgtcgggcctcgccgtcggtaccgaaggtaccttaccttcccactcctacacttactcggacgcgggcgtcggacaaggccgcgagtacg

SEQ ID NO: 78395 - DNA, 659 bp, Homo sapiens
  misc_feature: GYAE6OF01EUFXH.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcccctatatacgtgtcgcgagagatacgaggacggtaagtaagtagacgacgacgacgtctcgtacgtaaccgttacggccgggaacccgaacccggtaacccgttcggtacccgtacccgttcctacccgtacgaccgtccctacccaacccggaccggaccctacgtcccggttccccttcccgcgccctacccctccctaccgaacgccgacctacccgtcggtccgggcaacgacggcccggtccggcgggtcgtccgtccgtcggacgaacggtaccttaccgttcctacttaccgtaacctactacggtcgacggcgggtacgtcggacggaacggcaacgtcgtag

SEQ ID NO: 78396 - DNA, 606 bp, Homo sapiens
  misc_feature: GYAE6OF01CMARJ.37.26.C04.1.454.CMB.1.raw
  modified_base (317)..(317): a, c, t, g, unknown or other
  misc_feature (317)..(317): n is a, c, g, or t
tcagtagtgtagatcacgaccggtgctcgatttagtctagcgactttgggtttgggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattacngtgcgagagatcagacggagtatagcagcagctctgactactggggccacggaaccctggtcaccgtctcctcagcctccaccaacggcccatccggtccttccccgtcggccaccctccctaccaacgacgccacccgtcgtcggggccacgcggccggcccgtcggggcctcggcccgttcgggtaccgaaacgggtaccttaaccttcccgtaacttcccttaaccgtaccttaaccgttcggacgggccggggccgtacggggaccgaacgggccgcgaacgtag

SEQ ID NO: 78397 - DNA, 574 bp, Homo sapiens
  misc_feature: GYAE6OF01BH1XN.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcccctctattactgtgcgagagatcagacggagtatagcagcagctctgactactggggccacggaaccctggtcaccgtctcctcagccctcaccacgggcccatccggtcttccccctggccacccctccaccagacgccacctcggtcgggacacgcgccggcccgtcgggtcctcggccgtcggtaccgaacggtaccttaccttccacttaccgtacctaccgtacgtcggacggcgggcgtcggacgaggccgctaagtacg

SEQ ID NO: 78398 - DNA, 545 bp, Homo sapiens
  misc_feature: GYAE6OF01EERT4.37.26.C04.1.454.CMB.1.raw
  modified_base (517)..(517): a, c, t, g, unknown or other
  misc_feature (517)..(517): n is a, c, g, or t
tcagtagtgtagatcacgaccggtgctcgatttagtctagcgactttgggtttgggggaggctttggtacagcctggggggtccctgagactctcctgtgcagcctctggaataatctttagcaaatacgccatgatctgggtccgccaggctccagggaaggggctggagtgggtctcagccatttccggcaatggtggtggcacgcactacgcagactccgtgaagggccggttcaccgtctccagagacaattccaggaacactctatatctgcaaatgaacagcctgagagccgacgacacggccatatattattgtgcgaaagaccccaaacggtgaccacattggagtcttttgacttctggggccaagggacaacggtcaccgtctctcagcctccaccaagggcccatccggtcttccccgtggccgccctgcctccaggcgccaccctccgagagccacacgccggccctgggcctgcccgtggtccaaggcctacttccattctacnctactgacgcggactgggcaaggcgacg

SEQ ID NO: 78399 - DNA, 619 bp, Homo sapiens
  misc_feature: GYAE6OF01AD7FK.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcacgcctccaccacgggcccactcggtccttccccctggccctacccctccctacccaacgacgccacccgtcgtcgggggccacgacggccggccccgtcggggcctcggcccgttcgggtaccaacgggtaccttaccgtttcccaacttcccgttaaccctaaccttaaccgttcgggaacggcccggggtaccgtcgggaccgaaacggggccgacgagtacgg

SEQ ID NO: 78400 - DNA, 567 bp, Homo sapiens
  misc_feature: GYAE6OF01DJ07P.37.26.C04.1.454.CMB.1.raw
  modified_base (560)..(560): a, c, t, g, unknown or other
  misc_feature (560)..(560): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcctctattactgtgcgagagatcagacggatatagcagcagctctgactacgtggggccacggaaccctggtcaccgtctcctcacgccctccaccaacggcccactccggtcccttccccgtcgccaccctccctccaacgacgcaccctcgtcggggccacgacgccggcccgtcgggtcctcgccgtcggtcgaaacggtacctaccttccatcctactactactgacggcgggcgtcgggacgaaggcgngagtacg

SEQ ID NO: 78401 - DNA, 571 bp, Homo sapiens
  misc_feature: GYAE6OF01DDPS6.37.26.C04.1.454.CMB.1.raw
  modified_base (315)..(315): a, c, t, g, unknown or other
  misc_feature (315)..(315): n is a, c, g, or t
  modified_base (563)..(563): a, c, t, g, unknown or other
  misc_feature (563)..(563): n is a, c, g, or t
tcagtagtgtagatcacgaccggtgctcgatttagtctagcgacttttggggtttgggggaggcttggtacacgcctggggggtccctgagactctcctgtgcagcctctggtttcatctttagcaactacgccatgagctgggtccgccaggctccgagggaaggggctgggagtgggtctcaggtattactggtagtggtaataccgcatactacgcagactccgtgacgggccgttcaccgtctccagagacaattccaagaatacggtctatctggaaatgaacagcctgagagccgaggacacggccctntattactgtgcgagagatcagacggatatagcagcagctcagactacgtcggggaccaacggaacctggtccaccgtctcctcacgcctccaccgacggcccagtccggtccttccccgtggcctaccctcctccaagcgccacctcgtcgggcacgcgccggccgtcgggctcgcctcggtaccaacggtacctaccgttcccaagttcctactacctacgtcgacggcgggctcggacaagggccncgagtacg

SEQ ID NO: 78402 - DNA, 616 bp, Homo sapiens
  misc_feature: GYAE6OF01DOL7N.37.26.C04.1.454.CMB.1.raw
  modified_base (331)..(331): a, c, t, g, unknown or other
  misc_feature (331)..(331): n is a, c, g, or t
tcagtagtgtagatcacgaccggtgctcgatttagtctagcgactttgggttgggggaggcttggtacagcctggggggtccctgagactctcctgtgcacgcctctggttccatctttagcaactacgccatgagctgggtccgccaggctccgagggaaggggctgggacgtggggtactcaggtattacctgggtagtggtaataccgcatactacgcgagactccggtgacgggccggttcaccgtctcagagacattccaagaatacgtctatctaggaaatgaacagcctagagacgccgaggacaccggccctcgtacttacgnggtcgcgagagtatcgaggacggtagtatagcagcagctctagaactacgtggggaccacgggaaccctgggtaccaccgtctcctacacgcctaccgaaccgacggcccgtacgtccggttccctccccgtacgacctacccctcctaccgaacgtcgacctacccgtcgtcggggcacgcggcggcccgtgggcctcgtccgtcggtcgaacggtacctaccgtccagtaccgtacaactacgtcggacggtccgggtcgtcgggacgaaggcgcacgtacgg

SEQ ID NO: 78403 - DNA, 582 bp, Homo sapiens
  misc_feature: GYAE6OF01DAYW1.37.26.C04.1.454.CMB.1.raw
  modified_base (353)..(353): a, c, t, g, unknown or other
  misc_feature (353)..(353): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggaccacggccctctattactgtgcgagagatcgagacggagtatagcagcagctntgactacgtgggccacggaaccctggtccaccgtctcctcacgccctccaccgaacgggccctacgtccggttcccttcccccgtcggcccacccctcctacccaacgacgccaccgtcggtcggggccacgacgccggcccgtgggcctcgtcctcggtactaacggtacttaccgttccactcctactactacgtcgacggcggcgtcggacgaacggcgcagtacg

SEQ ID NO: 78404 - DNA, 585 bp, Homo sapiens
  misc_feature: GYAE6OF01A12MB.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacgggaaccctggtccaccgtctcctcacgccctccaccaacgggcccacgtccggtccttcccccgtcggcccacccctccctcccaacgacgccaccgtcgtcggggccacgacgccggcccgtcgggccgtcgccgtcggtacgaacggtaccttacttccctactaccgtaactacctacgtgacggccgggcgtcggacgaaggcgcgagtag

SEQ ID NO: 78405 - DNA, 546 bp, Homo sapiens
  misc_feature: GYAE6OF01ASFL0.37.26.C04.1.454.CMB.1.raw
  modified_base (522)..(522): a, c, t, g, unknown or other
  misc_feature (522)..(522): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggcccacggaaccctgggtccaccgtctcctcacgcctccaccaacgggcccactcggtccttccccctggccaccctcctccaacgacgcacctcgtggggccacacgccggccctgggcctggcctggtcaacggactacgttccatctacactacngagcggctcggcaaggcgngntag

SEQ ID NO: 78406 - DNA, 555 bp, Homo sapiens
  misc_feature: GYAE6OF01D316Q.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggcccctctatttactgtgcgagagatcagacggagtatagcagcagctctgactacgtgggggccaacggaaccctggtccaccgtctcctcacgcctccaccaacggcccatccggtccttcccctggccaccctccctccaagacgccacctcgtggggccacacgccggcccgtgggcctcgccgttggtcaaggctacttccatctacactacgtgacggcgggctcggacgaaggcgcgagtag

SEQ ID NO: 78407 - DNA, 576 bp, Homo sapiens
  misc_feature: GYAE6OF01DZZA7.37.26.C04.1.454.CMB.1.raw
  modified_base (319)..(319): a, c, t, g, unknown or other
  misc_feature (319)..(319): n is a, c, g, or t
  modified_base (569)..(569): a, c, t, g, unknown or other
  misc_feature (569)..(569): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctaggaaatgaacagcctgagagccgaggacacggccctctattacngtgcgagagatcagacggagtatagcagcagctctgactacgtggggccaacggaaccctggtccaccgtctcctcacgcctaccaccgacgggcccatccggtccttccccctggccacccctcctccaacgacgcaccgtcgtcggggccacgacggccggcccgtcgggctcggccttgggtacaacgggtaccttaccttccatccgtaactactactggacggcgggacgtcggacgaaggccgngagtacg

SEQ ID NO: 78408 - DNA, 596 bp, Homo sapiens
  misc_feature: GYAE6OF01AJ2GF.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcctctattactgtgcgagagatcagacggatatagcagcagctctgactacgtgggccacggaccctggtcaccgtctcctcacgccctccaccgaacggcccagtccggtcccttccccgtcggccacccctccctacccaacgacgccaccgtcgtcggggccacgacgccgggcccgtggggcctcggtccgttcggtaccgaacgggtaccttaccttcccaacttcccgtaacctacttaccgtcggacggtccgggtcgtcgggacgaagggccgcgtagtacg

SEQ ID NO: 78409 - DNA, 609 bp, Homo sapiens
  misc_feature: GYAE6OF01CAIMY.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggagtatagcagcagctcgtgactacgtcggggaccaaccgggaaccctggtccacccgtctccctcacgccctcccaccgaacgggcccacttccgggtccctttcccccgtcggccctacccctccctacccaacgacgcccacccgtcggtcgggggccaccgacggcccgggcccgtcggggcctcgcccgttgggtacgaacggtaccttaccttcccaattcctaactacctacgtgacggccgggctcggacgaaggcgcgagtag

SEQ ID NO: 78410 - DNA, 174 bp, Homo sapiens; identical to SEQ ID NO: 78297
  misc_feature: GYAE6OF01BEKVS.37.26.C04.1.454.CMB.1.raw
  modified_base (173)..(174): a, c, t, g, unknown or other
  misc_feature (173)..(174): n is a, c, g, or t

SEQ ID NO: 78411 - DNA, 586 bp, Homo sapiens
  misc_feature: GYAE6OF01CZ4UZ.37.26.C04.1.454.CMB.1.raw
  modified_base (353)..(353): a, c, t, g, unknown or other
  misc_feature (353)..(353): n is a, c, g, or t
  modified_base (578)..(578): a, c, t, g, unknown or other
  misc_feature (578)..(578): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctaggaaatgaacagcctgagagccgaggacacggccctctattactgtgcgagagatcagacggagtatagcagcagctntgactcgtggggaccacggaaccctggtccaccgtcctcctcacgcctaccaccgaacgggcccacgtccggtccctttcccccgtggccctacccctccctaccaaacggacgaccctacccgtcggtcggggccacgacggccggtcccgtgggcctcgccgttaggaccaacggacttacctccatacctacgactacgtgacggcggcgtcggacgaggcncgagtacg

SEQ ID NO: 78412 - DNA, 172 bp, Homo sapiens
  misc_feature: GYAE6OF01DA7S4.37.26.C04.1.454.CMB.1.raw
tcagtagtgtagatcacgaccggtgctcgatttagtctagcgactttgggtttgggggaagaggaagactgacggtcccccaggagttcaggtgctgggcacagcggccctgggctgcctggtcaaggactacttccatctacactactgagcgggctggcaaggcgcatag

SEQ ID NO: 78413 - DNA, 554 bp, Homo sapiens
  misc_feature: GYAE6OF01D66FN.37.26.C04.1.454.CMB.1.raw
  modified_base (430)..(430): a, c, t, g, unknown or other
  misc_feature (430)..(430): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactactggggccaacgggaaccctggtcaccgtctcctcagccctccaccgaacgggcccactcggtcctttccccncggccacccctccctccgaacgacgcacccgtcgtcgggggcacgacggcggcccgtcgggctcgcctggtcaacggactacttccatctacactactgacgcggcgtcggacaggcgcagtag

SEQ ID NO: 78414 - DNA, 556 bp, Homo sapiens
  misc_feature: GYAE6OF01CQALK.37.26.C04.1.454.CMB.1.raw
  modified_base (551)..(551): a, c, t, g, unknown or other
  misc_feature (551)..(551): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagatacggtctatctggaaatgaacagcctgagagccgaggacacggccctctattactgtgcgagagatcagacggagtatagcagcagctctgactactggggccacggaaccctggtcaccgtctcctcacgcctccaccaacggcccatccggtccttccccctcggccaccctccctccaacgacgccaccctcgtcgggggccacgacgccggccccgtgggcctgcccgtgggtccaacggtacctacttccatcctaccactactgacgcgggctcggacaggcgnagtag

SEQ ID NO: 78415 - DNA, 667 bp, Homo sapiens
  misc_feature: GYAE6OF01DCNQ7.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctggaaatgaacagcctgagagccgaggacacggccctctattactgtgcgagagatcagacggagtatagcagcagctctgacgtacgtcggggacccacggaacccgtggtcccaccggttcctccctcaacgtccctacccgaccgaacgggcccctacgtccgggtcccctttcccccgtacggtccctacccctcccgtacccaaacgaccgacccaacccgtccgtcgggggaccaccgaccggcccgggtccccgtcggggtcccgtcggccgttacgggtacgaaaccgggtaccttaccgttaccctacttacccgttaacctaaccttaacggtcgggaaccggtccggggaccgttcgggacgaaccgggccgtacgagtaacg

SEQ ID NO: 78416 - DNA, 625 bp, Homo sapiens
  misc_feature: GYAE6OF01CFG9Y.37.26.C04.1.454.CMB.1.raw
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (322)..(322): a, c, t, g, unknown or other
  misc_feature (322)..(322): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattacgtggtagtggtaataccgcatactacgcagactccgtgacgggccgttcaccgtctccagagacaattccaagaatacggtctatctaggaaatagaacagcctagagacgcgaggacacggcctntatcngtncgagagatcagacggagtatagcagcagctctgactacgtcgggaccacggaccctggccaccgtctcctcacgcctccgaccgacggcccacgtccggttacctccccgtcggaccctacccctccctaccaacgacgaccacccgtcggtcggggaccacggacgcccggcccgtcgggtccgtcggccgtacggtaccgaaacggtaccttaccgttaccctacgttacccttaccgtaacccgttaccgtacggtacgggccgggtaccgtcgggaaccgaagggaccgtcgacggtag

SEQ ID NO: 78417 - DNA, 582 bp, Homo sapiens
  misc_feature: GYAE6OF01AQUDH.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaccctggtcaccgtctcctcacgcctccaccaacgggcccagtccggttccttcccccgtcggcccacccctccctaccaacgacgccacccgtcgtcgggggccacgacgcccggcccgtcggggccttcgccgtcgggtcgaaacggaccttaccttccactcctacctactacgtcgacggcgggctcgggacgaagggcgccagtacg

SEQ ID NO: 78418 - DNA, 535 bp, Homo sapiens
  misc_feature: GYAE6OF01BDN9Z.37.26.C04.1.454.CMB.1.raw
  modified_base (530)..(530): a, c, t, g, unknown or other
  misc_feature (530)..(530): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacacagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctcaccaacgggcccatcggtcttccccctcggccaccctcctccaagacgcacctctcgggggcacgacgcggcccgtgggcctgcctggtcaaggactacgttccatctacatactgacgcggctggcaaggcncatag

SEQ ID NO: 78419 - DNA, 553 bp, Homo sapiens
  misc_feature: GYAE6OF01CZ69L.37.26.C04.1.454.CMB.1.raw
  modified_base (353)..(353): a, c, t, g, unknown or other
  misc_feature (353)..(353): n is a, c, g, or t
  modified_base (429)..(429): a, c, t, g, unknown or other
  misc_feature (429)..(429): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaagggctggagtgggtctcaggtattactggtagtggtaataccgcatactacgcagactccgtgacgggccgttcaccgtctccagagacaattccaagaatacggtctatctaggaaatgaacagcctagagagccgaggacacggccctctatactgtgcgagagatcaagacggagtatagcagcagctntgactacgtggggaccaccggaacctggtcaccgtctctcacgcctccacgaacggcccagtccgtccttccccgnggcccaccctcctccaacgcgaccacctcgtcggggcacgagccggcccgtggctgccgtggccgaaggtcttacctcctatccgtacactactcgacggcggcgtcggacgaggcgcagtacg

SEQ ID NO: 78420 - DNA, 616 bp, Homo sapiens
  misc_feature: GYAE6OF01C61BT.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggcctctattactgtgcgagagatcagacggagtatagcagcagctctagactacgtggggacccaacggaaccctgggtaccacccggtctccctcacgccctccaccgaacgggcccacgtccggtcccttcccccgtcggcccaccctccctaccaacgacgccaccctcgtcggggccacgacggccggcccgtcgggccgtcgcccgtacggtaccgaaacggtaccttaccttacccgtaacttccgtaacctaccgttaaccgtcggaacggccgggacgtcgggacgaagggccgtacgagtacg

SEQ ID NO: 78421 - DNA, 609 bp, Homo sapiens
  misc_feature: GYAE6OF01C5G6U.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggccaacggaaccctggtacaccgtctcctcacgccctccaccgaacggccctacgtccggtccttcccccgtcggccctaccccgtccctacccgaacgtacgcctacccgtcgtcgggggaccacgacggccggcccgtacggggtccgtcgcccgtggtaccgaacggtaccttaccttcccgactaccgtaccaccttacgtcggaacggccgggtcgtcgggaccaagggtccgctagtacg

SEQ ID NO: 78422 - DNA, 559 bp, Homo sapiens
  misc_feature: GYAE6OF01CNFH4.37.26.C04.1.454.CMB.1.raw
  modified_base (554)..(554): a, c, t, g, unknown or other
  misc_feature (554)..(554): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgccctccaccaacgggcccagtccggtcccttcccccgtcggcccacccctcctaccgaacgacgccaccctcgtcggggcaccgacgccggcccgtgggctcgccgtggtcaacggcctacttccatcctacactacgtgacgcggctggacaggcgngatag

SEQ ID NO: 78423 - DNA, 735 bp, Homo sapiens
  misc_feature: GYAE6OF01CN8SC.37.26.C04.1.454.CMB.1.raw
  modified_base (362)..(362): a, c, t, g, unknown or other
  misc_feature (362)..(362): n is a, c, g, or t
  modified_base (725)..(725): a, c, t, g, unknown or other
  misc_feature (725)..(725): n is a, c, g, or t
tcagtagtgtagatcacgaccggtgctcgatttagtctagcgactttgggtttgggggtaggcttaggtacagcctgggggtccctgaagactcctcgtgtgcagcctctggtttcatctttagcaactacgccgatgagtcgtgggtccgccaggctccgagggaagggctggagtgggtcctcgaggtattacgtggtagtaggtaataccggctagtacgtacggcagactccggtgacgggtccggtcgaccgtctcgagagactatccgaaagactacgtcatctaggaatgaacagtcgtgagagccgagacgacggcctctagtactggtgcgagagtatcgaagacggtagtanacgacgaagcagctagtacgtaaccgtacggtcggggacccctaaccggaacccgttgggtacccacccggttaccttaccctaacgaaccgtacccgtacccgaaccgtaaccgggcccctacgtcccggttacccttacccccggtacggtacccctacccctacccgtacccgaaagtacccgaccgtaccggtaccggtacggggacctaaccgaaccggtcccggtcccggtacgggtaccgttacggtacccgttacgggtacctaaacggtaccttaaccgttcccgtaacttacccgttaaccgtaaccgttaccgtacggtacggtccgggtacgtacgggacgaacgggtccncgtacgtacg

SEQ ID NO: 78424 - DNA, 575 bp, Homo sapiens
  misc_feature: GYAE6OF01BGOJ6.37.26.C04.1.454.CMB.1.raw
  modified_base (567)..(567): a, c, t, g, unknown or other
  misc_feature (567)..(567): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaccctggtccaccgtctcctcacgccctaccaccgaacgggccccacgtccggtcccttcccccgtggcccacccctcctcccaagacgccaccgtcgtcggggccacgacggccggcccgtggggcctcgccgtggtaccaacggtacctacttccacttcctacactacgtcggacgcgggctcggacaaggcncgagtacg

SEQ ID NO: 78425 - DNA, 575 bp, Homo sapiens
  misc_feature: GYAE6OF01EJT8A.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggccaacgggaaccctggtccaccgtctcctcacgccctccaccaacggccacgtccggtcccttccccgtggccacccctcctaccaacgacgccaccgtcgtcggggccacgacgccggcccgtgggccgtcgccgtcggtaccaacggctaccttccacttaccgtaacctactacgtcggacggcgggcgtcggacgaaggcgcagtag

SEQ ID NO: 78426 - DNA, 593 bp, Homo sapiens
  misc_feature: GYAE6OF01DRRND.37.26.C04.1.454.CMB.1.raw
  modified_base (584)..(585): a, c, t, g, unknown or other
  misc_feature (584)..(585): n is a, c, g, or t
  modified_base (588)..(593): a, c, t, g, unknown or other
  misc_feature (588)..(593): n is a, c, g, or t
tcagtagtgtagatcacgaccggtgctcgatttagtctagcgacttttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaacacgctctatctgcaaatgaacagcctgagagccgaagacacggccgtatattactgtgtaggaaaggcgtggggagtggggggactacgtggggccagggaaccctggtcaccgttctcctcacgccctaccaaccgaacgggcccaagttccggtccctttcccccgtggccctacccctcctccaacgacgccaccgtcgcggggcacgcggccgcccgtgggctcgccgtggtacgaacggtaccttaccgttccacttcctaacaccgttacgacggacgccgggcgtacgggacgtaacgggcgacgtagtacgnnacnnnnnn

SEQ ID NO: 78427 - DNA, 598 bp, Homo sapiens
  misc_feature: GYAE6OF01BAGK2.37.26.C04.1.454.CMB.1.raw
  modified_base (145)..(145): a, c, t, g, unknown or other
  misc_feature (145)..(145): n is a, c, g, or t
  modified_base (463)..(463): a, c, t, g, unknown or other
  misc_feature (463)..(463): n is a, c, g, or t
tcagtagtgtagatcacgaccggtgctcgatttagtctagcgactttgggtttgggggaggcttgatacagcctggggggtccctgagactctcctgtgcagcctctggtttcatctttagcaactacgccatgagctgggtccnccaggctccgagggaaggggctggagtgggtctcaggtattactggtagtggtaataccgcatactacgcagactccgtgacgggccggttcaccgtctccagagacaattccaagaatacggtctaatctaggaaatgaacagcctgagagccgaggacacggccctctattactgtgcgagagatcgagacggagtatagcagcagctctgactacgtgggccaacggaaccctggtccaccgtctcctcacgcctaccaccgaacggcccacgtccggtccttccccgtcggccacccctcctaccgaacgtacnccgaccgtcgtcggggccacgtacggccggccgtcgggcctcgtcccgtcggtaccgaacggtaccttaccgtacctacgtcctaaccaccttacgcggtacggccgggtcgtacggacgaacggtcgcgtaacg

SEQ ID NO: 78428 - DNA, 569 bp, Homo sapiens
  misc_feature: GYAE6OF01E4RKR.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggatatagcagcagctctgactacgtcggggccacgggaaccctggtacaccgtctcctcacgccctccaccgaacgggcccacgtccggtcccttcccccgtcggccacccctccctccaaagacgccaccgtcgtcgggggccacgacggccggcccgtggggcctcgcctcggacgaacggactactccatcctacactacgtgacgcgggcgtcggacgaaggcgcagtag

SEQ ID NO: 78429 - DNA, 550 bp, Homo sapiens
  misc_feature: GYAE6OF01BXYH7.37.26.C04.1.454.CMB.1.raw
  modified_base (545)..(546): a, c, t, g, unknown or other
  misc_feature (545)..(546): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtccaccgtctcctcagccctccaccaacgggcccatccggtccttccccctcggccacccctcctccaacgacgccaccctcgtcgggggccacgacgccggcccgtgggcctcgccgtggtcaaggactacttccatctacactactgagcgggctggcaaggcgnngtag

SEQ ID NO: 78430 - DNA, 593 bp, Homo sapiens
  misc_feature: GYAE6OF01AI080.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcccctctattactgtgcgagagatcagacggagtatagcagcagctctgactactggggccacggaacctggtccaccgtctcctcacgcctccaccaacgggcccactcggtccttcccctggccacccctcctacccaagacgccaccgtcgtggggccacgacggccggcccgtggggccttcggcccttcgggtaccaaacgggtaccttaccttcccattaccgtaccaccttaacgtcggacgggccgggtacgttcgggaccaaagggccgcgaatacgg

SEQ ID NO: 78431 - DNA, 603 bp, Homo sapiens
  misc_feature: GYAE6OF01AUYP4.37.26.C04.1.454.CMB.1.raw
tcagtagtgtagatcacgaccggtgctcgatttagtctagcgactttgggtttggggaggcttggtacagcctgggggtccctgagactctcctgtgcagcctctggtttcatctttagcaactacgccatcgagctcgggtccgccaggctccagggaagggctggagtgggtctcaggtattactggtagtggtaataccgcatactacgcagactccggtgacgggccggttcaccgtctccagagacaattccaagaatacggtctatctggaaatgaacagcctgagagccgaggacacggccctctatttactgtgcgagtagatcagacggatatagcagcagctctgactactggggaccacgggaaccctgggtaccaccgtctcctcagccctccaccaacgggcccagtccggtccttcccctcggtccaccctccctccaacgacgccacctcgtcggggcacgacgccggcccgtcgggcctcgaccttcggtaccaacgggaccttaaccgttcccaacttccgtaacccgtaaccttaaccgttcggacggcgggaccgttacggacgaaagggccgacacgtaacgg

SEQ ID NO: 78432 - DNA, 580 bp, Homo sapiens
  misc_feature: GYAE6OF01CWWV1.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgctttagactccgtgacgggccggttcaccgtctccagagacaattccaagaatacggtctatctggaaatgaacagcctgagagccgaggacactgccctctattactgtgcgagagatcagacggagtatagcagcagctctgactacgtggggccacggaaccctggtacaccgtctcctcacgcctccacccaacgggcccacgtccggtccttcccctcggccaccctccctccaacgacgaccacctcgtcggggcaccgacgccggcccgtcgggcctcgcccgtcggtacgaacggtacctaccttcccgacgtcctactacttacgtacggacgcgggtctcggacgaacggcgcgtacg

SEQ ID NO: 78433 - DNA, 562 bp, Homo sapiens
  misc_feature: GYAE6OF01DHBJW.37.26.C04.1.454.CMB.1.raw
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaagaatacggtctatctggaaatgaacagcctgagagccgaggacacggccctntattactgtgcgagagatcagacggatatagcagcagctcngactacgtgggccacggaacctggccaccgtctcctcacgcctaccaccgaacggcccactccggtcccttccccgtcggccctaccctccctccaacgacgcctacccgtcgtcgggcacgacgccggcccgtgggcgtcgccgtggtacaacggtacttacgtcctatcctaccactacgtgacggcggcgtcggacgaggcgcagtacg

SEQ ID NO: 78434 - DNA, 578 bp, Homo sapiens
  misc_feature: GYAE6OF01BVNGH.37.26.C04.1.454.CMB.1.raw
  modified_base (394)..(394): a, c, t, g, unknown or other
  misc_feature (394)..(394): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggcccaacggaaccctggtccaccgtctcctnacgcctccaccaacgggcccatcggtccttccccgtgccacccctcctccaagcgccacctcgtcggggccacgcgccggcccgtgggtcctcggcccgtggtaccgaacgggaccttacttcccactccgtacctacctacgtcggacgtccggggcgttcgggacgtaagggcgcgagtacg

SEQ ID NO: 78435 - DNA, 543 bp, Homo sapiens
  misc_feature: GYAE6OF01DUFIB.37.26.C04.1.454.CMB.1.raw
  modified_base (311)..(311): a, c, t, g, unknown or other
  misc_feature (311)..(311): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctntattactgtgcgagagatcagacggagtatagcagcagctctgactacgtggggccacggaaccctggtccaccgtctcctcacgcctccaccaacggcccagtccgtccttcccctcggccaccctcctccaacgacgccacctcgtggggcacgacgccggcccgtgggctcgccgtggtcaacggactacttccatctacactactgagcggctggacaggcgngntag

SEQ ID NO: 78436 - DNA, 548 bp, Homo sapiens
  misc_feature: GYAE6OF01BRECG.37.26.C04.1.454.CMB.1.raw
  modified_base (541)..(541): a, c, t, g, unknown or other
  misc_feature (541)..(541): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctccctcacgcctccaccaacgggcccacgtccggtccttcccctcggccacccctcctccaacgacgccacctcgtggggccacgacgcggcccgtgggctcggccgtggtcaaggactactccatctacactactgacgcgggctggcaaggcncgatacg

SEQ ID NO: 78437 - DNA, 560 bp, Homo sapiens
  misc_feature: GYAE6OF01BIDM2.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggagtatagcaagcagctctgactacgtcggggccacgggaaccctggtccaccgtctcctcacgcctccaccgaacgggcccatccggtccttcccccgtcggccctaccctcctccaacgacgccacctcgcggggcacacgccggcccgtgggcctcgccgtggtcaacggacctacttccactctacactactcgacgcggcgtcggacaggcgctagtcg

SEQ ID NO: 78438 - DNA, 615 bp, Homo sapiens
  misc_feature: GYAE6OF01CCX7A.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtcggggccacggaaccctggtcaccgtctcctcacgccctaccaccgaacgggcccacgtccggtcccttccccgtcggcccaccctccctaccgaacgacgccaccgtcgtcggggaccacgacggccggcccgtcgggccgtcgcccgttggtaccaaacgggtaccttaaccgttcccaacgttccctaaccgtaaccttaacgtcggaacggtccggggcgtacgggacgaaacgggccgacgtagtaacgg

SEQ ID NO: 78439 - DNA, 606 bp, Homo sapiens
  misc_feature: GYAE6OF01DUZOF.37.26.C04.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
  modified_base (303)..(303): a, c, t, g, unknown or other
  misc_feature (303)..(303): n is a, c, g, or t
  modified_base (310)..(310): a, c, t, g, unknown or other
  misc_feature (310)..(310): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaagggctggagtgggtctcaggtattactggtagtggtaaatccgnatactacgcagactccgtgacgggccgttcaccgtcnccagagacaattccaaagatacggtctatctaggaaatgaacagcctgagagccgaggacncggcctntattactgtgcgagagatcagacggatatagcagcagctgtcgactacgtggggcccaaccgggaaccctggtccaccgtctccgtcgacgccctacccgaacccgtaaccgggccctaacgttccggttccccttcccccgtcggccctacccctccctacccaacgacgcccgacctcggtcggggccacgaccggccggcccgtcgggcctcgccgtcgtacgaacggtaccttaccgttccattccgtacacctacgtcggacggccggcgtacggacgacggcgngngtag

SEQ ID NO: 78440 - DNA, 565 bp, Homo sapiens
  misc_feature: GYAE6OF01AD33U.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgcctccaccaacgggcccagtccggtccttcccccgtcggccacccctcctacccaacgacgccacctcgtggggccacgacggccggcccgtggggctcggcctggtacaacggactacttccatcctaaccactacgtcgacggcggcgtgggcaaggccgcagtacg

SEQ ID NO: 78441 - DNA, 541 bp, Homo sapiens
  misc_feature: GYAE6OF01BVXED.37.26.C04.1.454.CMB.1.raw
  modified_base (523)..(523): a, c, t, g, unknown or other
  misc_feature (523)..(523): n is a, c, g, or t
  modified_base (532)..(532): a, c, t, g, unknown or other
  misc_feature (532)..(532): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagggacaattccaagaacacactgtctctgcaaatgaacagcctgagagtcgaggacacggccttatattactgtgtgaagggacctctagccccttatagcagcgctggtcctggtactttgacgactggggccagggaaccctggtcaccgtctcctcagcctccaccaagggcccatcggtcttcccctggccgccctgcctccaggacgcacctccgagacgcacacgcggcccgtgggctcgcctggtcaggactacttccatctacactacncgacgcggncggcaggcg

SEQ ID NO: 78442 - DNA, 668 bp, Homo sapiens
  misc_feature: GYAE6OF01CA3EB.37.26.C04.1.454.CMB.1.raw
  modified_base (254)..(254): a, c, t, g, unknown or other
  misc_feature (254)..(254): n is a, c, g, or t
  modified_base (308)..(308): a, c, t, g, unknown or other
  misc_feature (308)..(308): n is a, c, g, or t
  modified_base (343)..(343): a, c, t, g, unknown or other
  misc_feature (343)..(343): n is a, c, g, or t
  modified_base (420)..(420): a, c, t, g, unknown or other
  misc_feature (420)..(420): n is a, c, g, or t
  modified_base (543)..(543): a, c, t, g, unknown or other
  misc_feature (543)..(543): n is a, c, g, or t
tcagtagtgtagatcacgaccggtgctcgatttagtctagcgactttggggtttggggggaggcttggtacagccgtggggggtccctgagactctcctgtgcagcctctggttcatctttagcaactacgccatgagctgggtccgccaggcctccgagggaaggggctggaggtgggtctcaggtattacgtggtagtggtaataccgcaatactacgcagactccggtgaccggggccgttcacccgttcnccaagagaactaattccgaaagaataccggtcaatctaggaaatgaacagtccngagagccgaagacacggcctctattactgtgcganagatcgagtacgatataggcagctagctctagactacgtggggccaacgggaaccctgggtaccaccggtctacctnacgcctaccaccgaaacgggccctaacgtccgggttccttaccccgtcggtacctacccctcctaccgaagaccgacctaccctcggtacggggacacgtaacggccggtcccgtgggtaccncgtcccgttacgggtaccgtaaacggtaccttaaccgttaccctaacttacccttaaccgtaaccttaaccgtcggtaaacgggccgggaccgttacgggaacggaacggacggacctagtaagg

SEQ ID NO: 78443 - DNA, 529 bp, Homo sapiens
  misc_feature: GYAE6OF01BKILW.37.26.C04.1.454.CMB.1.raw
  modified_base (450)..(450): a, c, t, g, unknown or other
  misc_feature (450)..(450): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
  modified_base (520)..(520): a, c, t, g, unknown or other
  misc_feature (520)..(520): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcccctatatactgtacgaaaatggcctacggatatgactactattgggactggtacttcgatctctggggccgtggcaccctggtcactgtctcctcagcctccaccaagggcccatcgtcttcccctgcgccctgctccaggngcaccctccgagancacngccggccctgggctgcctggcaaggctactccatctacactactgacgcggntggcaggcg

SEQ ID NO: 78444 - DNA, 579 bp, Homo sapiens
  misc_feature: GYAE6OF01BE13V.37.26.C04.1.454.CMB.1.raw
  modified_base (572)..(572): a, c, t, g, unknown or other
  misc_feature (572)..(572): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccggtgacggggccgttcaccgtctccagagacaattccaagaatacggtctatctggaaatgaacagcctgagagccgaggacacggccctctattactgtgcgagagatcgagacggagtatagcagcagctctgactacgtggggcccacgggaaccctggtaccaccgtctcctcacgccctccaccgaacgggcccacgtccggtacccttcccccgtcggcccacccctcctaccaacgcgccacctcgtcggggccacgacgccggcccgtgggccgtcgccgtcggcaacggtacctacctcctactactacctactacgtcgacggcggcgtcggacgaaggcngagtacg

SEQ ID NO: 78445 - DNA, 578 bp, Homo sapiens
  misc_feature: GYAE6OF01A2I1P.37.26.C04.1.454.CMB.1.raw
  modified_base (317)..(317): a, c, t, g, unknown or other
  misc_feature (317)..(317): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaagggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattacngtgcgagagatcaaggacggagtatagcagcagtctctgactacgtgggccactcgaaccctggtccaccggtcctctccgacgcctccaccgacgggcccagtccggtccttccccgtcggccctacccctcctaccaacgacgccaccctcgtcggggcaccgacggcccggcccgtgggccttcggccgtcggtacgaacggaccttaccttccacgtcctacactactgacggcgggtcgcggacgaacggcgctag

SEQ ID NO: 78446 - DNA, 539 bp, Homo sapiens
  misc_feature: GYAE6OF01CCO0F.37.26.C04.1.454.CMB.1.raw
  modified_base (398)..(398): a, c, t, g, unknown or other
  misc_feature (398)..(398): n is a, c, g, or t
  modified_base (512)..(512): a, c, t, g, unknown or other
  misc_feature (512)..(512): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaacaacacgctgtctctgcaacttaacagcctgagagacgaggacacggccgtatattactgtgcgaaggaagggtctagcagtgcctggtactcccactactatatggacgtctggggcaaaggaatcgcggtcaccgtntcctcagcctccaccaaggcccatcgtcttcccctggcaccctcctccaacgagccacctctggggccacacgcggccctgggctgcctggtcaacggactactccgatctacnctactgacgcgggctggcaaggcgacg

SEQ ID NO: 78447 - DNA, 579 bp, Homo sapiens
  misc_feature: GYAE6OF01BDHWZ.37.26.C04.1.454.CMB.1.raw
  modified_base (351)..(351): a, c, t, g, unknown or other
  misc_feature (351)..(351): n is a, c, g, or t
  modified_base (574)..(574): a, c, t, g, unknown or other
  misc_feature (574)..(574): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctntgactacgtggggccacggaaccctggtccaccgtctccctcacgccctccaccaacgggcccacgtccggtccttcccccgtggccaccccgtcctccaacgacgccaccctcgtcggggccacgacgccggcccgtcggggcctcgccgtcggtacaacggtacctacttcccgactccgtactacctacgtggacggcgggcgtcgggacaagggcgcgngtacg

SEQ ID NO: 78448 - DNA, 630 bp, Homo sapiens
  misc_feature: GYAE6OF01B6B78.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaagggctggagtgggtctcgaggtattactggtagtggtaataccgcatactacgcagactccggtgacgggccggttcaccgtctccagagacaattccaaagaatacggtctatctggaaatgaacagcctgagagccgaggacacggcctctattactgtgcgaagagatcagacggagtatagcagcagctctagactacgtggggcccaacgggaaccctggtaccaccgtctccctcacgccctccaccgacggcccacgttccggtcccttccccgtcggccctaccctccctaccgaacgaccgcctaccgtcggtcggggaccacggacggccggccccgtcggggtccgtcggccgttacgggtaccgaaacggtaccttaaccgttccctacttacccgtaaccgtaccttacgtcggaacggtccgggacgttcgggacgaacgggcgtacgagtacg

SEQ ID NO: 78449 - DNA, 605 bp, Homo sapiens
  misc_feature: GYAE6OF01BVXLS.37.26.C04.1.454.CMB.1.raw
  modified_base (601)..(605): a, c, t, g, unknown or other
  misc_feature (601)..(605): n is a, c, g, or t
tcagtagtgtagatcacgaccggtgctcgatttagtctagcgactttgggtttgggggaggcttggtacagcctggggggtccctgagactctcctgtgcagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaacctccgtgcatctgacaaatgaacagtctgagagccgaggacacggcttatttattactgcgcgagagaaggactggggcggtttcgactacgtggggccagggaccctggtccaccgtctcctcacgcctcccacgaacggccccagtccggtcccttcccccgtggcccgccctcgcctcccgacggacgccacccgtccgagacgcaccgacggcccgggcccgtcggggcctcggcccgttcgggtacgaacgggtaccttaccgttcccacttacctaaccgtaccttacgtcggacggccgggtcgtacgggccgaacgggccgactagtagnnnnn

SEQ ID NO: 78450 - DNA, 552 bp, Homo sapiens
  misc_feature: GYAE6OF01BATQ7.37.26.C04.1.454.CMB.1.raw
  modified_base (532)..(532): a, c, t, g, unknown or other
  misc_feature (532)..(532): n is a, c, g, or t
  modified_base (541)..(541): a, c, t, g, unknown or other
  misc_feature (541)..(541): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaacaccctgtctctgcaaatgaacaacctgagagccgaggacacggccctatattactgtacgaaaatggcctacggatatgactactattgggactggtacttcgatctctggggccgtggccaccctggtcactgtcctcctcagcctccaccaagggccccatccggtccttccccctggccgccctgcctccaggacgcacctccgagagccacagccggccctgggcctcgcccgtggccaaggacctacttccatcctacactacngacgcgggntcggcaaggcg

SEQ ID NO: 78451 - DNA, 563 bp, Homo sapiens
  misc_feature: GYAE6OF01CH2GP.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaacctggtcaccgtctcctcacgccctccaccgaagggccccagtccggtcccttcccccgtggccctacccctccctccaacgacgccacccgtcgtcggggccacgacgccggcccgtcgggctcgccgtggtacaacggtcctactccatcctacactacgtgacgcgggctggacgaggcgcagtacg

SEQ ID NO: 78452 - DNA, 665 bp, Homo sapiens
  misc_feature: GYAE6OF01B8DAE.37.26.C04.1.454.CMB.1.raw
  modified_base (312)..(312): a, c, t, g, unknown or other
  misc_feature (312)..(312): n is a, c, g, or t
  modified_base (351)..(351): a, c, t, g, unknown or other
  misc_feature (351)..(351): n is a, c, g, or t
  modified_base (390)..(390): a, c, t, g, unknown or other
  misc_feature (390)..(390): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccgttcaccgtctccagagacaattccaaagaatacggtctatctggaaatggacagcctgagagccgaggacacggccctntatactgtgcgagagatcagacgagtatagcagcagctngactacgtcgggccaacggaacctggtccaccgtctccnacgcctaccaccgaacggcccacgttccggtacccttcccccgtcggaccctaccccttcctacccaacgtaccgaccgtaacccgttccgggtacggggtaccaaccggtaccggcccgggtaccccgtcggggtcccgtacgggtccccgttacgggtacccgtaaccgggtacctttaacccggttccctaaacgtttccccgtaaccgtaaccgttaccggtacgggacggcccggggtcgtacgggaccgaaagggccgtacgtagtacg

SEQ ID NO: 78453 - DNA, 580 bp, Homo sapiens
  misc_feature: GYAE6OF01APH34.37.26.C04.1.454.CMB.1.raw
  modified_base (573)..(573): a, c, t, g, unknown or other
  misc_feature (573)..(573): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctaatctggaaatgaacagcctgagagccggaggacacggccctctattactgtgcgagagatcgagacggagtatagcagcagctctgactacgtggggccaccggtaacccgtggtaccacccgttctccctcaccgccctacccaccgaacgggcccacgtcccggttcccttcccccgtcggccctaccctcctaccaagacgcaccctcgcgggccacgacgccggcccgtgggctcgccgtcggacgaacggcctacttccattcctacactacgtgacggcgggactcggaccaaggcngagtacg

SEQ ID NO: 78454 - DNA, 548 bp, Homo sapiens
  misc_feature: GYAE6OF01DVBNK.37.26.C04.1.454.CMB.1.raw
  modified_base (342)..(342): a, c, t, g, unknown or other
  misc_feature (342)..(342): n is a, c, g, or t
  modified_base (543)..(543): a, c, t, g, unknown or other
  misc_feature (543)..(543): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctaattactgtgcgagagatcagacggagtanagcagcagctctgactacgtggggccaacggaaccctggccaccgtctcctcacgcctccaccacggccagtcgtcttcccctgccacccctcctccaacgacgcacctcgtcggggcacgacgccggcccgtggctcgctggtacgaaggacttactcctatacgtactactacgcgacgcgggcgtcggacgaggcgcngtacg

SEQ ID NO: 78455 - DNA, 560 bp, Homo sapiens
  misc_feature: GYAE6OF01DOCRK.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgcctccaccaaggcccatccgtccttccccctcgccaccctccctccaacgacgccacccgtcgtcgggggccacgacgccggcccgtcggggctcgcctcggtcgaacggacctaacttccaatcctaccactactgacggcgggcgtggacgaggcgcgagtag

SEQ ID NO: 78456 - DNA, 551 bp, Homo sapiens
  misc_feature: GYAE6OF01B7HL0.37.26.C04.1.454.CMB.1.raw
  modified_base (459)..(459): a, c, t, g, unknown or other
  misc_feature (459)..(459): n is a, c, g, or t
  modified_base (545)..(545): a, c, t, g, unknown or other
  misc_feature (545)..(545): n is a, c, g, or t
  modified_base (548)..(548): a, c, t, g, unknown or other
  misc_feature (548)..(548): n is a, c, g, or t
tcagtagtgtagatcacgaccggtgctcgatttagtctagcgactttgggtttgggggaggcttggtacagcctggggggtccctgagactctcctgtgcagcctctggattcacctttgacaagtgtgccatgacctgggtccgccaggctccagggaaggggctggagtgggtctcagttattagtggtagtggtagtagcacagattacgcagactccgtgaaggccggttcaccatctccagagacaattccaacagcacgctgtatttgcacatgaacagcctgagagccgaggacacggccatatattattgtgcgaaacttccttttgacttggttattatccctagtgaccactgggccagggaaccctggtcaccgtctcctcagcctccaccaacgggcccacgtcggtccttcccctcggccaccctcctccaacgacgccacctcgnggggccacgacgccggcccgtggggtcctcgccctgggtcaacggacctacttccatcctacactactgacgcggctggcaaggcncgntag

SEQ ID NO: 78457 - DNA, 572 bp, Homo sapiens
  misc_feature: GYAE6OF01BFWBL.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcacgcctccaccaagggcccagtccggtccttccccctcggccacccctccctccaacgacgccaccctcgtcgggggccacgacgccggcccgtggggtcctcggccctcgggtaccgaaggacctaccttcccattcctactacctactggacggcgggcgtcggcgaaggccgcagtacg

SEQ ID NO: 78458 - DNA, 553 bp, Homo sapiens
  misc_feature: GYAE6OF01BCECJ.37.26.C04.1.454.CMB.1.raw
  modified_base (321)..(321): a, c, t, g, unknown or other
  misc_feature (321)..(321): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (396)..(396): a, c, t, g, unknown or other
  misc_feature (396)..(396): n is a, c, g, or t
  modified_base (436)..(436): a, c, t, g, unknown or other
  misc_feature (436)..(436): n is a, c, g, or t
  modified_base (443)..(443): a, c, t, g, unknown or other
  misc_feature (443)..(443): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcatccattagtagtagtggtacttacatatactacgcagactcagtgaggggccattcaccatctccagagacaacgccaagaactcactgtatctgacaaatgaacagcctagagacgccgaggacacggctgtgtattacgngtgcgagacgcccctcacctcagcagcagcggtnacgttcgnggggccaagggaccctggccacccgtctcctcncgcctccacgacggcccacgtccgtcctccccgtggcccnccctccnccaacgcgccaccgtcgtcgggcacgcgccgccgcggctcgccgtggtaccaacggcctaccgtccactacctacacctacgtcggacggcgggcgtcggacgaaccggg

SEQ ID NO: 78459 - DNA, 545 bp, Homo sapiens
  misc_feature: GYAE6OF01CXLRE.37.26.C04.1.454.CMB.1.raw
  modified_base (312)..(312): a, c, t, g, unknown or other
  misc_feature (312)..(312): n is a, c, g, or t
  modified_base (539)..(540): a, c, t, g, unknown or other
  misc_feature (539)..(540): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctggaaatgaacagcctgagagccgaggacacggcccctntattactgtgcgagagatcagacggagtatagcagcagctctgactacgtggggccacggaacctggtccacgtctcctcacgccctccaccgaacgggccccatccggtccttccccgtggccaccctcctccaacgacgccacctcgtcggggcacgacgccggcccgtgggctgcctggtcaacggactactccatctacactactgacgcggctggacaggcnngtacg

SEQ ID NO: 78460 - DNA, 593 bp, Homo sapiens
  misc_feature: GYAE6OF01BHWXA.37.26.C04.1.454.CMB.1.raw
  modified_base (317)..(317): a, c, t, g, unknown or other
  misc_feature (317)..(317): n is a, c, g, or t
  modified_base (335)..(335): a, c, t, g, unknown or other
  misc_feature (335)..(335): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattacngtgcgagagatcagacgngtatagcagcagctctgactacgtggggccacggaaccctggtcaccgtctcctcacgccctccaccaacgggcccagtccggtccttcccccgtggccaccctccctccaacgcgccaccgtcgtcggggccacgacgccggcccgtggggcctcggccgttcggtaccgaaacgggtacctaccgttcccaattcccgtaacctaccttaccgtcggacgggccgggccgtgggaccgaagggccgccgagtacgg

SEQ ID NO: 78461 - DNA, 594 bp, Homo sapiens
  misc_feature: GYAE6OF01AVBTX.37.26.C04.1.454.CMB.1.raw
  modified_base (305)..(305): a, c, t, g, unknown or other
  misc_feature (305)..(305): n is a, c, g, or t
  modified_base (357)..(357): a, c, t, g, unknown or other
  misc_feature (357)..(357): n is a, c, g, or t
  modified_base (401)..(401): a, c, t, g, unknown or other
  misc_feature (401)..(401): n is a, c, g, or t
  modified_base (556)..(556): a, c, t, g, unknown or other
  misc_feature (556)..(556): n is a, c, g, or t
tcagtagtgtagatcacgaccggtgctcgatttagtctagcgactttgggtttgggggaggcttgggtacagcctgggggtccggtcgagactctcctgtgcagcctcctggtttcgtatctttagtcaactaacgccatgagctgggtccggccaggctccagggaagggggcgtggaggtgggtctcaggtattactggtagtggtaataccgcatactacgcagactccgtgacgggccggttcaccgtctccagagacaattccaagaatacggtctatctggaaatgaacagcctgagancagaggacacggccctctattactgtgcgagagatcagacgggagtaatgcngcagctctgactactggggccacggaaccctggcaccgtctccncacgcctcccacaacgggcccatcggtccttcccctggccacccctcctcaacgagcctaccctcgcggggcacacggcggcccgtgggctcggcccgtggtaccgaaacgggtaccttaccttcccgactccgttaaaccaccttacgttacgngggaccggggtcctaggggaccaaacgggccgctaagg

SEQ ID NO: 78462 - DNA, 595 bp, Homo sapiens
  misc_feature: GYAE6OF01CT1GY.37.26.C04.1.454.CMB.1.raw
  modified_base (320)..(320): a, c, t, g, unknown or other
  misc_feature (320)..(320): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (588)..(588): a, c, t, g, unknown or other
  misc_feature (588)..(588): n is a, c, g, or t
tcagtagtgtagatcacgaccggtgctcgatttagtctagcgactttgggtttgggggaggcttggtacagcctggggggtccctgagactctcctgtgcagcctctggtttcatcttttagcaactacgccatgagctgggtccgccaggctccagggaaggggctgggagtgggtctcaggtattactggtagtggtaataccgcatactacgcagactccgtgacgggccgttcaccgtctccagagacaattccaagaatacggtctatctaggaaatgaacagcctgagagccgaggacacggccctctattacngtgcgagagatcaggacggagtaanagcagnagctctagactacgtcggggacccacggtaaccctgggtaccacccgtctcctcacgccctaccgaccgaacgggcccacgtccggtcccttccccgtcggcctacccctccctacccaacgaccgccacccgtcggtcggggaccacgacgccggcccgtcgggcgtcgccgtcggtacgaacggtactacctcctactcctaccgtactacgtgacgcgggcgtcggacgaggcncgagtag

SEQ ID NO: 78463 - DNA, 749 bp, Homo sapiens
  misc_feature: GYAE6OF01CEEQF.37.26.C04.1.454.CMB.1.raw
  modified_base (746)..(748): a, c, t, g, unknown or other
  misc_feature (746)..(748): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgaggggaaggggctgggagtgggtctacaagtactagtgctcctggtaatagagcagactacgcagactccgtgaagggccgttcaccatctcagagacaatccaagaacacgctctatctgacaaatagaacacgcctaggacgacgaccgaaagacgaccggacgtaattattaactgtaggtaggaaaggtcggtaggggaggtacggggggactacgggtcggggaccgaacgggggtaacccgtcggtaccgtacccggttccgtcccgttacgacccggtccccttaccccgaaaccccggaaaccggggtaccccgtaacggtttccccgggttacccctttccccccggttcgggaccccctacccccgttaccctacccgaaacgaccggtaccctaccgtccgggtacgggggaccaaccggacggccccgggacccggtgggcccgtacggtcccgtacgggtaccgaaaccgggttacccttaacccgttacctaccttaccgtaaccgtacgttacggtaccggaacgggccgggtaccggtacgggaacggtaacgggaccgacgaacgtagcagcnnng

SEQ ID NO: 78464 - DNA, 580 bp, Homo sapiens
  misc_feature: GYAE6OF01A69N5.37.26.C04.1.454.CMB.1.raw
  modified_base (573)..(573): a, c, t, g, unknown or other
  misc_feature (573)..(573): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacaccggccctctattactgtgcgagagatcagacggagtatagcagcagctctgactacgtggggccacggaaccctggtccaccgtctcctcacgccctccaccgaacgggcccatccggtccttcccccgtggccacccctccctacccaagacgccacccgtccgtcggggccacgacggccggcccgtcggggcctcgcccgtggtaccgaacggtacctaccttccaacgttcctaccactacgtcgacgcgggctcggacaaggcncgatacg

SEQ ID NO: 78465 - DNA, 567 bp, Homo sapiens
  misc_feature: GYAE6OF01D05VN.37.26.C04.1.454.CMB.1.raw
  modified_base (206)..(206): a, c, t, g, unknown or other
  misc_feature (206)..(206): n is a, c, g, or t
  modified_base (312)..(312): a, c, t, g, unknown or other
  misc_feature (312)..(312): n is a, c, g, or t
  modified_base (562)..(562): a, c, t, g, unknown or other
  misc_feature (562)..(562): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgnatactacgcagactccgtgacgggccggttcaccgtctccagagacaattccaaagaatacggtctatctaggaaatgaacagcctgagagccgagacacggcctntattactgtgcgagagatcagacggatatagcagcagctctgactacgtggggccaacggaaccctggtcaccgttctcctcacgccctaccaccgaacggcccacgtccggtcccttccccgtcggcctacccctcctaccaacgcgccaccgtcgtcggggccacgacggccggcccgtgggcctcgccgtcggtacgaacggccttactccatccgtacactacgtggacgcggcgtcggacaggcnagtag

SEQ ID NO: 78466 - DNA, 606 bp, Homo sapiens
  misc_feature: GYAE6OF01B45W9.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggagtatagcagcagctctgactacgtggggcccacggaaccctggtccaccgtctccctcacgccctccaccgaacgggcccacgtccggttcccttcccccgtcggccctacccctccctcccaacgacgccaccctcgtcggggccacgacggcccggcccgtcggggtcctcggtcccgtcgggtaccgaacggtaccttaccgttccctacttcctacctaccttaccgtcggacggcggggcgtcggacgaagggcgcgagtacg

SEQ ID NO: 78467 - DNA, 583 bp, Homo sapiens
  misc_feature: GYAE6OF01C0NRB.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcacgcctccaccaacggcccatccggtccttcccccgtcggccacccctcctccaacgacgccacctccgtcggggccacgacggccggccccgtggggcctcggcccgttcggtacgaacgggtacctaccttcccaatcctaaccgacttaccgtcgcggtaccgggcttcgggacaagggcgcgagtag

SEQ ID NO: 78468 - DNA, 577 bp, Homo sapiens
  misc_feature: GYAE6OF01DNV4T.37.26.C04.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (424)..(424): a, c, t, g, unknown or other
  misc_feature (424)..(424): n is a, c, g, or t
  modified_base (479)..(479): a, c, t, g, unknown or other
  misc_feature (479)..(479): n is a, c, g, or t
  modified_base (511)..(511): a, c, t, g, unknown or other
  misc_feature (511)..(511): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctgggagtgggtctcgaggtattggtggcaggtggtgagaccacatactacgcagactccgngaagggccgttcaccatctccaganacaatccaagaccaccctgtctctgacaaatgaacaactgagagccgaggacacggcctatattactagtaacgaaaatcggacctaacggatagtagactactagttgggacttggtacttcggacttcgtcgtcgggccgtggccaccgtggtcactgtcctcctcacnccctaccaaccgacggcccacgtcgtcccttccccgcgccgccctgcctcgagcnccaccgtcgagacgcacgcgccggccgcggcncgtccgtggtaccgacggtacctaccgttccactactaccacttacgtggacggccggcgtacggg

SEQ ID NO: 78469 - DNA, 606 bp, Homo sapiens
  misc_feature: GYAE6OF01B7YUX.37.26.C04.1.454.CMB.1.raw
  modified_base (206)..(206): a, c, t, g, unknown or other
  misc_feature (206)..(206): n is a, c, g, or t
  modified_base (315)..(315): a, c, t, g, unknown or other
  misc_feature (315)..(315): n is a, c, g, or t
  modified_base (358)..(358): a, c, t, g, unknown or other
  misc_feature (358)..(358): n is a, c, g, or t
tcagtagtgtagatcacgaccggtgctcgatttagtctagcgactttgggtttgggggaggcttgggtacagcctggggggtccctgagactctcctgtgcagcctctggtttcatctttagcaactacgccatgagctgggtccgccaggctccagggaaggggctggagtgggtctcaggtattactggtagtggtaataccgnatactacgcagactccgtgacgggccgttcaccgtctccagagacaattccaaagaatacggtctatcgtggaaaatgaaacagcctgagagccgaggacacggccctntacttactgtgcgagagatcagacggagtatagcagcagctcngactacgtggggccacggaacctggtcaccgtctcctcacgcctccaccgaacggccctacgtccggtcccttccccgtcggccaccctccctaccaacgacgacaccgtcgtcggggccacgacgccggtcccgtcgggtccgtcgccgtcggtaccgaacggtaccttaccgttcctaacttccgtaaccgtacgtaccgtcggacggtccgggtccgtacgggacgaacgggccgacgtagtacg

SEQ ID NO: 78470 - DNA, 587 bp, Homo sapiens
  misc_feature: GYAE6OF01A086Q.37.26.C04.1.454.CMB.1.raw
  modified_base (581)..(581): a, c, t, g, unknown or other
  misc_feature (581)..(581): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgcgaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcccctctattactgtgcgagagatcagacggagtatagcagcagctctgactcgtggggccacggaaccctgggtccaccgtctcctcacgccctccaccgaacgggcccacgtccggtcccttccccgtcggccacccctccctaccaacgacgccacctcgtcggggccacgacgccgggcccgtcgggccgtcggccgtcggtaccgaacggtaccttaccttccactaccgtacctactacgtcggacggtccggcgtcggacgaggccgngagtag

SEQ ID NO: 78471 - DNA, 625 bp, Homo sapiens
  misc_feature: GYAE6OF01C8Q1J.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctaggaaatgaacagcctgagagccgaggacacggccctctattactgtgcgagagatcagacggagtatagcagcagctctgactacgtggggccacgggaaccctggtccacgtctcctcacgccctccacccaacgggcccctagtccggttccctttcccccgtcggccctacccctccctaccctaaacgacgcctaacccgttccggtcgggggacctaccgacggcccgggtccccgtggggcctcggtcccgttcgggtaccgaaacgggtaccttaccgttccctactcctaacctaccttaacgtggacgggccgggtctcgggaacagggccgctagtaacg

SEQ ID NO: 78472 - DNA, 569 bp, Homo sapiens
  misc_feature: GYAE6OF01A1UGJ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctatttactgtgcgagagatcagacggagtatagcagcagctctgactacgtggggccacggaaccctggtcaccgtctcctcacgcctccaccaacgggccccatccggtccttccccctggcccaccctccctacccaacgacgccacccgtcgtcgggggccacgacgccggccccgtgggcctcgcccgtggtaccaacggtacctaccttccatcctacacctacgtgacgcgggctcggcgaaggcgcgatcg

SEQ ID NO: 78473 - DNA, 594 bp, Homo sapiens
  misc_feature: GYAE6OF01D36H7.37.26.C04.1.454.CMB.1.raw
  modified_base (587)..(587): a, c, t, g, unknown or other
  misc_feature (587)..(587): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtcggggccacgggaaccctggtcaccgtctcctcacgcctccaccgacggcccatccggtccttcccccgtggcccacccctcctccaacgacgccaccctcggtcggggccacgacggcccggcccgtggggcctcggtcccgtggtaccgtaaacggtaccttaccttccctattcccgtaaccaccttacgtggacggccggggacgtcgggaccaacgggccgngagtacg

SEQ ID NO: 78474 - DNA, 566 bp, Homo sapiens
  misc_feature: GYAE6OF01B4073.37.26.C04.1.454.CMB.1.raw
  modified_base (544)..(544): a, c, t, g, unknown or other
  misc_feature (544)..(544): n is a, c, g, or t
  modified_base (563)..(564): a, c, t, g, unknown or other
  misc_feature (563)..(564): n is a, c, g, or t
  modified_base (566)..(566): a, c, t, g, unknown or other
  misc_feature (566)..(566): n is a, c, g, or t
tcagtagtgtagatcacgaccggtgctcgatttagtctagcgactttgggtttgggggaggcttggtacagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgacaaatgaacagcctgagagccgaagacacggccgtatattactgtgtagaaaggcgtgggagtgggggactacgtggggaccagggaaccctggtcaccgtctcctcgacgccctaccaccgaacgggccccaattcccgggtaccttccccccgtggtccctacccctcctacccaacgtacgcctaccgtcgtcggggcacgacggccgcccgtggctcgccgtggtcaacggtactacgtccattctaccactacgtgagcgggcnggacaacggcgacagtagnngn

SEQ ID NO: 78475 - DNA, 638 bp, Homo sapiens
  misc_feature: GYAE6OF01CK4DH.37.26.C04.1.454.CMB.1.raw
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggagggctggagtgggtctcaggtattactgggtagtggtaataccgcatactacgcagactccggtgacgggccgttcaccgtctccagagacaattccaaagactacggtctatctaggaaatgaacagcctgagagccgaggacacggccctntattacngtcgcgagagatcgaggacggagtatagcagcagctagtagactacgtcggggaccaaccgggaccctggtaccaccgttcctaccgtcgacgtccctacccgaacccgaacggtaccctacgtccggttcccttccccgtacggtacccgtaccctcctaccgtaacgacgtaccaccgtcggtcggggacacgacggccggcccggtcgggtccgtcgtccgtacggtaccgaacggtaccgttaccgttacctacgtaccgtaccgtacgtacgtcggacggtcgggacgtacgggacgagggccgagtagtacg

SEQ ID NO: 78476 - DNA, 731 bp, Homo sapiens
  misc_feature: GYAE6OF01B6Z1V.37.26.C04.1.454.CMB.1.raw
  modified_base (146)..(146): a, c, t, g, unknown or other
  misc_feature (146)..(146): n is a, c, g, or t
  modified_base (211)..(211): a, c, t, g, unknown or other
  misc_feature (211)..(211): n is a, c, g, or t
tcagtagtgtagatcacgaccggtgctcgatttagtctagcgactttgggtttgggggaggcttggtacagccgtgggggtccctgagactctcctgtgcagcctctggttcatctttagcaactacgccatgagtcgtgggtccnccaggtctccgaggggaagggctggagtcgggtctcgaggtacttactggtagtggtaataccgntatactacgctagtactccgtgaccgggccggttcaccgtctccgagagacaattccaagagtacggtctatctggaaatgaacagtcctagagtacgccgaaggaccaccggggtccctagtactttaccgtggttccgaccggtaaggaggtacttccgaaggaccgggtaagttagtaggcctaggcccaagtctcgtacggacttacggtggggacccaaccggggtaaccctgggtacccaaccggttctcccgtacgacgcccgtaccaccgtaacggcccgacgtccggtacccttccccgtcggcccacccctaccctaccgaacgaccgtcctacccgtccggtcggggaccacgacggaccggtcccgtacggggtccgtcggtaccgttcggtaccggaacggtacccgttacccgttacccgtaacgttaccgtaacccgtaaccgttaccggtacgggaccggtccgggtacgtacgggacgtaaccgggccgtacgtagtaacggg

SEQ ID NO: 78477 - DNA, 617 bp, Homo sapiens
  misc_feature: GYAE6OF01CT9D6.37.26.C04.1.454.CMB.1.raw
  modified_base (288)..(288): a, c, t, g, unknown or other
  misc_feature (288)..(288): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccggttcaccgtctccagagacaattccaaagaatacggtctatctaggaaatgaacngcctgagagccgaggacacggccctctattactgtgcgagagatcaggacggagtatagcagcagctctcgacttacggtgggaccaacgggaaccctggtaccaccggtctcctcagtccctaccacccgaacgggacccctacgtcccggttcccgtttcccccgcggtcccacccctccctaccaacgacgccaccgtcgtcggggacacgacgccggcccgtgggtcctcgccgtcggtacaacgggtactaccgtccgtactacctaccaccttacgtcggacggccggggccgtacgggaccgaagggtccgagtaagtacgg

SEQ ID NO: 78478 - DNA, 647 bp, Homo sapiens
  misc_feature: GYAE6OF01DHPAS.37.26.C04.1.454.CMB.1.raw
  modified_base (315)..(315): a, c, t, g, unknown or other
  misc_feature (315)..(315): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccgaggggaaggggctggagtgggtctcaggtattactggtagtggtaataccgcatactacgcagactccgtgacgggccgttcaccgtctccagagaacaattccaagaatacggtctatctaggaaatgaacagcctgagagccgaggacacggccctntaattactgtgcgagagatcgaggacggatatagcagacagctcgtgaactacggtggggaccaacgggaccctggtccaccgtctcctcacgccctaccaaccgacgggacccacgtcccggttcccttcccccgtccggaccctaccccttaccctacccgaaacggaccgaccctacccgttccggtcgggggaccacgaccggcccgggcccgtcggggtccgtcggtcccgtagggtaccgtaacggtacccttaccgttcccattacctaacgtaccttacgtaggacggtcgggaccgtacgggacgaacgggcgaccgtagacg

SEQ ID NO: 78479 - DNA, 561 bp, Homo sapiens
  misc_feature: GYAE6OF01BWNK7.37.26.C04.1.454.CMB.1.raw
  modified_base (556)..(557): a, c, t, g, unknown or other
  misc_feature (556)..(557): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagatacggtctatctggaaatgaacagcctgagagccgaggacacggccctctattactgtgcgagagatcagacggagtatagcagcagctctgactactggggccacgggaaccctgggtccaccgtctcctcagccctccaccaacgggcccatccggtccttccccctggccacccctccctccaacgacgccaccctcgtcgggggccacgacggccggccccgtggggctcgcccgtggtcgaacggtacctaccttccactctacactacgtgagcgggctggcgaggcgnngtag

SEQ ID NO: 78480 - DNA, 557 bp, Homo sapiens
  misc_feature: GYAE6OF01D800F.37.26.C04.1.454.CMB.1.raw
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (345)..(345): a, c, t, g, unknown or other
  misc_feature (345)..(345): n is a, c, g, or t
  modified_base (427)..(427): a, c, t, g, unknown or other
  misc_feature (427)..(427): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggcccttntattacngtgcgagagatcgagacggagtatagnagcagctctgactacgtggggccacggaacctggtccaccgtctcctcagccctccaccgacggccacgtcgtcccttcccncgccacccctcctaccagacgcacctcgtcggggcacgacgccggcccgtcggcgtcgccgtggacgaacggactaccgttccactcctaacacctactcggacggccggcgtggacaaggcgcgagtag

SEQ ID NO: 78481 - DNA, 552 bp, Homo sapiens
  misc_feature: GYAE6OF01EIHFA.37.26.C04.1.454.CMB.1.raw
  modified_base (520)..(520): a, c, t, g, unknown or other
  misc_feature (520)..(520): n is a, c, g, or t
  modified_base (526)..(526): a, c, t, g, unknown or other
  misc_feature (526)..(526): n is a, c, g, or t
  modified_base (549)..(549): a, c, t, g, unknown or other
  misc_feature (549)..(549): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtatttactggtagtggtaataccgcatactacgcagactccgtgacgggccggttcaccgtctccagagacaattccaagagcactctgtatctgcaaatgaacagcctgagtgccgaggacacggccctatattattgtgcgaaatggtgggggagtggggctacgtcctggcgttttgactacgtggggccaggggacgccctggtcaccgtctcctcagcctccaccaagggcccagtccggtccttcccccgtggccgccctgcctccaggacgccacctccgagcgcacagccggcccgtgggctgcctggtcaacggctacttccagtcctanactacnggacgcgggctcgggacagggcncag

SEQ ID NO: 78482 - DNA, 586 bp, Homo sapiens
  misc_feature: GYAE6OF01BDWUL.37.26.C04.1.454.CMB.1.raw
  modified_base (311)..(311): a, c, t, g, unknown or other
  misc_feature (311)..(311): n is a, c, g, or t
  modified_base (434)..(434): a, c, t, g, unknown or other
  misc_feature (434)..(434): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctntattactgtgcgagagatcagacggatatagcagcagccctgactacgtgggccgaccgaaccgtcggtcaccgtctcctccacgcctcccaccgaacgggccctactcggtcccttcccccncggtcacccctcctccaagacggcctacccgtcgtcggggcaccaggccggcccgtcggcgtccgccgtcggtacgaaggtacctaccgtcctactactaccgtactacgacggtgacccgggcgtacggtacgaacggtacgccaatggac

SEQ ID NO: 78483 - DNA, 555 bp, Homo sapiens
  misc_feature: GYAE6OF01C0U25.37.26.C04.1.454.CMB.1.raw
  modified_base (548)..(548): a, c, t, g, unknown or other
  misc_feature (548)..(548): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagatacggtctatctggaaatgaacagcctgagagccgaggacacggcccctctattactgtgcgagagatcagacggagtatagcagcagctctgactacgtggggccacggaaccctggtcacgtctcctcagcctccaccaacggcccacgtcggtccttcccccgtggcccacccctcctaccaagacgccacccgtcgtcgggggccacgacggcggcccgtcgggcctgcccgtggtcaaggtcctactccatccacactactgacggcgggctcgggacaggcngagtacg

SEQ ID NO: 78484 - DNA, 588 bp, Homo sapiens
  misc_feature: GYAE6OF01DDQZ4.37.26.C04.1.454.CMB.1.raw
  modified_base (312)..(312): a, c, t, g, unknown or other
  misc_feature (312)..(312): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctntattactgtgcgagagatcagacggagtatagcagcagctctgactacgtggggaccacggaaccctggtcaccgtctcctcacgcctaccaccgaacggcccactccggtcccttccccgtcggccctacccctccctacccgaacgacgccacccgtcgtcgggggccacgacgccgggcccgtcgggccgtcgccgttcggtaccgaacggtaccttaccttcccatcctaactacctactggacggcgggcgtcggacgaggcgcgagtacg

SEQ ID NO: 78485 - DNA, 647 bp, Homo sapiens
  misc_feature: GYAE6OF01BZ4LV.37.26.C04.1.454.CMB.1.raw
  modified_base (309)..(309): a, c, t, g, unknown or other
  misc_feature (309)..(309): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctcagagacaattccaagaatacggtctatctaggaaatgaacagcctgagagccgaggacacggcctntatactgtgcgagagatcagacggagtatagcagcagctctacggactacgtcggggacccaaccggtaacccgtcggtacctacccggttctaccccgtacacgtcccctacccgaacccgtaaccggcccgtaaccgttcccgggttccccttcccccgtcgggaccctacccccgtccctacccgaacgacgccctacccgtcggtcggggaccacggacgcccggtcccgtcgggccgtcgccgtcggtaccgaacggtacctaccttccacttaccgtaccgtacttacggtacggacggtccggcgtacggacgtaacggcgacgtagtacg

SEQ ID NO: 78486 - DNA, 565 bp, Homo sapiens
  misc_feature: GYAE6OF01B4CDS.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaacacctgtctctgcaatgaacaacctgagagccgaggacacggcccctatatttactgtaacgaaaatggacctacggatatgactactattgggactggtacttcgatctcgtggggcctggcaccctggtcactgtctcctcacgccctccgaacccaacgggccccagttcccggtccttccccgtcggccgccctgcctccgaggagccacctcgagcgcacgaggccgccgtggctcgccgtggtcaaggtccttacgtccatactaccactacgtgacggccggactcggacgtaggcg

SEQ ID NO: 78487 - DNA, 599 bp, Homo sapiens
  misc_feature: GYAE6OF01ENRGV.37.26.C04.1.454.CMB.1.raw
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (393)..(393): a, c, t, g, unknown or other
  misc_feature (393)..(393): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcttgggtccgccaggctccgagggaagggctggagtgggtctcaggtattactggtagtggtaataccgcatactacgcagactccgtgaccgggccgttcaccggtctccagagacaattccaagaatacggtctatctggaaatgaacagcctgagagccgaggacacggccctntattacnggtgcgagagatcagacggatatagcagcagctctgactacgcggggccacgggaccctggtaccacccgtcncctcagtccctccaccaacggccacgtccggtccttccccgtggcctaccctcctaccaacgacgccacccgtcgtcggggccacgacggccggcccgtcgggtccgttcggtccgttcggtacgaacggtaaccttaccttaccgtacttccgtaacctaccgtaactcggacgcgggacgtcgggacgacgggcgcgaagtacg

SEQ ID NO: 78488 - DNA, 580 bp, Homo sapiens
  misc_feature: GYAE6OF01A66BG.37.26.C04.1.454.CMB.1.raw
tcagtagtgtagatcacgaccggtgctcgatttagtctagcgactttgggtttgggggaggcttggtacagcctggggggtccccgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggcctctattactgtgcgagagatcagacggagtatagcagcagctctgactacgtgggccacggaaccctggtcaccgtctcctcagccctccaccaacgggcccactccggtccttcccccctcggccacccctccctacccaacgacgccacctcgtcggggccacgacgccggcccgtcgggcctcggccgttcggtccaacggaccttaccttccagtcctaaccgtacctacgtggacggcgggacgtcgggacgaacggcgacagtaagc

SEQ ID NO: 78489 - DNA, 654 bp, Homo sapiens
  misc_feature: GYAE6OF01C7XAR.37.26.C04.1.454.CMB.1.raw
  modified_base (317)..(317): a, c, t, g, unknown or other
  misc_feature (317)..(317): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctgggagtgggtctcaggtattacgtggtagtggtaataccgcatactacgcagactccgtgacgggccgttcaccgtctcagagacaattccaagaatacggtctatctaggaaatgaacagcctgagagccgagacacggcctatatacngtgcgagagatcgagacgatataggcagcagcctcgtagactacggtgggacccacggaaccctggtaccaccgtctccctacgacgtcccctcccaaccgaacgggcccctacgtcccgggtccctttccccgtcggaccctaccctacccgtaccgaacggaccacccgtaccgtcggtcggggacccaacgccggccggccccggtcgggtccgtaccggtcccgttacgggtaccgtaacggtaccttaccttacccgaacttaccgtaaccgtaaccttacggtcggaaacgggccgggtccgtacgggtaccgaagggtccgcgagtacgg

SEQ ID NO: 78490 - DNA, 557 bp, Homo sapiens
  misc_feature: GYAE6OF01A2V0R.37.26.C04.1.454.CMB.1.raw
  modified_base (353)..(353): a, c, t, g, unknown or other
  misc_feature (353)..(353): n is a, c, g, or t
  modified_base (530)..(530): a, c, t, g, unknown or other
  misc_feature (530)..(530): n is a, c, g, or t
  modified_base (551)..(551): a, c, t, g, unknown or other
  misc_feature (551)..(551): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctcngactacgtggggccacggaaccctggtccaccgtctcctcacgcctccaccgaacgggcccactccggtcccttccccctcggcccacccctccctccaacgacgccaccctcgtcggggcacgacgccggcccgtgggctcgcctggtcaaggacctacgtccactctacactacngacgcgggctcggacaaggcncagtag

SEQ ID NO: 78491 - DNA, 629 bp, Homo sapiens
  misc_feature: GYAE6OF01CUPQF.37.26.C04.1.454.CMB.1.raw
  modified_base (209)..(209): a, c, t, g, unknown or other
  misc_feature (209)..(209): n is a, c, g, or t
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctgggagtgggtctcaggttattactggtagtggtaataccgnatactacgcagactccgtgaccgggccgttcaccgtctccagagacaattccaaagaatacggtctatctaggaaatgaacagcctgagagccgaggacacggccctntattacngtgcgagagatcagacggatatagcagcagtctcgtacgactaaccgtggggacccaacgggtaacccttgggacctaccgtcctcctcgacgtccctaccgaacccgaacggcccctacgttccggtccctttccccgtcggccctacccctcctaccgaacgacgcctacccgtcggtacggggaccacgacgccggcccgtcgggcgtcgccgttacggtacgaacggtacctaccttccctactccgtaactacttaacgtcggacggtccgggcgtacgggacgaagggcgacgaagtag

SEQ ID NO: 78492 - DNA, 714 bp, Homo sapiens
  misc_feature: GYAE6OF01CU9F0.37.26.C04.1.454.CMB.1.raw
  modified_base (145)..(145): a, c, t, g, unknown or other
  misc_feature (145)..(145): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccnccaggctccgaggggaagggctgggagtgggtctcgaggtattactggtagtggtaataccgcatactacgcagactccgtggacgggccggttcaccgtctccagagacaattaccaaagaatacggtctatcgtaggaaatgaacgagcctagaacgacgccggaaggaccaccggcccttactattacgtgcgacgagagataccgaagacggtaagtatacgacgacgacacgtcttacgtacgacgttaccggcgggggaccctaacccgggaacccttcgggtacccacccgttacctcccgtacgaccgtacccctacccgaccgaacgggcccctacgttcccggtccccttccccgcggacccctaccctaccctaccgaacgccgaccgtacccgtcgggtcggggaccaacggaccggcccgggtacccgtcgggtcctaccggtccgtacggtaccgaaacggttaccttaccgtaccctacgttacctaaccgtaccttacggtacggaccgggtaccgggaccggtacgggaacggtaacggccgacgtagtacg

SEQ ID NO: 78493 - DNA, 578 bp, Homo sapiens
  misc_feature: GYAE6OF01B92EX.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggagtatagcagcagctctgactactggggccaacggaaccctggtccaccgtctcctcacgcctccaccaacgggcccagtccggtcccttcccctcggccaccctccctaccaacgacgccaccctcgtcggggccacgacgccggcccgtcggggcctcgcccgtggtacaacggacctacgttcccaatccgtaactactacgtggacggccgggctcgggacgaaggccgcgagtacg

SEQ ID NO: 78494 - DNA, 574 bp, Homo sapiens
  misc_feature: GYAE6OF01CA7DD.37.26.C04.1.454.CMB.1.raw
  modified_base (441)..(441): a, c, t, g, unknown or other
  misc_feature (441)..(441): n is a, c, g, or t
  modified_base (567)..(567): a, c, t, g, unknown or other
  misc_feature (567)..(567): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactactggggccacggaaccctggccaccgtctcctcgacgccctaccaccgaacgggcccactccggttcccttcccccgtcggccncccctcctacccaacgcgccaccctcggtcggggaccacgacggccggcccgtgggccgtcgccgtcggtcaacggctaccttccatcctacactacgtggacggcgggcgtcggacgtaaggcgngagtacg

SEQ ID NO: 78495 - DNA, 627 bp, Homo sapiens
  misc_feature: GYAE6OF01EABWC.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctagactacgtggggccaacggaaccctggtccaccgtctcctcacgcctccaccgaacggcccacgtccggtcccttcccccgtcggacccacccctccctacccgaacgacgaccaccctcggtcggggccacgacggccggccccgtcggggcctcggcccgttcgggtaccgaaacgggtacccttaaccgttacccacttacccgtaacctaacgttaccgtacgggaacgggccggggtaccgtcgggacgaagggaccgcgtaagtacg

SEQ ID NO: 78496 - DNA, 625 bp, Homo sapiens
  misc_feature: GYAE6OF01DYVLE.37.26.C04.1.454.CMB.1.raw
  modified_base (248)..(248): a, c, t, g, unknown or other
  misc_feature (248)..(248): n is a, c, g, or t
  modified_base (618)..(618): a, c, t, g, unknown or other
  misc_feature (618)..(618): n is a, c, g, or t
tcagtagtgtagatcacgaccggtgctcgatttagtctagcgacttttgggtttgggggaggcttggtacagcctggggggtccctgagactctcctgtgcagcctctggtttcatctttagcaactacgccatgagctgggtccgccaggctccgaggggaaggggctggagtgggtctcgaggtattactggtagtggtaataccgcatactacgcagactccggtgacgggccggttcaccgtcnccagagacaattaccaagaatacggtctatctaggaaatgaaacagcctgagagccgaggacaccggccctctaattactggtgcgagagatcaggacggatatagcagcagctgtgtaacctacgtcggggcccaaccggtacctggtccaccgtctcctcacgtccctaccgaccgaacgggccctacgtccggttacccttccccgtcggccctaccccctcctacccgaacgccgacctacccgtcggtcgggggccaacgacgccggcccgtcgggtccgtcggccgtcggtacgaacggtccttacctaccgtactacctacgtacctacgtcggtacggcgggtcgtcggacgaacgggccgngagtacg

SEQ ID NO: 78497 - DNA, 657 bp, Homo sapiens
  misc_feature: GYAE6OF01DSNP6.37.26.C04.1.454.CMB.1.raw
  modified_base (341)..(341): a, c, t, g, unknown or other
  misc_feature (341)..(341): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggagtanagcagcagctctgactacgtggggaccacggaaccctggtccacgtctcctcgacgccctccacccaacgggccccaagtccgggttcccttcccccgtcggacccacccccttccctacccaaacgtacgccctaacccgttccgtacgggggccaaccgacggcccgggaccccggttcggggccttcggcccttcggggtaccgaaacgggtaaccttaaccgttcccgtaacttaccgttaaacccaccgttaaaccgttcggaacggtccggggcgttacggggaccgtaaagggcccgaccgtaagtacg

SEQ ID NO: 78498 - DNA, 639 bp, Homo sapiens
  misc_feature: GYAE6OF01BP4GC.37.26.C04.1.454.CMB.1.raw
  modified_base (205)..(205): a, c, t, g, unknown or other
  misc_feature (205)..(205): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgngatactacgcgacgacgtccgtcggacgggaccgggttccgtaccgtaccgtccacgagaacaacttactaacgaaagtacgtacgtactactaggtaaagtaagtaacgaacgccgtcgagaaggaccgacggacgaccgcccgtcctattactgtgcgagagatcagaggagtatagcagacgagctctgacgtacgtacgggccggaaccgaaccgtcggtcgtacccgtctcctccacgcctccccaaccgaacgggcccgcttaccgggttcccgttcccctccggacgaccccctccctccgaagacgccaccgtcgtggggaccgacacggcggcccgtcgggcgtcgcgtcggtagaccgtaagtcccttacctacgacgtacctaccgaacgttggacggcggcgtacgcggaacgacgcgatag

SEQ ID NO: 78499 - DNA, 212 bp, Homo sapiens
  misc_feature: GYAE6OF01AZAJT.37.26.C04.1.454.CMB.1.raw
  modified_base (178)..(212): a, c, t, g, unknown or other
  misc_feature (178)..(212): n is a, c, g, or t
tcagtagtgtagatcacgaccggtgctcgatttagtctagcgactttgggtttggggggtaaggaggaagactgacggtcccccaggagttcaggtgctggcacagcggccctgggctgcctggtcaaggactacttccatctacacttactgagcgggctggtcaaggcgcattagnnnnnnnnnnnnnnnnnnnnnnnnnnnnnnnnnnn

SEQ ID NO: 78500 - DNA, 597 bp, Homo sapiens
  misc_feature: GYAE6OF01DYKAC.37.26.C04.1.454.CMB.1.raw
  modified_base (434)..(434): a, c, t, g, unknown or other
  misc_feature (434)..(434): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgtaaactttccttttgacttgttattatccctagtcgacacgtggggccagggaccctggcaccgtctcctcacgcctccaccaacgggcccacgtccggtccttcccccgnggacccacccctcctaccaacgcgcctaccgtcgtcggggccacgacgccggcccgtggggcctcgccgtcggtacgaacggtaccttaccgttcccattaccctaaccacttacctcgggaacggccggggtccgtcgggaccgaagggccgcgaagtaacg

SEQ ID NO: 78501 - DNA, 175 bp, Homo sapiens
  misc_feature: GYAE6OF01AIK9P.37.26.C04.1.454.CMB.1.raw
  modified_base (173)..(175): a, c, t, g, unknown or other
  misc_feature (173)..(175): n is a, c, g, or t
tcagtagtgtagatcacgaccggtgctcgatttagtctagcgactttgggtttgggggaagaggaagactgacggtcccccaggagttcaggtgctgggcacagcggccctgggctgcctggtcaaggactacttccatctacactactgagcgggctggcaaggcgcatagnnn

SEQ ID NO: 78502 - DNA, 607 bp, Homo sapiens
  misc_feature: GYAE6OF01CVQE4.37.26.C04.1.454.CMB.1.raw
  modified_base (243)..(243): a, c, t, g, unknown or other
  misc_feature (243)..(243): n is a, c, g, or t
  modified_base (355)..(355): a, c, t, g, unknown or other
  misc_feature (355)..(355): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgcatgagctgggtccgccaggctccgaggggaaggggctggagtgggtctcaggtattactggtagtggtaataccgcatactacgcagactccgtgacgggccgttcaccgtcnccagagacaattccaaagatacggtctatctaggaaatgaacagcctgagagccgaggacacggccctctaattactgtgcgagagatcagacggagtatagcagcagctcngactacgtggggacccaacggaaccctggtaccaccgtctcctcacgccctaccaccgacggccctacgtccggtcccttccccgtcggccctaccccttaccctaccaacgacgccgtaccgtcggtcggggaccacgacggcccggtcccgtcgggtccgtcgtccgtacggtacgaacggtaccttaaccttccgtactccgtaacccacttacgtggacggtcggcgtcggacgaggccgcgagtacg

SEQ ID NO: 78503 - DNA, 584 bp, Homo sapiens
  misc_feature: GYAE6OF01BVQRE.37.26.C04.1.454.CMB.1.raw
  modified_base (442)..(442): a, c, t, g, unknown or other
  misc_feature (442)..(442): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtgggccacggaaccctggtccaccgtctcctcagccctaccaccaacggcccacgtccgtccttccccgtggccacccctccnccaacgcgacacccgtcgtcggggcacgacgccggcccgtgggcctcggcccgtggtaccgaacggtaccttacgttccctagttcctaccgaccttaacgtcggacggccggggtcctacgggacgaaggccgcgatacgg

SEQ ID NO: 78504 - DNA, 629 bp, Homo sapiens
  misc_feature: GYAE6OF01CDFQG.37.26.C04.1.454.CMB.1.raw
  modified_base (355)..(355): a, c, t, g, unknown or other
  misc_feature (355)..(355): n is a, c, g, or t
  modified_base (621)..(621): a, c, t, g, unknown or other
  misc_feature (621)..(621): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctaggaaatgaacagcctgagagccgaggacacggccctctattactgtgcgagagatcaaggacgagtatagcagctagctcngacgtacgtcggggacccaacggtaaccctgggtccacccgttctccctcacgtccctacccaaccgaacggaccccagttaccggtccctttcccccgtcggaccctacccctccctacccgaaagaccgaccacccgtcggtcggggaccaacgacggcccgggcccgtcggggaccgttcggcccgtggacccgaaggaccgttaccttcccaatcctaccacttacgtcggaacggccgggacgtacgggaccgaagggccncgagtacg

SEQ ID NO: 78505 - DNA, 631 bp, Homo sapiens
  misc_feature: GYAE6OF01DYHFG.37.26.C04.1.454.CMB.1.raw
  modified_base (314)..(314): a, c, t, g, unknown or other
  misc_feature (314)..(314): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccgttcaccgtctccagagacaattccaaagaatacggtctatcgtaggaaatgaacagcctgagagccgaggacacggccctntattactgtgcgagagatcagacggatatagcagcagctctgactacgtgggaccaacggaccctggccaccgtctcctcacgtccctaccaaccgaacgggccccagtccggttacccttcccccgcggtcccaccccttccctacctaacgacgccacccgtcggtcggggccacgacggcccggtcccgtcgggtcctcggccgttcgggtaccgaacggtacccttaccgttacccacttaccgtaacctaacgttaccgtggaaccgggtccgggtaccgttacgggaccgaagggcccgacgtagtaacgg

SEQ ID NO: 78506 - DNA, 705 bp, Homo sapiens
  misc_feature: GYAE6OF01CTBM7.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgcatgagctgggtccgccaggctccaggggaaggggctggagtgggtctcaggtattactggtagtggtaataccgcatacctacgcagactccggtgacgggccgttcaccgtctccagagacaattccaaagaatacggtctatctaggaaatgaacagccctgagagccgaggacacggcccctctattactgtgcgagagatcagacggagtatagcagcagctctgactacgtgggccacggaccctgtccacgtcctcctcacgccctccaaccgaacgggcccctaacgtccggttcccctttcccccgtcgggaccctacccccgtcccctaccgtaaacggacgtcccaacccgttccggtacgggggccaaccgacggtaccccgggtcccccggttacgggggtccgtaccgggtccccggtttacgggtacccggtaaacgggtacccgttaacccgttacccgtacgttacccttaaacccgtaacctttaacccggtagggaaccggggtccggggtacccgttcggggacccgtaaacgggcccggtacgtaacggttacgg

SEQ ID NO: 78507 - DNA, 567 bp, Homo sapiens
  misc_feature: GYAE6OF01ENMP9.37.26.C04.1.454.CMB.1.raw
  modified_base (315)..(315): a, c, t, g, unknown or other
  misc_feature (315)..(315): n is a, c, g, or t
  modified_base (401)..(401): a, c, t, g, unknown or other
  misc_feature (401)..(401): n is a, c, g, or t
  modified_base (544)..(544): a, c, t, g, unknown or other
  misc_feature (544)..(544): n is a, c, g, or t
  modified_base (563)..(563): a, c, t, g, unknown or other
  misc_feature (563)..(563): n is a, c, g, or t
tcagtagtgtagatcacgaccggtgctcgatttagtctagcgacttttgggtttgggggaggcttggtacagcctgggggggtccctgagactctcctgtgcagcctctggtttcatctttagcaactacgccatgagctgggtccgccaggctccaggggaaggggctggagtgggtctcaggtattactggtagtggtaataccgcatactacgcagactcgtgacgggccgttcaccgtctccagagacaattccaaagaatacggtctatctggaaatgaaacagcctgagagccgaggacacggcccctntattactgtgcgagagatcagacgagtatagcagcagctctgactacgtggggccaacggaaccctggcctaccgtctcctcgacnccctacccaaccgaacgggcccacgtccggtcccttcccccgtcggccacccctcctaccgaagacgccaccgtcgtcggggcacgacgccggcccgtgggcctcgccgtggtacaaggtactacttccatcctacactacgngacgcgggctggacaggcnagtg

SEQ ID NO: 78508 - DNA, 668 bp, Homo sapiens
  misc_feature: GYAE6OF01DMBQM.37.26.C04.1.454.CMB.1.raw
  modified_base (285)..(285): a, c, t, g, unknown or other
  misc_feature (285)..(285): n is a, c, g, or t
  modified_base (311)..(311): a, c, t, g, unknown or other
  misc_feature (311)..(311): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtcttaggtattactggtagtggtaataccgcatactacgcagactcgtgacgggccgttcaccgtctccagagacaattccaaagaatacggtctatctaggaaatgaacngcctgagagccgagacaccggccctntattactgtgcgagagatcgagacggatatagcagcagctcgtgactacgtcggggaccaaccggtaacccgtggtaccacccgtcctcccctacaccggcccctacccaacccgaaccggccccaacgttcccggttaccccttccccccgtcggcccctacccctcccgtaacccacgtaccgcccgtacccgtcggtcgggggaccaccgacggcccgggtacccgtcggggtccttccggacccgttacggtaaccgtaaccggtacttacccttaccctacgttacccgtaacctaaccgttacgtcggaacgggtccgggtcgttacggacgaacgggaccgactagtgcg

SEQ ID NO: 78509 - DNA, 687 bp, Homo sapiens
  misc_feature: GYAE6OF01DK8NH.37.26.C04.1.454.CMB.1.raw
  modified_base (145)..(145): a, c, t, g, unknown or other
  misc_feature (145)..(145): n is a, c, g, or t
  modified_base (206)..(206): a, c, t, g, unknown or other
  misc_feature (206)..(206): n is a, c, g, or t
  modified_base (291)..(291): a, c, t, g, unknown or other
  misc_feature (291)..(291): n is a, c, g, or t
  modified_base (349)..(349): a, c, t, g, unknown or other
  misc_feature (349)..(349): n is a, c, g, or t
tcagtagtgtagatcacgaccggtgctcgatttagtctagcgactttgggtttgggggaggcttggtacagcctggggggtccctgagactctcctgtgcagcctctggtttcatcttagcaactacgccatgagcgtgggtccnccaggctccgagggaagggctggagtgggtctcgaggtattactggtagtggaactaccgnaatactacgcagactccgtgaccgggtccgttcaccgtctcagagacaattccaaagaatcggtactatcgtaggaaaatgaacncgacctggaggacgaccggaagtaccaacggtccccttagtattactggtagcgaagngactcgaagacggtatagacgcaggtcagtctacgtacgaacgttcggcggggaccaaacccggtaaccgtcgtaccgacccgttcctaccgaccacgtacccctacccgaacgaacccgggtccacggtccccggttccctccccggtcgtccctaaccccgtccgtaaccgaacggccgaccctaccggtcgggtaccgggacaaccggtacgggcccgggtccggtacgggtcttccgggtcgtacgggtaactaacgggtaccctacttccgaactttaccgacgtaacgttggacgacggggcacgggtaccgacggtaaacggcagtagacg

SEQ ID NO: 78510 - DNA, 743 bp, Homo sapiens
  misc_feature: GYAE6OF01BFSCE.37.26.C04.1.454.CMB.1.raw
  modified_base (259)..(259): a, c, t, g, unknown or other
  misc_feature (259)..(259): n is a, c, g, or t
  modified_base (583)..(583): a, c, t, g, unknown or other
  misc_feature (583)..(583): n is a, c, g, or t
  modified_base (734)..(734): a, c, t, g, unknown or other
  misc_feature (734)..(734): n is a, c, g, or t
tcagtagtgtagatcacgaccggtgctcgattttagtctagcgactttgggtttgggggtagggcttgggtacaggcctgggggtccctagacgtacgtcttccctgtcgctagtccctcttgggttttcaattccgtttagacctaacgtaacgcccaagtggaacgtcctcgggtaccgtccgaagggttcgtccaggggaaggggcctgggtagtgggtctcgtaggttaattacgtggtagtggtaactaccggnatacgtacgcgtagacgtccgggtagaccgggtccggttcaccggtcgtccagacgcaattccaagatacggtctatcgtaggaaatgaacaggtcctaggagacgccggaaggtaccaacgggtccccttgtaacgtttaccgtggttcggaccggaaggaacggacttccggaaagggtaccgggtagttaacgtacggactacggacctaaggtctacgttagaaccgttacggtggggaccctacgggaaccctggtaccaccgttctccgtacgacgtccctaccaccgaacggcctacgttccggtacccttccccgnggtccctaccccttccgtaccgaacgaccgtacctaccgtcggtcgggacacgacggtccggccgtggtcctacgtccgtacggacgtaacgtcttaccgttcgactccgtactacgtacgtcggacgtcgggtactcggacgtaaggtcncgtagtacg

SEQ ID NO: 78511 - DNA, 640 bp, Homo sapiens
  misc_feature: GYAE6OF01DAXST.37.26.C04.1.454.CMB.1.raw
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccgttcaccgtctccagagacaattccaaagaatacggtctatctaggaaatgaacagcctgagagccgaggacacggccctctattactgtgcgagagatcagacggagtatagcagcagctctgactacgtggggccacggaaccctggtccaccgtctcctcacgcctccaccgaacgggcccacgtccggtccctttcccccgtcggcccacccctccctacccaaacgacgccaacccgtcgtcgggggccacgacggccgggccccgtcggggcctcggcccgttacgggtccgaaacgggtaccttaaccgttccctaacttacccgtaacctaaccttaaccgtcggacgggtcccggggtaccgttacggggaccgaaacgggtccggcgtaagtaacgg

SEQ ID NO: 78512 - DNA, 644 bp, Homo sapiens
  misc_feature: GYAE6OF01ALJV6.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattacgtggtagtggtaataccgcatactacgcagactccgtgacgggccgttcaccgtctccagagacaattccaagaatacggtctatctaggaaatgaaacagcctagaggacgccgaggaccaccggccctctattacctgtcgcgaggagatccgaaggacggagtaagtaagcgacgcgaagtctcgtagactacggtacggggacccaccggtaacccgtggtaccctacccgttcctaccgtcaccgccctacccaccgaaccggcccacgtccggtcccttccccgccgtccaccctccctaccgaacgacgacaccgtcgtcggggaccacgacgccggcccgtcgggtccgtcgtccgtcggtacgaacggtacctaccgttaccgaccttaccgtaccgtaccgtacgtacgacgggacgggtccgtacggccgaacggcgcgacgtag

SEQ ID NO: 78513 - DNA, 556 bp, Homo sapiens
  misc_feature: GYAE6OF01AHTQ2.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggccacggaacctggtcaccgtctcctcacgcctccaccaacgggcccatccggtccttcccctggccaccctcctaccaagacgcacctcgtggggcacgacgccggcccgtgggcctgcccgtggccgaacggtacctacttccattcctacactactggacgccgggctcgggacaagggcgcgagtacgg

SEQ ID NO: 78514 - DNA, 634 bp, Homo sapiens
  misc_feature: GYAE6OF01CAAPX.37.26.C04.1.454.CMB.1.raw
  modified_base (630)..(631): a, c, t, g, unknown or other
  misc_feature (630)..(631): n is a, c, g, or t
  modified_base (633)..(634): a, c, t, g, unknown or other
  misc_feature (633)..(634): n is a, c, g, or t
tcagtagtgtagatcacgaccggtgctcgatttagtctagcgactttgggtttgggggaggcttggtacagcctggggggtccctgagactctcctgtgcaacctctggattcagttgtagtgattgttggatgggttggtccgccaggctccagggagggctggagtgggtggccaacataaagcgagatggaagcgagaaatctatgtggactctggtggaggggccgattcaccatctccgacagacaacgccaagaaatcaatctttttgcaaatgaacagtctgagagtcgaggacacggccatgtattactgtacgagagaacagacttgggccaggaaccctggtcaccgtctcctcagccctccaccgaacgggcccacgtccggtccttcccccgtggcccgtccctcgcctcccgagggtacgcctacccgtccggaagacgccgaactacggcccggtaccccgtggggccttaccggccgttacgggtaaccgtaaacgggtaccttaacccgttaccctaacgttaccttaaccaaccgttaccgttacgggaacgggtccggggtccctaggggaacccgtaaaggggcccgtaacgtaacgtaggcagctcgacnngnn

SEQ ID NO: 78515 - DNA, 578 bp, Homo sapiens
  misc_feature: GYAE6OF01AOP6Z.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccggtgacgggccggttcaccgtctccagagacaattccaagaatacggtctatctggaaatgaacagcctgagagccgaggacacggccctctattactgtgcgagagatcgagacggagtatagcagcagctcgtgactcgtcggggccacggaccctggtcaccgtctcctcacgcctccaccgacggccacgtcgtcccttccccgtcgccaccctcctaccgaacgacgccgacctcgtcggggccacgacggccggtcccgtcgggctcggccttcggtaccaacggtcctaccgttaccacttaccgtacactaccgtgacggcgggcgtacgggcgaaggcgcgtagtacg

SEQ ID NO: 78516 - DNA, 694 bp, Homo sapiens
  misc_feature: GYAE6OF01DC551.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgaaggccgtcacatctcaggacaattccaagaacacactgtctctgcaaatgaacagcctgagagtcgaggacacggccttatattactgtgtagaaggtacctctacgtccccttatacgctacgcggtctcggtccttaggttactttggaaccgtacgtcgggggaccaacgggtaaccctgggtaccaccggttctcccgtacgacgtcccctaccgaccgtaaccgggccctaacgttccggttcccttccccccgtgggtccccgtcccgtacggcccgttacccgaacggaccaccgaaccccttaccggaacgaccggacgaccggacggtcccggtcccgtcgggtccctcgggcccgttggtaccgtaaacgggtaacccttaccgttcccgaacttaccctaaccgtaacccgttaccgtacggacgggtacccgggcggttaccgggaccggtaacggg

SEQ ID NO: 78517 - DNA, 597 bp, Homo sapiens
  misc_feature: GYAE6OF01DG3B3.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggcgttcaccgtctccagagacaattccaagaatacggtctatctaggaatgaacagcctgagagccgaggacacggcctctattactgtgcgagagatcagacgagtatagcagcagctctgacgtacgtcgggggaccacgggaaccctggtccaccgtctcctcacgccctaccaaccgaacgggcccacgtccggttcccttcccccgtcggcccacccctccctaccaacgacgccacccgtcggtcggggaccacgcgccggcccgtgggcctcgccgtcggtccgaaacggtaccttacttcccgtacttaccgtaacctaacgttacgtggacggcgggccgtcggacgaggcgcagtacg

SEQ ID NO: 78518 - DNA, 626 bp, Homo sapiens
  misc_feature: GYAE6OF01AQBPH.37.26.C04.1.454.CMB.1.raw
  modified_base (242)..(242): a, c, t, g, unknown or other
  misc_feature (242)..(242): n is a, c, g, or t
  modified_base (312)..(312): a, c, t, g, unknown or other
  misc_feature (312)..(312): n is a, c, g, or t
  modified_base (322)..(322): a, c, t, g, unknown or other
  misc_feature (322)..(322): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtcnccagagacaattccaagaatacggtctaatctggaaaatgaacagcctgagagccgaggacacggccctntatttactgngcgagagatcaggacggatatagcagcagctctgactacggtgggcccaacggaccctggccaccgtctcctacacgccctccaccgaacggcccagtcccggtcccttccccgcggcccacccctccctaccgaacgacgcccacccgtcggtacggggaccacgacggcccggccccgtggggtcctcggaccgtcggtacgaacggtaccttaccttacctaacgttaccctaaccgtaaccttaaccgtacggaccgggtccgggacgttaccggggactaacgggcgtacgtagtacgg

SEQ ID NO: 78519 - DNA, 586 bp, Homo sapiens
  misc_feature: GYAE6OF01ENRJL.37.26.C04.1.454.CMB.1.raw
  modified_base (363)..(363): a, c, t, g, unknown or other
  misc_feature (363)..(363): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaaatgaacagcctgagagccgaggacacggcctctattactgtgcgagagatcagacggagtatagcagcagctctgactacgnggggcccacggaaccctggtccaccgtctcctcacgccctccacccaacgggcccacgtccggtccttcccccgtcggcctacccctccctccaagacgcctacccgtcgtcgggggcacgacgaccggcccgtcgggtcctcggccgtcggtacgaacggactaccgttccaatcctaacctactacgtcggacggcgggcgtcggacgaaggcgcgagtag

SEQ ID NO: 78520 - DNA, 776 bp, Homo sapiens
  misc_feature: GYAE6OF01C0JHC.37.26.C04.1.454.CMB.1.raw
  modified_base (272)..(272): a, c, t, g, unknown or other
  misc_feature (272)..(272): n is a, c, g, or t
  modified_base (316)..(316): a, c, t, g, unknown or other
  misc_feature (316)..(316): n is a, c, g, or t
  modified_base (351)..(351): a, c, t, g, unknown or other
  misc_feature (351)..(351): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaagggctgggagtgggtctcaggtattacgtggtagtggtaataccgcatactacgcagactccgtgacgggccgttcaccgtctccagagacaattccaaagaatacggtntatcgtaggaaatgaacagcctagagagccgagaccacggcctntattctgtgcgagagatcgaaggtacggaagttanacggacagcaagccttcgtaacggtactacggtcggggaccctaaacccgggtacccgttcgggtccctacccggttcctcccttacgaccgtcccctacccgacccgaacgggtaccccctacggttccccggttaccccgttcccccgttccggaccccctaccccgttacccgtaaccccgtaaacggtaccgaccctaaccccggtccgggttaccgggggaccccgtaacccggacccgggtcccgggaccccccgggttacgggggtccccgttccgggtacccggttaccgggtacgtaaacccgggtaccctttaacccgttaccctaaccgttacccttaaccgtaacccgttacggtacggaccggggcccgggtacggtaccggtaaccggaacgggtcccgtaacgtagtacg

SEQ ID NO: 78521 - DNA, 613 bp, Homo sapiens
  misc_feature: GYAE6OF01A1XPH.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcacgcctccaccaacgggcccatccgtccttccccctggccacccctccctccaagacgccaccctcgtcgggggccacgacggccgggccccgtcggggcctcggcccgttgggtaccgaaacgggtaccttaccgtttaccccgaacttccgtaacctaacccgttaaccttcggaaccggccgggggccttcggggacgaaaggggccgcgaagtacgg

SEQ ID NO: 78522 - DNA, 591 bp, Homo sapiens
  misc_feature: GYAE6OF01CP9E2.37.26.C04.1.454.CMB.1.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (311)..(311): a, c, t, g, unknown or other
  misc_feature (311)..(311): n is a, c, g, or t
  modified_base (566)..(566): a, c, t, g, unknown or other
  misc_feature (566)..(566): n is a, c, g, or t
  modified_base (586)..(587): a, c, t, g, unknown or other
  misc_feature (586)..(587): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctgggagtgggtctcgaggtattacgtggtagtggtaataccgcatactacgcagactccgtgacggccgttcacgtcncaganacatccaagactacggtctatcgtaggaaatgaacagcctgagagccgagaccacggcctntaattactgtcgcgaagagatcgaggacggtagtatagcagcagctcgtagactacgcgggacctaacggacctggtaccaccgtctcctacgacgccctaccgaccgaacggccctacgtccggtcccttccccgcgtaccctaccctccctaccgaacgccgacctaccgtcggtcgggaccacggacggccggtcccgtgggtcctcgtccgtacggtacgaacgtactacctaccactacctactactacngacgcggcgtcggacaggcnngtag

SEQ ID NO: 78523 - DNA, 666 bp, Homo sapiens
  misc_feature: GYAE6OF01CX1GA.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccggttcaccgtctccagagacaattccaagaatacggtctatctaggaaatgaacagcctgagagccgaggacacggcccctctattactgtgcgagagatcagacggagtatagcagcagctctgaactacgtcggggcccacgggaaccccttggtccaaccggtcctcccttacacggccctacccaacccgaacggggccccacgttcccgggtccctttcccccccgtgggtccccaacccccttcccctaccctaaaacggaccgaccctaaccccgttccgttcggggggacctaaccgaacggcccgggacccccgtggggtccgtcggtcccgttcgggttaccgaacggtaaccttacccttccacgttccgtaacaccgttactcggacggccgggcgtacgggaccgaagggccgacgagtaacg

SEQ ID NO: 78524 - DNA, 545 bp, Homo sapiens
  misc_feature: GYAE6OF01DTTR8.37.26.C04.1.454.CMB.1.raw
  modified_base (540)..(541): a, c, t, g, unknown or other
  misc_feature (540)..(541): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggcaccgtctcctcagccctccaccaaggcccatccggtcttcccctggccaccctccctccaacgacgccaccctcgtcggggccacgacgccggcccgtgggcctgccctggcgaacggactactccatctaccactactgacgcgggctcggacaggcgnngtag

SEQ ID NO: 78525 - DNA, 641 bp, Homo sapiens
  misc_feature: GYAE6OF01B2JWR.37.26.C04.1.454.CMB.1.raw
  modified_base (637)..(638): a, c, t, g, unknown or other
  misc_feature (637)..(638): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtggccaaacataaagcaagatggaagtaagaaggagtatgtggactctgtgaagggccgtttcaccatctccagagacaacgccaagaactccgtgcatctgacaaaatgaacagtctgagagccgaggacacggcttatttatactgcgcgagagaaggactgggcgtttcgactacgtggggccaagggaaccctggtccaccgtctcctcacgccctaccaaccgaagggcccctagtccggtcccttcccccgtggcccgcccctcgccgtcccgacgggacgccgaccctaccggacgacgaccacgacggcccgggtcccgtcgggcctcggacccgttcgggtaccgtaaacgggtacccttaccgtttacccacgttaccctaacccgtaacctaccgttacgggacgggccggggtcgtacggggaccgaacggggccggacctaagtacggnngcg

SEQ ID NO: 78526 - DNA, 604 bp, Homo sapiens
  misc_feature: GYAE6OF01C1ZQ7.37.26.C04.1.454.CMB.1.raw
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (346)..(346): a, c, t, g, unknown or other
  misc_feature (346)..(346): n is a, c, g, or t
  modified_base (596)..(596): a, c, t, g, unknown or other
  misc_feature (596)..(596): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccgaggggaaggggctggagtgggtctcaggtattactggtagtggtaataccgcatactacgcagactccgtgacgggccgttcaccgtctccagagacaattccaaagaatacggtctatctaggaaatgaaacagcctgagagccgaggacncggccctntattactgtgcgagagatcagacggagtanagcagcagctctgactacgtggggcccaacggaaccctggtccacgtcctcctcacgcctaccaccgacgggcccacgtccggtcccttcccctcggaccctacccctccctaccgaacgacgccaccgtcggtcggggccacgacggccggtcccgtcgggctcggccgttcggtacgaacggtaccttacctcctactccgtaactacgttacgtcggacgggccgggcgtacgggaccgagggccgngtagtacg

SEQ ID NO: 78527 - DNA, 583 bp, Homo sapiens
  misc_feature: GYAE6OF01BWKQ2.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggagtatagcagcagctctgactacgtggggccacggaccctggtcaccgtctcctcagcctccaccgaacggcccagtccggtcccttccccgtcggcctacccctcctccaacgacgccacctcgtcggggccacgacggccggcccgtggggcctcgccgttcggtaccaacggtaccttaccttccacttaccgtactaccttactcggaacggcgggcgtcgggacgaagggcgcgtagtacg

SEQ ID NO: 78528 - DNA, 635 bp, Homo sapiens
  misc_feature: GYAE6OF01A7D77.37.26.C04.1.454.CMB.1.raw
  modified_base (188)..(188): a, c, t, g, unknown or other
  misc_feature (188)..(188): n is a, c, g, or t
  modified_base (258)..(258): a, c, t, g, unknown or other
  misc_feature (258)..(258): n is a, c, g, or t
tcagtagtgtagatcacgaccggtgctcgatttagtctagcgactttgggtttgggggaggcttggtacagccgtgggggtcccgtgagactctcctgtgcagcctcttggtttcattctttagcaactacgccatgagcgtgggtccgccaggctccgaggggaagggctggagtgggtcggccaanataaaggcaaagatggaagtgaagaaatactatggtcggactcgtgtgaagggccgtattcaccattccnccagagaccaaccgcccaagactcattgtatctgcaaatgaacagactgagagacgaggacacggctgtgtattacgtgtggcgagaggacggaggacgtagttagtcggtaaagtgggacgtgggtcccttataactacgtaactactacgtagtcggtacgtacgtcgggtacgaaacgggtaccaccggtacgtacccgtccgtccgtcctacggcctacccgaccgaacgggccctacgtccgtccttacccccgtcgccctaccctccctaccgacgaccgacctaccgtccgtacgggcaaccgcggccggtacccgcgggcgtcgtccggcgtaacgacggtacttacccgttacccatccgtctaaccg

SEQ ID NO: 78529 - DNA, 631 bp, Homo sapiens
  misc_feature: GYAE6OF01BNG2U.37.26.C04.1.454.CMB.1.raw
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
  modified_base (367)..(367): a, c, t, g, unknown or other
  misc_feature (367)..(367): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcgaggtattactggtagtggtaataccgcatactacgcagactccgtgacgggccgttcaccgtctccagagacaattccaaagaatacggtctatctaggaaatgaacagcctgagagccgaggacacggccctntattacngtgcgagagatcgaagacggatatagcagcagctcgtagactacgnggggccaaccggaacccttggtaccaccgttctcctcacgccctcccgaaccgacgggacccctagtccggttcccttcccccgtcggaccctacccctccctacctaacgacgcccgtaccgtcggtacggggaccaccgtacgcccggcccgtggggtcctcggtcccgtacggtacgaacggtacctaccttacctactaccgtaactacgttaacgtcggacggtccgggacgtacgggaccgaagggccgacgagtacg

SEQ ID NO: 78530 - DNA, 564 bp, Homo sapiens
  misc_feature: GYAE6OF01B5YKL.37.26.C04.1.454.CMB.1.raw
  modified_base (328)..(328): a, c, t, g, unknown or other
  misc_feature (328)..(328): n is a, c, g, or t
  modified_base (543)..(543): a, c, t, g, unknown or other
  misc_feature (543)..(543): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtggggtctcaggtattactggtagtggtaataccgcatactacgcagactccgtgacgggccggttcaccgtctccagagacaattccaaagaatacggtatatctggaaatgaacagcctgagacgccgaggacacggccctctatactgtgcgagngatcgagacggagtatagcagcagctctgactacgtggggcccaacggaacctggtccaccgtctcctcacgcctaccgaccgacggcccacgttccggttccccttccccgtcggccctacccctccctaccgaacgcgccaccgtcggtcggggccacgacgccggcccgtcgggctcgcgtcgtacgacgtactactccatcctacactcgngagcggcgcgacgagcngntg

SEQ ID NO: 78531 - DNA, 654 bp, Homo sapiens
  misc_feature: GYAE6OF01EF54K.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccgttcaccgtctcagagacaattccaaagaatacggtctatctaggaaatgaacagcctgagagccgaggacacggccctctattactgtgcgagagatcgagacggatatagcagcagctctagactacgtcggggacccacgggtaaccctggtccacccgtctcctcacgccctcccaaccgaacgggccccacgttcccggttacccttcccccgtcggcccctacccccgttccctaacccgaacgaccgtacccacccgttcggtacgggggccaaccgacggtcccgggccccgtgggtcctccggccgttaggtaccgtaacggtaccttaccgttacccaacgtttaccctaaccgtaccgttaccgtggaccggggcgggtccgtacgggaccgaagggccgacgtaggtacg

SEQ ID NO: 78532 - DNA, 603 bp, Homo sapiens
  misc_feature: GYAE6OF01D2X69.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaacacactgtctctgcaaatgaacagcctgagagtcgaggacacggccttatattactgtgtgaagggacctctacgccccttaatagcagcggctggtcctggtacttgacgacgtgggccagggaccctggtccaccgtctacctcacgccctaccaaccgaacgggcccctacgtccggtcccttcccccgcgggcccgcccctcgccctcccgaaggacgccacccgtccgaagacgacaccgacggccggtcccgtgggctcggccgttggaccgtaaggacccttaccttcccacttcctaactaccgtacgtgacggccgggtctcgggcgaacggg

SEQ ID NO: 78533 - DNA, 549 bp, Homo sapiens
  misc_feature: GYAE6OF01AZZWS.37.26.C04.1.454.CMB.1.raw
  modified_base (512)..(512): a, c, t, g, unknown or other
  misc_feature (512)..(512): n is a, c, g, or t
  modified_base (541)..(549): a, c, t, g, unknown or other
  misc_feature (541)..(549): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaacacgctctatctgcaaatgaacagcctgagagccgaagacacggccgtatattactgtgtgaaaggctggggatggggggactacgtggggccagggaaccctggtcaccgtctcctcacgcctccaccgaaagggcccatcggtccttccccctggccacccctcctccaagacgccacctcgtcggggcacgacgcggccctgggcctcggccctggtcaacggactaccgttcatctacaccttacngacggcgggctggcgaacggcgacatagnnnnnnnnn

SEQ ID NO: 78534 - DNA, 718 bp, Homo sapiens
  misc_feature: GYAE6OF01CGMB4.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgaccgggccgttcaccgtctccagagacaattccaaagactacggtctatctggaaatgaaacagcctgagagccgaggaccaccggccctctattacctgtgcgagagatacaggacggagtatagcagcagtctcgtgaacctacgtcggggccaacgggtaaccctggtccacccgtctcctcacgccctaccacccgaacggcccctacgttccggttccccttcccccgtcggacccctaccccgttccctacccgaacgaccgtcccaacccgttccggtcgggggacctaccggaccggcccggtcccggtacgggtccgtccggtcccgttcgggtacctaaaccggggtaacccttaacccgttacccgtaaccgtttacccgtaacccgtaaacccgttaacccgttacgggtaaacccgggtcccggggtaccggtttacggggacccgtaaacggggtacccggtaaccgtaacggtaaacgg

SEQ ID NO: 78535 - DNA, 613 bp, Homo sapiens
  misc_feature: GYAE6OF01BL5CK.37.26.C04.1.454.CMB.1.raw
  modified_base (308)..(308): a, c, t, g, unknown or other
  misc_feature (308)..(308): n is a, c, g, or t
  modified_base (358)..(358): a, c, t, g, unknown or other
  misc_feature (358)..(358): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccggttcaccgtctccagagacaattccaagaatacggtctatctggaaatgaacagcctgagagcgaggacacggcctntattactgtgcgagagatcgagacggatatagcagcagctctgactacgngggccaacggacctggtcaccgtctcctcgacgcctaccgaccacggccctacgtccgtccctccccgtcggccctacccctccctcccgaaacgaccgccgaccgtcggtcggggaccacgacggccggacccgtcgggtccgtcggcccgtacgggtaccgaacgggtaccttaccgttacctaacttaccgtaacctaccgttaacgtcggacggccgggtacgtacgggacgtaacggcgcgtaagtacgg

SEQ ID NO: 78536 - DNA, 546 bp, Homo sapiens
  misc_feature: GYAE6OF01DFL4J.37.26.C04.1.454.CMB.1.raw
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
  modified_base (541)..(541): a, c, t, g, unknown or other
  misc_feature (541)..(541): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctntatttacngtgcgagagatcagacggagtatagcagcagctctgactacgtggggccacggaaccctggtcaccgtctcctcacgcctccaccacggccatcgtccttccccgtcggccacccctcctccaacgtacgcaccctcgtcggggcacgacgccggcccgtgggctcgcctggtcaagacctactccatcctacactacgtgacgcgggcgtcggacaggcgcngtacg

SEQ ID NO: 78537 - DNA, 1095 bp, Homo sapiens
  misc_feature: GYAE6OF01C33BV.37.26.C04.1.454.CMB.1.raw
  modified_base (306)..(306): a, c, t, g, unknown or other
  misc_feature (306)..(306): n is a, c, g, or t
tcagtagtgtagatcacgaccggtgctcgatttagtctagcgactttgggtttgggggaggcttgggtacagccgtggggggtcccggtgagactctcctgtcgcagccgtctggtttcattacttttagctaactacgccatgagctgggtccgccaggctccgagggaagggctggagtgggtctcgaggtattacgtggtagtggtaagtaccggcatactacgctagacctccgtaggaccgggtcccgttcgaacccggtcgtcccaagtagtacaattccaaagtaatacggtactaacnctaggaaattgaacctagaccctaagaggaacgccgacggacacggccccttagtaacgttaacctggtcgacgtaagtaagtacgttacgaaggaaccgggtaagtacgtaacggaccgtaacgggccgtaaaccggtctttacccgtaacggtaaacccgtttaccggggtacccggggggaaccccgtaaacccgggggtaaccccgtttcggggtaccccgttaaacccccggtttccctttaccccgttaccgaacccggtccccccgtttaacccccgaaacccccggaaaccccggggggtacccccctaaaccggtttccccggggtttacccccccgttttacccccccggtaaccggggtcccccggtaccccccgtttacccggtaacccccgtttaaccccgggaaaccgggacccggtaacccccggtaacccccggtttaccccggggaaacccggtaaacccgggacccgtaaaccccggaacccgggggtaccccccggggttaccccggggtaccggggggtttaccccgtcccccggggtttaccccgggtttaacgggggttaaaacccccgggttaaaacccgggttaaaccccgtttttaaacccccgtttaacccggtttaaacccgttttaacccccgttttaaaccccggttaaaacccggtttaacccgggttaaccggggaacccgggggttaccccgggggttaacccgggtttacccgggggaaaccccgggtaacccggggtaccccggttaaacccggg

SEQ ID NO: 78538 - DNA, 637 bp, Homo sapiens
  misc_feature: GYAE6OF01CI7MC.37.26.C04.1.454.CMB.1.raw
  modified_base (313)..(313): a, c, t, g, unknown or other
  misc_feature (313)..(313): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccgttcaccgtctccagagacaattccaaagaatacggtctatctaggaaatgaacagcctgagagccgaggacacggccctntattactgtgcgagagatcagacggagtatagcagcagctcgtgactacgtggggccaacggaacctggtaccaccgtctccctcacgccctaccaaccgaacggccctacgtccggttcccttccccgtcggccctacccctccctaccgtaacgacgccacccgtcggtcggggaccacgacggccggcccgtcgggtccgtcggtccgttacggtaccgaaacggtaccttaccgttacctaacgttacccgttaaccgtaccttacggtacggacgggtccggggtaccgtacgggaccgaacgggaccgacgtagtacg

SEQ ID NO: 78539 - DNA, 771 bp, Homo sapiens
  misc_feature: GYAE6OF01D8KPW.37.26.C04.1.454.CMB.1.raw
  modified_base (312)..(312): a, c, t, g, unknown or other
  misc_feature (312)..(312): n is a, c, g, or t
  modified_base (340)..(340): a, c, t, g, unknown or other
  misc_feature (340)..(340): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattacgtggtagtggtaataccgcatactacgcagactcgtgacgggccgttcaccgtctccagagacaattccaaagaatacggtctatctaggaaatgaacagcctgagagcgaggacacggccctntattactgtgcgagagatcagcggatanagcagcagctctcgactacgtcggggacccaaccgggaaccctggtccacccggttcctcccgtcacgcccctacccgaacccgtaaccggggcccctagtcccgggttacccctttcccccgtccgggtaccctaccccccgttacccttacccgaaacggtaccgacccgtaaccccgtttccggttacgggggtacccaacccggaaccgggtccccggggtccccggttcgggggtcccgttccgggcccggtttacgggtacccgaaaacggggttaccctttaaaccccggtttaccccttaaaccgtttaccccgttaaacccgtaaccccgtttaacggttaccggggaaaccggggtcccggggggtacccgtttacggggaacccggtaaaacggggttccccggagttaaaccgtaaggg

SEQ ID NO: 78540 - DNA, 577 bp, Homo sapiens
  misc_feature: GYAE6OF01DU47F.37.26.C04.1.454.CMB.1.raw
  modified_base (313)..(313): a, c, t, g, unknown or other
  misc_feature (313)..(313): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctaggaaatgaacagcctgagagccgaggacacggccctntattactgtgcgagagatcgagacggagtatagacagcagctctgactacgtggggccaacgggaaccctggtccaccgtctcctcacgccctacccaaccgaacgggacccctagtccggtcccttccccgtcggcctacccctcctaccaacgacgcctaccgtcgtcggggccacgacgccggcccgtgggctcgcctcggtcaacggtacctacctccatctacactactcgacgcggcgtcggacgaggcgcgagtacg

SEQ ID NO: 78541 - DNA, 598 bp, Homo sapiens
  misc_feature: GYAE6OF01DPEKS.37.26.C04.1.454.CMB.1.raw
  modified_base (252)..(252): a, c, t, g, unknown or other
  misc_feature (252)..(252): n is a, c, g, or t
  modified_base (317)..(317): a, c, t, g, unknown or other
  misc_feature (317)..(317): n is a, c, g, or t
  modified_base (543)..(543): a, c, t, g, unknown or other
  misc_feature (543)..(543): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctggagtgggtctcgaggtattactggtagtggtaactaccgcatactacgcagactccgtgacgggccggttcaccgtctccagngacaattccaaagaatacggtctatctaggaaatgaacagcctgagagccgaggacacggccctntattacgtggtgacggagagatcgaagacggtagtatagcagcagctcagactacgcggggaccaaccggaccgtggtcctacccgtctcctcgacgccctacccaccgacggccctacgttccggtccccttccccgcggccctacccctcctaccacgacgcctaccgtcggtcgggcacgcgccggccgtcgggctcgtcgtcggtacgaacggtaccttacncctactcctactacgacgtcggcggccggtacgtcggacgacggcgcgtagtacg

SEQ ID NO: 78542 - DNA, 584 bp, Homo sapiens
  misc_feature: GYAE6OF01A56H1.37.26.C04.1.454.CMB.1.raw
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
  modified_base (578)..(578): a, c, t, g, unknown or other
  misc_feature (578)..(578): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctgggagtgggtctcaggtattacgtggtagtggtaatccgcatactacgcagactccgtgacgggccgttcaccgtctccagagacaattccaaagaatacggtctaatctggaaaatgaaacagcctggagagccgaaggacacggccctntattactgtgcgaganatcagacggatatagcagcagctctgactacggcggggaccaacggaaccctgggtccaccgtctcctcacgccctaccaccgacggccctagtccgtccctccccgtcgccctacccctcctaccaagacgccaccgtcgcggggccacgacggccggtcccgtcgggtctcgccgtcggtacgaacggtacctacctcctactacctactactacgtggacggcggacgtcggacgaggccngagtag

SEQ ID NO: 78543 - DNA, 682 bp, Homo sapiens
  misc_feature: GYAE6OF01AW91T.37.26.C04.1.454.CMB.1.raw
  modified_base (351)..(351): a, c, t, g, unknown or other
  misc_feature (351)..(351): n is a, c, g, or t
  modified_base (394)..(394): a, c, t, g, unknown or other
  misc_feature (394)..(394): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagatacggtctatctggaaatgaacagcctgagagccgaggacacggccctctattactgtgcagagtatcagacggagtatagcagcagctcngactacgtgggccacggaaccctggtccaccgtcctcctcacncctccaccgaacggcccaacgtcggtcccttaccccgtcggccctaccctcccgtacccgtaagacgacctaccctcggtacggggtaccaacgtaaccggccgggtcccccggttacggggtccttaccggtcccgttacgggtaccgtaaaacggttaacccgttaacccgtttacccgtaaacttacccgtaaaccgttaacccgttaaaccgttccgggaaccgggtcccggggtaccgttacggggacccggtaaaaggggccccggtaacgtaaaggtaacg

SEQ ID NO: 78544 - DNA, 639 bp, Homo sapiens
  misc_feature: GYAE6OF01DVJ3D.37.26.C04.1.454.CMB.1.raw
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccgttcaccgtctccagagacaattccaagaatacggtctatctaggaaatcgaacagcctgagagccgaggacacggcctntattacngtgcgagagatcagacggatatagcagcagctcgtgactacgtggggaccaacggaacctggtccaccgtctcctcacgcctaccgaccgaacgggccctagttccggtaccctttcccccgtacgggtcccgtccccgtcgcctaccgacggtacgcccgtacccgtacggacgacgccaacgaccggaccgggtcccgtagggtcctcggcccgttcggtaccgaacgggtacccttaccgttacccgtacgttaccctaacctaccgttaccgtacggaacgggtccgggtacgttagggaccgaagggccgtaacg

SEQ ID NO: 78545 - DNA, 842 bp, Homo sapiens
  misc_feature: GYAE6OF01CZNBF.37.26.C04.1.454.CMB.1.raw
  modified_base (251)..(251): a, c, t, g, unknown or other
  misc_feature (251)..(251): n is a, c, g, or t
tcagtagtgtagatcacgaccggtgctcgatttagtctagcgactttgggtttgggggaggcttggtacagcctggggggtccctgagactctcctgtgcagcctctggtttcattctttagcaactacgccatgagcgtgggtccgccaggctccgagggaaggggctggagtgggtctcaggtattactggtagtggtaataccgcatactacgcagactccgtgacgggccgttcaccgtctccaganacaattaccaaagaatacggtctaatcgtaggaaaatggaaaccagtaccctaggaagacggacccggaaggaaccgaaccgggtcccccttacttaagtttaaccgtggtcggacggaagtaaggaactccgaaaaggaaccgggtaagttaaagtacggcaaggccgaacgtccttacgagtaaccgtaaccggtcgggggaccccaaaccggggtaaacccttgggtacccgtaaccccggttcctacccttcgaaccgtcccctaccccgaacccgaaacgggccccgtaacggttcccggttacccccgtttcccccgtaccgggacccctaacccccttaccccgtaacccgaaacgaccgacccgtaaccccgttccgggttaccgggggaccgaacccgaaccgggccccgggtccccgggtccggggtccgttaccgggacccgttacgggtaccgaaaacgggttacccttaaacccgtttccctaaccttaccctaaaccgtaaccgttaaccgtacgggaaccgggtccggggtacccggtacgggaaccggaaacggggcggtaaccgtaagtaacgg

SEQ ID NO: 78546 - DNA, 916 bp, Homo sapiens
  misc_feature: GYAE6OF01EFMST.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaagggctggagtgggtccagtagtactgtagtagtagtaccgcgatactacgcgacgacgtccgtcggacgggaccgggttccgtaccgtaccgtccagagaacgaacttaacctaacgaaagtaacggttaccgttactacgtacggtaaaagtaacgtaacgaaacgtccgtcgtaggaacgaccggacggaacgaaccggccccgtacccttatttaacgtcgtggacgtaacggaagtaacgtacgtaggaacgggtaacggttaattaacgaccgaacggcgaacgaccgttccgttacggtacgtaacccgttaccgggggacccgtaacccgggaaaccccgtttcggttacccgtacccgtacccgtttcccgtccgtaaccggaccccttacccccgtaacccggaaaccggggtacccccgtaccgtttacccgggtttacccccgttttacccccccgttccccggggaaccttacccccccctttaacccccggttaccccgaaaaccgggtaaaccgacccccgttaaccccccgggtttacgggttacccgggggggacccggaaccaacccgggtcccggggtaccccccgggttcggggtacccgtacgtccccgggttacgggtacccaaaacgggtaacccgtttaaccctttccccggtataacccggttacctaaaccgttacgttcggaccggggcggttccggacggtaccggaacgcgggtactaacggtgtac

SEQ ID NO: 78547 - DNA, 570 bp, Homo sapiens
  misc_feature: GYAE6OF01A44XR.37.26.C04.1.454.CMB.1.raw
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (469)..(469): a, c, t, g, unknown or other
  misc_feature (469)..(469): n is a, c, g, or t
  modified_base (565)..(565): a, c, t, g, unknown or other
  misc_feature (565)..(565): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctgggagtgggtctcgaggtattactggtagtggtaaataccgcatactacgcagactccgtgacgggccgttcaccgtctcagagacaattccaagatacggtctatctaggaaatgaaacagcctagaggacgccgaggaccacggcccctntattacgngtgcgagagatcgagacggatangcagcagctcngactacgcgggaccacggacctgtcaccgtctcctcgacgcctacccaccgaacgggccctacgtccgtcccttccccgcggcccaccctccctaccaagccgaccnccgtcggcgggaccacgcgcccggccgtcggtcgtcgccgtcggacaaccggtctaccttcactacacctactcgtcgacgcggcgtcgacgagcngagtg

SEQ ID NO: 78548 - DNA, 735 bp, Homo sapiens
  misc_feature: GYAE6OF01D6070.37.26.C04.1.454.CMB.1.raw
  modified_base (539)..(539): a, c, t, g, unknown or other
  misc_feature (539)..(539): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaagggctggagtgggtctcaggtattacgtggtagtggtaataccgcatactacgcagacctccgtggaccgggtccggttcaccgtctccagacgacaattccagaacactctatatctgacaaatagaacacgcctagacgacgacccggacgaaccgaccggacctaataattatttagttgtacgaccgaaaaccgaacccccgaacggtacgaccaactagttggacgttcgttttacgacttcggtcgggaccgaagggaaccgaacggtaccacccggttcctccgttccgacgtcccgtacccgaaccgtaaccggccctacgttccggtccccttcccccgtggaccctcccgtgtaccctcgacggccncccgtaccccgtcgaacggacgtaccgacgaccggtacccggtccgtacgggtccgtacgtcccgtagggtacccgtaacggtaacccttaccgttacccgaactttaacccgtacccgtaactacccgttcgggaacccggggtcccggtaccggtaccgggaccgtaaaccgggcccgtaaacgtacggtaacg

SEQ ID NO: 78549 - DNA, 602 bp, Homo sapiens
  misc_feature: GYAE6OF01DVTSH.37.26.C04.1.454.CMB.1.raw
  modified_base (207)..(207): a, c, t, g, unknown or other
  misc_feature (207)..(207): n is a, c, g, or t
  modified_base (314)..(314): a, c, t, g, unknown or other
  misc_feature (314)..(314): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaggggctgggagtgggtctcaggtattacgtggtagtggtaataccgnatactacgcagactccgtgacgggccgttcaccgtctccagagacaattccaaagaatacggtctatctaggaaatgaacagcctgagagccgaggacacggccctntattactgtgcgagagatcagaacggagtatagcagcagctcgtagtacctacggtcggggacccaaccgggtaacccgtcggcctacccgtcctccctcaccgccctacccgaccgaacgggcccgtacgtccggttccccttccccgtcggcccacccctccctccaacgcgccacgtcggtcggggcacgacggccggccgtcgggtcgtcgccgtggaccgaacggtacctacttccactcctactacctacgtcgacggcgggacgtcggacgaggcngngtg

SEQ ID NO: 78550 - DNA, 591 bp, Homo sapiens
  misc_feature: GYAE6OF01EYQM2.37.26.C04.1.454.CMB.1.raw
  modified_base (360)..(360): a, c, t, g, unknown or other
  misc_feature (360)..(360): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagatacggtctatctggaaatgaacagcctgagagccgaggacacggccctctattactgtgcgagagatcagacggagtatagcagcagctctgactacgnggggccacggaaccctggtccaccgtctcctcacgccctccaccgaacggcccacgtccggtcccttccccgtcggccacccctccctaccaacgacgccacctcgtcggggcacgacggccggcccgtgggtcctcggccgtacggtaccgaacggtaccgtaccttaccaacttccgtaacctacctaacgtcggacggcgggcgtacgggacaagggcgacgagtacg

SEQ ID NO: 78551 - DNA, 612 bp, Homo sapiens
  misc_feature: GYAE6OF01BJZUU.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactactcggggccacggaaccctggtccaccgtctccctcacgccctccacccaacgggccccacgtccggttccttccccccgtcggcccaccccctccctacccaacgacgaccacccgtcgtcgggggccacgacggccgggcccgtcgggtctcggcccgtcggtaccgaacggtaccttaccgtttcccaattcccgtacctaaccttaccgtcggacggccggggcgtcgggacgaacgggccgcgagtacgg

SEQ ID NO: 78552 - DNA, 565 bp, Homo sapiens
  misc_feature: GYAE6OF01DW2FC.37.26.C04.1.454.CMB.1.raw
  modified_base (310)..(310): a, c, t, g, unknown or other
  misc_feature (310)..(310): n is a, c, g, or t
  modified_base (351)..(351): a, c, t, g, unknown or other
  misc_feature (351)..(351): n is a, c, g, or t
  modified_base (561)..(561): a, c, t, g, unknown or other
  misc_feature (561)..(561): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctntattactgtgcgagagatcagacggagtatagcagcagctngactacgtggggccaacggaacctggccaccgtctcctcagccctccaccgaacggcccagtccggtcccttccccgtcggccaccctcctaccaacgacgccaccctcgtcggggcacgacgccggcccgtgggcctcgccgtggtacgaacggaccttaccttccattccgtactactacgtcggacgcgggcgtcggacaggcgcgngtag

SEQ ID NO: 78553 - DNA, 772 bp, Homo sapiens
  misc_feature: GYAE6OF01A7GAJ.37.26.C04.1.454.CMB.1.raw
  modified_base (249)..(249): a, c, t, g, unknown or other
  misc_feature (249)..(249): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggatccgagggaaggggctggagtgggtctcaggtattactggtagtggtaataccgcatactacgcagactccgtgacgggccgttcaccgtctccaganacaattccaagaatacggtctatctggaaatgaacagcctgagacgccgaggacacggccctatattactgtgcgagagatcagacggagtatacgcaagcgagtactcgtgaaccttaacggtcggggacccaacgggtaacccctgggtacccacccgttctaccctcgaaccgtcccctacccgaacccgaaaccgggtcccctaacgttcccggttaccccttccccccgtacgggacccctacccccgttccccgtaacccgaaacggaccgtacccgtaccccgttccgggtaccggggggtacccaaccggtaaccgggccccgggtccccggtacggggtcccgttccgggtacccggttacgggtacccgaaacggggttacccctttaacccgttacccgtaacgttacccgttaaaccgtaacccgtttaacccggtcgggtaaccggggtcccggggtaccgttacggggaacccggtaaacccggggcccgttaacgtaacggtaaccgg

SEQ ID NO: 78554 - DNA, 657 bp, Homo sapiens
  misc_feature: GYAE6OF01DHGW5.37.26.C04.1.454.CMB.1.raw
  modified_base (350)..(350): a, c, t, g, unknown or other
  misc_feature (350)..(350): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacacagactccgtgacgggccggttcaccgtctccagagacaattccaagaatacggtctatctggaaatgaacagctgagagccgaggacacggccctctattactgtgcgagagatcagacgagtatagcagcagctcngactacgtcggggcccaacgggaaccctcggtaccaccgtcctcctcacgtccctacccaccgaacgggccccaacgttccggtccctttcccccgtcggccctaccctccctaccgaaacgacgccaccgtcggtcgggggcccaacgacggccggccccgtcggggcctcggtcccgttgggtaccgaaacggtacccttacccgtttccctaaacgttacccgttaacctaacccgttaaaccggtcggtacgggcccgggggtaccgttacgggaccgaaacggggccgtaccgaagtaacgg

SEQ ID NO: 78555 - DNA, 608 bp, Homo sapiens
  misc_feature: GYAE6OF01EW4TS.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccggttcaccgtctccagagacaattccaagaatacggtctatctaggaaatgaacagcctgagagccgaggaccacggcccctctattactgtgcgagagatcagacggagtatagcagcagctctgactacgtcggggaccacgggaaccctggtccacccgtctcctcacgccctcccacccgaacggcccacgtccggttccttcccccgtcggccctacccctccctacccaacgacgccaccctcgtcggggccacgacggccgggtccccgtcgggccttcgcccgtacggtacgaacggtacctaccgttccacttccgtaacctaccttacgtcggacggcgggccgtcgggacaagggctcgagtacg

SEQ ID NO: 78556 - DNA, 657 bp, Homo sapiens
  misc_feature: GYAE6OF01AYDO1.37.26.C04.1.454.CMB.1.raw
  modified_base (551)..(551): a, c, t, g, unknown or other
  misc_feature (551)..(551): n is a, c, g, or t
  modified_base (654)..(654): a, c, t, g, unknown or other
  misc_feature (654)..(654): n is a, c, g, or t
tcagtagtgtagatcacgaccggtgctcgatttagtctagcgactttgggtttgggggaggcttggtacagccgtggggggtccctgagactctcctgtgcagcctctggtttcatctttagcaactacgccatgagctgggtccgccaggcctccgaggggaaggggctgggagtgggtctcaggtattacgtggtagtggtaaataccgcatactacgcagctcggtgaccgggccgttcaccgtctccagagacattccaagtaatcggtctaatcgtaggaaaatgaaacacgtcctaggaacggacgccggaacggccgaccggtccccttattacgttaccgtggtcggacgagtgactcgacggaacgagttagagctaaggcctagccttcgacgtaacgttccgcgggggaccctaaccgggtaacccttcgggtcccaccggttccctcccacgtaacgcccctaccaaccggaacggtcccctagtcccgtttcccgttcccccgacggcccctacccctccgtaccgaagcccgtaccncccgttcggacggggccacggccggccggtccgtcgctcgcgttagacgtacgtctactcactactcaggtctcggacggcggtacgacggcgaagggcttgngtg

SEQ ID NO: 78557 - DNA, 841 bp, Homo sapiens
  misc_feature: GYAE6OF01CM7RR.37.26.C04.1.454.CMB.1.raw
tcagtagtgtagatcacgaccggtgctcgatttagtctagcgactttgggtttgggggaggcttggtacagcctgggggggtccctgagactctcctgtgcagcctctggtttcatctttagcaactacgccatgagcgtgggtccgccaggctccgaggggaaggggctgggagtgggtctcgaggtattacgtgggtagtggtaaataccgcatactacgcagacctccggtggacgggtccggttcaccgtctccagagacaattccaaagaatacggtctatctaggaaatgaaacagcctagagagccgaaggaccaccggtccctaatatttaaccgtagtaacgtaaaaagtcggacctaacgggattaagtagtacttaaaccgttagttaggggactttaggttaacctttccggaattccttacgggtcggggggtcccggttcggccctaaccccggttgggtcccgtaacgtttcggttacccttccccgtttaccgaccgtcccccgttaccccgaaacccgtaacccggggggtaccccctaacgggtttcccccggtttcccccgttttccccccggtcgggcccgtccccgtcggtccccttaccgaacgggaccgcccgtaacccggtacccggaagtaaccggaccaccggaaccgggtcccggggccccggttacggggccttccgggtacccgttacgggtaaccggaaaacgggttacccttaaacccggtttacccctaatttaacccgttaaccctaaacccggttacgacgggtaaccgggtcgggggccggttaacgggcgtaaaacggggtcccg

SEQ ID NO: 78558 - DNA, 549 bp, Homo sapiens
  misc_feature: GYAE6OF01D1VGV.37.26.C04.1.454.CMB.1.raw
  modified_base (544)..(545): a, c, t, g, unknown or other
  misc_feature (544)..(545): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgcctccaccaacgggcccatccggtccttcccctcggccacccctccctccaacgacgccaccctcgtcgggggcacgacgccggcccgtgggctgccgtggtcaacggactactccatctacactactgacgcggctcggacaaggcnngtag

SEQ ID NO: 78559 - DNA, 565 bp, Homo sapiens
  misc_feature: GYAE6OF01B01B2.37.26.C04.1.454.CMB.1.raw
  modified_base (560)..(560): a, c, t, g, unknown or other
  misc_feature (560)..(560): n is a, c, g, or t
tcagtagtgtagatcacgaccggtgctcgatttagtctagcgacttttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggaccacggccctctattactgtgcgagagatcagacggagtatagcagcagctctgactacgtggggcccacggaaccctggtaccacccggtctcctacacgccctccaccgaacgggcccacgttccggtcccttcccccgtcggcccacccctccctaccaagacgccacctcgtcggggccacgacgccgcccgtggtcgtcgccgtggtcaacggcctactccatcctacactactgacgcggcgtggacaggcngagtg

SEQ ID NO: 78560 - DNA, 589 bp, Homo sapiens
  misc_feature: GYAE6OF01BKCJT.37.26.C04.1.454.CMB.1.raw
  modified_base (283)..(283): a, c, t, g, unknown or other
  misc_feature (283)..(283): n is a, c, g, or t
  modified_base (309)..(309): a, c, t, g, unknown or other
  misc_feature (309)..(309): n is a, c, g, or t
  modified_base (562)..(562): a, c, t, g, unknown or other
  misc_feature (562)..(562): n is a, c, g, or t
  modified_base (582)..(582): a, c, t, g, unknown or other
  misc_feature (582)..(582): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggagggctggagtgggtctcaggtattactggtagtggtaataccgcatactacgcagactccgtgacgggccggttcaccgtctccagagacaattccaagaatacggtctatctggaaatgaacngcctgagagccgaggacacggccctntattactgtgcgagagatcgagacggagtatagcagcagctctgacttacgtcggggacccaacggaaccctcggtaccaccggttcctcctcgacgccctacccgaaccgaaccgggccctacgttcccggttcccttccccgtcggcccctaccccttcccgaccaacgcgccacccgtcgtcggggcacgcggccggcccgtgggcctcgccgtggacgaacggtctaccttccacttctacctatacgnggacgcggcgtgacgaggcncgagtcg

SEQ ID NO: 78561 - DNA, 668 bp, Homo sapiens
  misc_feature: GYAE6OF01DDZLZ.37.26.C04.1.454.CMB.1.raw
  modified_base (209)..(209): a, c, t, g, unknown or other
  misc_feature (209)..(209): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctggagtgggtctcaggttattacgtggtagtggtaataccgnatactacgcagactccgtgacgggcgttcaccgtctcagagacaattccaaagatacggtctatcgtaggaaatgaacagcctgaagagccgaggaccacggccctatattactgtgcgagagatcgaggacgagtatacgacagcagtctcgtacgactacggtcggggacccaaccgggtaacccctgggtacccaccggttcctacccgtacaccggacccctacccgaacccgaaccgggacccctaacgttccgggttaccccctttcccccgtacggtaccctaccccttacccgtaccgaaacgaccgaccctacccgtcggtcggggaccacgaaccgccgggtcccgtacgggtcgtccggccgttacggtacgaacggtacctacctaccgtactaccgtacctacgtacgtcggacggcggacgtacggacgtacggcacgtagtacg

SEQ ID NO: 78562 - DNA, 608 bp, Homo sapiens
  misc_feature: GYAE6OF01ATJUX.37.26.C04.1.454.CMB.1.raw
  modified_base (511)..(511): a, c, t, g, unknown or other
  misc_feature (511)..(511): n is a, c, g, or t
tcagtagtgtagatcacgaccggtgctcgatttagtctagcgactttggggtttgggggaggcttggtacagcctggggggtccctgagactctcctgtgcagcctctggtttcatctttagcaactacgccatgagctgggtccgccaggctccgaggggaaggggctgggagtgggtctcaggtattacgtggtagtggtaataccgcatactacgcagactccgtgaccgggtccggttcaccgtctccgagagaactaacttccgaaagtaactacggtctaattccgtagggaaaatgaaacacgcctgagacgaccggaggaccaccgggtccctacttaatttacgtggtcgacggagagactcgaggtacggagtatacgcagcagctcagacgtacggtcgggaccacggtaacctggtccaccgtctccctcgacgtccctaccgaccgacggcccgactccgtcccttcccgtcgcccaccctcctaccgacgacgaccnccgtcgcgggcacgcgccgcgtggcgtcgtcgtcgacgtacggactcctctactaccgtactacgtcgtcgacgtcgggcgtcggacgagcgcagcg

SEQ ID NO: 78563 - DNA, 173 bp, Homo sapiens; identical to SEQ ID NO: 78276
  misc_feature: GYAE6OF01CI62B.37.26.C04.1.454.CMB.1.raw
  modified_base (173)..(173): a, c, t, g, unknown or other
  misc_feature (173)..(173): n is a, c, g, or t

SEQ ID NO: 78564 - DNA, 788 bp, Homo sapiens
  misc_feature: GYAE6OF01CJKZ8.37.26.C04.1.454.CMB.1.raw
  modified_base (188)..(188): a, c, t, g, unknown or other
  misc_feature (188)..(188): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaagggctggagtgggtctcaggtattacnggtagtggtaataccgcatactacgcagactcgtgacggccgttcacgtctcagagacaattccaaagatacggtctatctaggaaatgaacagcctgagagccgaggacacggcctctatactgtgcgagagatcagacggagtatagcacgcagactcgtagacgtaacgtggggaccctacgtacgtaaacccgtggtccctaaacccggtcctacccgttaccgaccggtaccccttacccgaacccgaaccgggacccctaacgttcccgggtttccctttaccccccggtcgggtacccaacccccgtttcccgtaacccgaaacggtaccgtacccgaaccccgttccgggtaccggggggtaacccaaccggaaccgggcccgggtaaccccccggtttaggggccccttacccgggtaccccgttacggggttaaacccgaaaacggggttaacccgtttaaaccctttacccggtaaatttacccccggttaaacccttaaaccggttaaacccggtttacgggaaaccgggtcccggggtacccggttacggggaacccggaaaccggggtcccggtaccgttaaacgg

SEQ ID NO: 78565 - DNA, 665 bp, Homo sapiens
  misc_feature: GYAE6OF01EG1F4.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctcagagacaattccaagaatacggtctatctaggaaatgaacagcctgagagccgaggacaccggcctctattactgtgcgagagactcgagacggagtatagcagcagctcgagactacggtcggggaccaaccggtaacccgtcggtacctaccgtctcccgtcacgtccctaccgaaccgaaccggccctacgtcccgtccctcccgtcgacccacccctacctaccgacgaccgacctccgtcggtacggggccacggccggtacccggtcccggtcgggtacccgttccggacccgttacgggtacccgtaaacggtacccttaccgttaccctacgttacccgtaacctacccgtacgttacgggacccgggtcggggtacccgttacggggaccgaacggggccgtaagaacgtacgg

SEQ ID NO: 78566 - DNA, 585 bp, Homo sapiens
  misc_feature: GYAE6OF01D9YFE.37.26.C04.1.454.CMB.1.raw
  modified_base (312)..(312): a, c, t, g, unknown or other
  misc_feature (312)..(312): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctntattactgtgcgagagatcagacggagtatagcagcagctctgactacgtggggcccacggaaccctggtccaccgtctcctcacgccctccaccgaacggcccactccggttccttccccgtcggcccacccctcctacccgaacgacgcctaccgtcgtcggggccacgacgccggcccgtgggtccgtcgcccgtaggtaccaacggtaccttaccttcctactacctactactacgtcggacggcgggcgtcggacgaggcgcgagtag

SEQ ID NO: 78567 - DNA, 626 bp, Homo sapiens
  misc_feature: GYAE6OF01C5RW3.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgaagggccggttcaccatctccagagacaattccaagaacaccctgtctctgcaaatgaacaacctgagagccgaggacacggccctatattactgtaacgaaaatggacctacggatatgactactagttggactgtacttcgatctcgtcggggccgtggcacccgtggtcactgtctcctcacgtccctccaaccgaacgggcccctacgtccggttcccttcccccgtcggcccgcccctgccctccgaggacgccaaccctccgaagacgaccaccgacgcccggcccgtgggcctcggcccgttgggtacccgaaagggtacccttaaccttccctaacttccctaacccgtacgttaccgtcggtaacggccggggtactcgggaaccgtaacggg

SEQ ID NO: 78568 - DNA, 606 bp, Homo sapiens
  misc_feature: GYAE6OF01D7J1K.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcgaggtattactggtagtggtaataccgcatactacgcagactccgtgacgggccggttcaccgtctccagagacaattccaaagaatacggtctatctaggaaatgaacagcctgagagccgaggacacggccctctattactgtgcgagagatcagacggagtatagcagcagctctagactacgtggggcccaacggaccctggtccaccgtctcctcacgcctcccaccgaacggcccatccggttcccttcccccgtggtcccaccccttccctacccaacgaccgccctacccgtcggtacggggccaaccggacggcccgggtcccgtcggggtccgtcgccgtacgggtaccgaaaggtccctacttccacttcgtacctatacgtggacgcggcgtcggacgaacggctaccgagtacg

SEQ ID NO: 78569 - DNA, 626 bp, Homo sapiens
  misc_feature: GYAE6OF01CTEF8.37.26.C04.1.454.CMB.1.raw
  modified_base (313)..(313): a, c, t, g, unknown or other
  misc_feature (313)..(313): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccgttcaccgtctccagagacaattccaaagaatacggtctatctggaaatgaacagcctgagagccgaggacacggcccctntattactgtgcgagagatcagacggagtatagcagcagctctgactacgtggggaccacggaccctggtccaccgtcctcctcacgccctaccaaccgaacgggccccacgttcccggtaccctttccccccgtcggcccacccctcccgtacccgtaaacgaccgacctacccgtcggtcgggggaccacgacgccggcccgtgggcctcgtcccgtacggtcgaacggtaccttaccgttaccctattaccgtaacctaccttaacgtcggacggtccgggtacgtacgggacgtaggccgcgtagtaacg

SEQ ID NO: 78570 - DNA, 689 bp, Homo sapiens
  misc_feature: GYAE6OF01B9OG3.37.26.C04.1.454.CMB.1.raw
  modified_base (294)..(294): a, c, t, g, unknown or other
  misc_feature (294)..(294): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggcctccgaggggaaggggctggagtgggtctcgaggtattacgtggtagtggtaataccgcatactacgcagactccgtggaccgggccgttcaccgtctcagagaacattaccaagaagtacggtctagtctaggaatgaacngcctgagagccgaggaccacggcctatattacgtgtcgcgaagagactcgaaggacgggtattagtacgcagcagtctcgagactacggtggggacccaacgggtaaccctgggaccctacccgttctaccctacgaccgtccctacccgaaccgaccgggtacccctacgttcccggtaccccttccccgtcggaccctaccccgtcccgtaccgaacgcgacccgtaccgtccgggtcgggaccgacggaccgggccgggcccgtcgggtccgtccgccggttaccggtaccgaaacggttcccttaccgtaccgtaacctaccgtaccgttactaaccggttgaacggggtccggtccggtacggacggaaccggacgtacccgtagtacgg

SEQ ID NO: 78571 - DNA, 624 bp, Homo sapiens
  misc_feature: GYAE6OF01D1QY5.37.26.C04.1.454.CMB.1.raw
  modified_base (311)..(311): a, c, t, g, unknown or other
  misc_feature (311)..(311): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattacgtggtagtggtaataccgcatactacgcagactccggtgacgggccgttcaccgtctccagagacaattccaagaatacggtctatctggaaatgaacagcctgagagccgaggacacggcctntatactgtgcgagagatcagacgatatagcagctagctctagactagtcggggaccacggaaccctgggtaccaccgtctccgtcacgtccctccgaacccgaacggcccacgtccggttcccttcccccgtcggccctacccctaccctaccaacgacgccaccgtcggtcggggacacgacgccggcccgtcggtccgtcgtccgtcggtaccgaacggtaccttaccgttaccctaacttaccgtaaccgtaacctaccgtacggacgggccgggtcgtacggacgtaaacgggccgtacgtaagtaacg

SEQ ID NO: 78572 - DNA, 560 bp, Homo sapiens
  misc_feature: GYAE6OF01BMT2J.37.26.C04.1.454.CMB.1.raw
  modified_base (241)..(241): a, c, t, g, unknown or other
  misc_feature (241)..(241): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggcgttcaccgtcncagagacaattccaaagaatacggtctaatctggaaaatgaacagcctgagagccgaggacacggccctntattacngtgcganagatcaagacggagtatagcagcagctntgactacgnggggccaacggaaccctggtcaccgtctccgtnacgccnccaccaaagggccccaagtccggtccttcccctggcctacccctcctacccaaagacgccaacctcgtggggccaacgagcggcccgtgggcctgccctggcaacggactaacttccatccttaacatactgagcggggctcggacaaggcgcgaagag

SEQ ID NO: 78573 - DNA, 697 bp, Homo sapiens
  misc_feature: GYAE6OF01DF95L.37.26.C04.1.454.CMB.1.raw
tcagtagtgtagatcacgaccggtgctcgatttagtctagcgactttggggtttgggggaggcttggtacagcctgggggggtccctgagactctcctgtgcagcctctggtttcatctttagcaactacgccatgagctgggtccgccaggctccgagggaaggggctggagtgggtctcgaggtattacgtggtagtggtaataccgcatactacgcagactccgtgacgggccgttcaccgtctccagagacaattccaaagaatacggtctatcgtaggaatagaacagcctgaagagccgaggacacggcctctattactgtgcgagagatcgagacggagtatagacagcagtctcgtagaactacggtcggggcccaaccgggtaacccgtcgggtacctacccgtcctcccgtacacgcccctaccaacccggaacgggcccctaacgtcccggttacccctttcccccgtcggacccctaacccccttcccgtaacccgaacgtaccgacccgtacccgttcggtcgggggaccaaccggaaccggtcccgggcccccggtacggggtcctcggtccccggttgggtaacccgaagggtaaccccttacttacccgtacttaccgtaacctaccgttaaccgtggaacgggtccgggacgtaccgggacggacggcgcgtaaggtacg

SEQ ID NO: 78574 - DNA, 589 bp, Homo sapiens
  misc_feature: GYAE6OF01E5DJ6.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattcccaaagaatacggtctatctggaaatgaacagcctgagagccgaggacacggccctctattactgtgcgagagatcagacggagtatagcagcacgctctgactacgtcggggaccaaccgggaccctggtcctacccgtcctcctcacgccctaccaccgaacggcccagtccggtcccttccccgtcgcccaccctcctaccaacgcgccaccgtcgtcgggcacgcgcggcccgtcgggtcgtcgtccgtcggtacaacggtacttaccgtcctaactccgtactactacgtcgacggcgggcgtcgggacgaaaggccgacgtagtacg

SEQ ID NO: 78575 - DNA, 663 bp, Homo sapiens
  misc_feature: GYAE6OF01AUHYU.37.26.C04.1.454.CMB.1.raw
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaagggctggagtgggtctcaggtattactggtagtggtaataccgcatactacgcagactccgtgacgggccgttcaccgtctccagagacaattccaagatacggtctatctaggaaatgaacngctgagacgcgagcacgcctntatactgtgcgagngactcgagacgatatagcagcagctcgtgtactacgtcgggacccaacggtacccgtgtacccaccgtcctccctacgaccgtccctaccgaacccggaaccgggtcccctacgttcccggttccccttacccccgtcggaccccttacccctccctaaccgaacgtacccgtaccgacccgtcgggtaccggggcctaacggcccgggtccccggacccgggtcgggtcccgttcggtacccgttcggtaaccgtacggtacccttaccgttaccctacgttaccgtaaccgtaccttacggtaggccggtaccggtcgtacggacgaaggtccacgtagacg

SEQ ID NO: 78576 - DNA, 630 bp, Homo sapiens
  misc_feature: GYAE6OF01A36KQ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccgttcaccgtctccagagacaattccaagaatacggtctatctggaaatgaaacagcctgagagccgaggacacggccctctattactgtgcgagagatcagacggagtatagcagcagctctgactacgtggggccacggaaccctggtccaccgtctcctcacgccctccaccgacgggccacgtcggtccttcccccgtggcccaccccttccctacccgaacgacgccacccgtcgtcgggggaccacgacggccgggtcccgtacggggtcctcggcccgttacggtacgaacggtacccttaaccgttccctacgttacccttaaccgtaccgttaccgtcgggacggtaccgggccgttacgggaccggaaagggcccgacgtacgtaacgg

SEQ ID NO: 78577 - DNA, 547 bp, Homo sapiens
  misc_feature: GYAE6OF01C4C0S.37.26.C04.1.454.CMB.1.raw
  modified_base (394)..(394): a, c, t, g, unknown or other
  misc_feature (394)..(394): n is a, c, g, or t
  modified_base (541)..(541): a, c, t, g, unknown or other
  misc_feature (541)..(541): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccactcgaaccctggtcaccgtctcctcncgcctccaccaacgggcccatccggtccttccccgtggccaccctcctccaagcgccacctcgtcggggcacgagccggcccgtgggctgcctggtcaacggtactacttccatctacactactgagcggtcgtacggcaacggcgngtaacg

SEQ ID NO: 78578 - DNA, 574 bp, Homo sapiens
  misc_feature: GYAE6OF01A3N5U.37.26.C04.1.454.CMB.1.raw
  modified_base (205)..(205): a, c, t, g, unknown or other
  misc_feature (205)..(205): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgnatactacgcagactccgtgacgggccgttcaccgtctccagagacaattccaagaatacggtctatctggaaatgaacagcctgagagccgaggacacggccctctattactgtgcgagagatcagacggatatagcagcagctctgactacgtggggcccacggaaccctggtccaccgtctcctcacgccctaccaccgaacgggcccactccggtcccttccccctcggccaccctccctaccgaagacgcacccgtcgtcggggccacgacggccggcccgtgggctcgcctggtaccaaggtacctaccttccacttcctaacactactcggacggcgggccgtcggacgaaggcgcgagtacg

SEQ ID NO: 78579 - DNA, 589 bp, Homo sapiens
  misc_feature: GYAE6OF01DSTZM.37.26.C04.1.454.CMB.1.raw
  modified_base (395)..(395): a, c, t, g, unknown or other
  misc_feature (395)..(395): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctaggaaatgaacagcctgagagccgaggacacggccctctattactgtgcgagagatcagacggagtatagcagcagctctgactacgtcggggaccaacggaaccctggtccaccgtctccncacgcctccaccgaacggccctactccggtcccttccccgtcggccacccctccctaccaacgacgccaccctcgtcggggcacgacggccggcccgtcgggtctcgtccgtacggtccgaacgtacctaaccttaccacttacctactactacgtggacggcgggacgtcgggaccgaagggccgcgagtacg

SEQ ID NO: 78580 - DNA, 596 bp, Homo sapiens
  misc_feature: GYAE6OF01A0LHL.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggccaacggaacctggtccaccgttcctcctcacgccctccaccgaacgggcccagtccggtccttcccccgtggcccacccctcctccgaagcgccaccctcgtcggggaccacgacggccggcccgtggggcctcggcccgtcggtacaacgggtacttaccttccacttccgtaacctaccttacgtggaacggccggggcgtacgggaccgaagggccgcgtaagtcgg

SEQ ID NO: 78581 - DNA, 567 bp, Homo sapiens
  misc_feature: GYAE6OF01C1HDU.37.26.C04.1.454.CMB.1.raw
  modified_base (452)..(452): a, c, t, g, unknown or other
  misc_feature (452)..(452): n is a, c, g, or t
  modified_base (489)..(489): a, c, t, g, unknown or other
  misc_feature (489)..(489): n is a, c, g, or t
  modified_base (565)..(566): a, c, t, g, unknown or other
  misc_feature (565)..(566): n is a, c, g, or t
tcagtagtgtagatcacgaccggtgctcgatttagtctagcgactttgggtttgggggaggcctggtgcagcctggggggtccctgagactctcctgtgcagcctctggattaatgtttagcaactctggcatgaactgggtccgcaggctccaggcatggggctgcagtgggtctcaagtactagtgctcctggtaatagagcagactacgcagactccgtgaagggccgttcaccatcctccagagacaattaccaagaacacgctctatctgacaaatgaacagcctgagagccgaagacacggcgtatattactgtgtaggaaaggtcgtaggggagtcgggggtactacggtcggggaccgacgggaacccgtggtcctacccgtctcctcgacgtccctaccaccgaacgggcccacgttccgtcccttccccgcgccaccctccnccaacgcgccaccgtcggcgggcacgcggccggccgngggctcgccgtgtacgaacggtactactaccatcctacacgtcgtggacggcgggcgtggacgtaacggcagatgnng

SEQ ID NO: 78582 - DNA, 713 bp, Homo sapiens
  misc_feature: GYAE6OF01BKQET.37.26.C04.1.454.CMB.1.raw
  modified_base (342)..(342): a, c, t, g, unknown or other
  misc_feature (342)..(342): n is a, c, g, or t
  modified_base (367)..(367): a, c, t, g, unknown or other
  misc_feature (367)..(367): n is a, c, g, or t
tcagtagtgtagatcacgaccggtgctcgatttagtctagcgactttgggtttgggggaggcttggtacagccgtgggggtccctgagactctcctgtgcagcctctggtttcatctttagcaactacgccatgagctgggtccgccaggctacgagggaagggctggagtgggtctcaggtattactggtagtggtaatccgcagtacgtacgcagactccggtgacgggccgttcaccgtctccgagagtacaagttccaaagtaattacggtcttaagtcgtaggaaatcggaaacacgcctaggacgacgccggaggaccacggtccttctattacgngtagcgagagatcgagacggtatancgcagcagctcgtagtactaccggtggggacccaacgggtaacccttgggtacccctacccggttcctacccgtacgaccgtacccctacccgaacccgaacgggcccctacgttaccggttacccgttaccccgtcggtaccctacccgttacccgtaccgaacgtaccgtaccgtaccgtaccggtacgggacctacggacgggtacccggtcccggtacgggtcccgtcggtaccggtacggtacggtaaccggtaccgttaccgttaccgtaacgttaccgtaactaccgttacgtcggacggtccggtacgtacggtacgtaacggtccgtacgtagtacg

SEQ ID NO: 78583 - DNA, 594 bp, Homo sapiens
  misc_feature: GYAE6OF01COAF5.37.26.C04.1.454.CMB.1.raw
  modified_base (312)..(312): a, c, t, g, unknown or other
  misc_feature (312)..(312): n is a, c, g, or t
  modified_base (460)..(460): a, c, t, g, unknown or other
  misc_feature (460)..(460): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactgggtagtggtaataccgcatactacgcagactccgtgacgggccggttcaccgtctccagagacaattccaagaatacggtctatctggaaatgaacagcctgagagccgaggacacggccctntattactgtgcgagagatcagacggtagtatagcagcagctctgactacgtggggaccacggaacccgtggtccaccgtctcctcacgcctccaccgaacggcctacgtccgttccttccccgtcgcctaccctccctaccaacgacncctaccgtcggtcggggacacgacgccggcccgtcgggctcgtccgtacggtcaacggtacctacccttaccacttacctaccgtacgtacgtggaccggcgggtccgtcgggtaccgaaggccgcgtagtacg

SEQ ID NO: 78584 - DNA, 577 bp, Homo sapiens
  misc_feature: GYAE6OF01EYZNF.37.26.C04.1.454.CMB.1.raw
  modified_base (388)..(388): a, c, t, g, unknown or other
  misc_feature (388)..(388): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtcncctcacgccctccaccgaacggcccacgtccggtcccttcccctcggcccacccctccctaccaacgacgaccacccgtcgtcggggcacgacgccggcccgtgggctcgccgtcggtacaacggacctaccttccactccgtactactacgtcggacggccgggcgtacggacgaaggcgcgagtacg

SEQ ID NO: 78585 - DNA, 576 bp, Homo sapiens
  misc_feature: GYAE6OF01AN13C.37.26.C04.1.454.CMB.1.raw
  modified_base (318)..(318): a, c, t, g, unknown or other
  misc_feature (318)..(318): n is a, c, g, or t
  modified_base (352)..(352): a, c, t, g, unknown or other
  misc_feature (352)..(352): n is a, c, g, or t
tcagtagtgtagatcacgaccggtgctcgatttagtctagcgactttgggtttgggggaggcttggtacagcctggggggtccctgagactctcctgtgcagcctctggattcaccttcagtagctatagcatgaactgggtccgccaggctccagggaaggggctggagtgggtctcatccattagtagtagtggtacttacatatactacgcagactcagtgaggggccattcaccatctccagagacaacgccaagaactcactgtatctgacaaatgaacagcctgagacgccgagacacggctgtgtattacngtgcgagacgccctccacctcagcagcagcggtnacttcgcgggccaggggaccctgggtccaccgtctcctcacgcctccaccgaacgggccctacgtccgtccttcccccgtggcccacccctcctaccaacgacgccacccgtcggtcggggcacgacgcccggcccgtcgggcctcggccctggtaccgaacggtaccttaccttaccacttccctaaccaccgttacgtcggacggccgggtcgtcggaccgg

SEQ ID NO: 78586 - DNA, 612 bp, Homo sapiens
  misc_feature: GYAE6OF01D3OZ0.37.26.C04.1.454.CMB.1.raw
  modified_base (145)..(145): a, c, t, g, unknown or other
  misc_feature (145)..(145): n is a, c, g, or t
  modified_base (207)..(207): a, c, t, g, unknown or other
  misc_feature (207)..(207): n is a, c, g, or t
  modified_base (364)..(364): a, c, t, g, unknown or other
  misc_feature (364)..(364): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccnccaggctccgaggggaaggggctggagtgggtctcaggtattactggtagtggtaataccgnatactacgcagactccggtgacgggccgttcaccgtctccagagacaattccaaagaactacggtctatctaggaaatgaacagcctgagagcgaggacacggcctctatactgtgcgagagatcgagacggagtatacgcagcagctctgactcgngggccaacggacctggtccaccgttctcctcacgccctaccaccgaacgggcccacgtccgtcccttccccgcggccctaccctccaccgaacgacgccaccgtcgtcggggacaccgacggcccggtccggtcgggtcctcgacccgttcgggtaacgaacggtaaccttacctaccgtaactccctaacctaacgttacgtcggacggccgggtcgtacgggacgtaaacgggcgtacgaagtacg

SEQ ID NO: 78587 - DNA, 619 bp, Homo sapiens
  misc_feature: GYAE6OF01EQS4K.37.26.C04.1.454.CMB.1.raw
  modified_base (204)..(204): a, c, t, g, unknown or other
  misc_feature (204)..(204): n is a, c, g, or t
  modified_base (612)..(612): a, c, t, g, unknown or other
  misc_feature (612)..(612): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgnatactacgcagactccggtgacgggccgttcaccgtctccagagacaattccaaagatacggtctatctggaaatgaacagcctgagagccgaggaccacggccctctattactgtgcgagagatcaaggacggagtatagcagcagctctgactacggtcggggacccaaccgggtaaccctggtaccacccgtctcccgtcacgccctacccaccgaacggcccacgtcccggttcccttcccccgtggcccctaccccgttaccctaccgaaacgtcgaccctaacccgtcggtacggggcaccgacggcccggcccggtgggccgttcgccgttcggacgaaccgggtcttaccttcccaagttcctaactactacgtggacgccgggtactcgggacacggcntagtacg

SEQ ID NO: 78588 - DNA, 758 bp, Homo sapiens
  misc_feature: GYAE6OF01ASO1Z.37.26.C04.1.454.CMB.1.raw
  modified_base (208)..(208): a, c, t, g, unknown or other
  misc_feature (208)..(208): n is a, c, g, or t
  modified_base (288)..(288): a, c, t, g, unknown or other
  misc_feature (288)..(288): n is a, c, g, or t
  modified_base (317)..(317): a, c, t, g, unknown or other
  misc_feature (317)..(317): n is a, c, g, or t
  modified_base (351)..(351): a, c, t, g, unknown or other
  misc_feature (351)..(351): n is a, c, g, or t
  modified_base (416)..(416): a, c, t, g, unknown or other
  misc_feature (416)..(416): n is a, c, g, or t
  modified_base (748)..(748): a, c, t, g, unknown or other
  misc_feature (748)..(748): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctggagtgggtctcaggtattacgtggtagtggtaataccgnatactacgcagactccggtgacgggccgttcacgtctccagagacaattccaagatacggtctatcgtaggaaatgaacngcctggagacgccgaggacaccggccctntattacgtgtgacgagagatcgaaggacggatanacgcaagcagctagtacgacgttacggcggggacccaccgggtaccctgggtacccacccgttcnccctacgaccgtcccctacccgaacccggaaccggcccctacgttcccggttcccctttaccccccgcggtacccctacccccgttccctaacccgaaacggtacccgacccgtaccccggttcgggacccggggtaccgaacccggtaccggggtcccccggggtccccggtccgggggtcccgttaccgggtccccggttacggggtaacccgtaaaccgggttaacccctttacccgttacccgtaacccgttacccgtaacccgtaaccggttaccggtcgggaacccgggtcccggggtccgtacggggacccgtaagggtacccgngtaaacgtag

SEQ ID NO: 78589 - DNA, 617 bp, Homo sapiens
  misc_feature: GYAE6OF01B0XSG.37.26.C04.1.454.CMB.1.raw
  modified_base (399)..(399): a, c, t, g, unknown or other
  misc_feature (399)..(399): n is a, c, g, or t
tcagtagtgtagatcacgaccggtgctcgatttagtctagcgactttgggtttgggggaggcttggtacagcctggggggtccctgagactctcctgtgcagcctctggtttcatctttagcgactacgccatgagctgggtccgccaggctccaggggaaggggctggagtgggtctcaggtattactggtagtggtaataccgcatactacgcagactccgtgacgggccggttcaccgtctccagagacaattccaagaatacggtctatctaggaaatgaacagcctgagagccgaggacacggccctctattactgtgcgagagatcagacggagtatagcagcagctctgactacgtggggaccacggaaccctggtccaccgtctcctcacnccctcccacccaacgggcccacgttcccggtcccttcccccgtcggcccacccccttccctacccaaacgaccgccaacccgttccggtcgggggaccaccgacggccgggccccgttcggggcctcggtccgtcgggtacgaaacggtaccttaccttcccatccgtaacctactaccgttggacggtcgggcgtcgggacgaagggcgacgatacg

SEQ ID NO: 78590 - DNA, 581 bp, Homo sapiens
  misc_feature: GYAE6OF01AYRYW.37.26.C04.1.454.CMB.1.raw
  modified_base (577)..(577): a, c, t, g, unknown or other
  misc_feature (577)..(577): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtgggaccacggaacctggtacaccgtctccctcacgccctccaccgacggcccacgtccggttcccttcccccgtcggcccacccctccctacccaacgaccgccacccgtcgtcggggccaccgacggcccgggcccgtcgggtctcgtccgtggaccgaaggtacctcgttcccatcctacactactggacggtcggcgtcgggacgaaggcagngtag

SEQ ID NO: 78591 - DNA, 583 bp, Homo sapiens
  misc_feature: GYAE6OF01BMCK4.37.26.C04.1.454.CMB.1.raw
  modified_base (246)..(246): a, c, t, g, unknown or other
  misc_feature (246)..(246): n is a, c, g, or t
  modified_base (315)..(315): a, c, t, g, unknown or other
  misc_feature (315)..(315): n is a, c, g, or t
  modified_base (556)..(556): a, c, t, g, unknown or other
  misc_feature (556)..(556): n is a, c, g, or t
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccaggggaaggggctggagtgggtctcgaggtattactggtagtggtaataccgcatactacgcagactccggtgacgggccgttcaccgtcnccagagacaattccaagaatacggtctatctaggaaatgaacagcctgagagccgaggacacggccctntatactgtgcgagagatcgagacggagtatagcagcagctctagacgtacgtcggggcccaaccggaacccgtggtaccaccgtcctcctcacgccctaccaccgaaccgggccctacgtccggtcccttccccgtcggcccaccctccctaccaacgacgccaccgtcgtcggggccacgcgccggccgtcgggctcggccgtcggtacgaacgtctacctcctactacctacactacgngcggcggcgtggacgaggcngngtacg

SEQ ID NO: 78592 - DNA, 595 bp, Homo sapiens
  misc_feature: GYAE6OF01DRPI6.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccatctccaggacaattccaagaacacactgtctctgcaaatgaacagcctgagagtcgaggacacggccttatattactgtgtgaagggtacctctacgccccttatacgcagcggctcggtcttggttacttgacgacgtgggaccgagggaccctggtcaccgtctcctcacgcctcccaccgtaacgggcccagttccggtaccttcccccgtggcccgcccgttcgcctccgaggacgcacccgtccgaacgcgcacgtacgccgccgtggccgtcgccgtcgggtaccacggtacctaccgttaccgacttcctactacgttaccgtggacggcgggtccgtggcgtaaacgg

SEQ ID NO: 78593 - DNA, 701 bp, Homo sapiens
  misc_feature: GYAE6OF01C0QTC.37.26.C04.1.454.CMB.1.raw
  modified_base (322)..(322): a, c, t, g, unknown or other
  misc_feature (322)..(322): n is a, c, g, or t
tcagtagtgtagatcacgaccggtgctcgatttagtctagcgactttgggtttgggggaggcttggtacagcctggggggtccctgagactctcctgtgcagcctctggtttcatcttttagcaactacgccatgagctgggtccgccaggctccgagggaaggggctggagtgggtctcaggtattactggtagtggtaataccgcatactacgcagactccgtgacgggccgttcaccgtctccagagacaattccaaagaatacggtctatctaggaaatgaacagcctgagacgcgaggacacggcctctattactgngcgagagatcagacggagtatagcagcagctctagactacgtcggggaccaaccggaacccgtgtccctaccgtcctcctccacgtccctacccgaacccgaacgggtcccctacgttaccggttcccctttcccccgtacggacccctaccccttacccgtacccgaaacgtaccgacccgacccgttcccgggtacggggggaccaccggtaacgtccccggggccccgttacgggggtcccgttcggcccggttacgggtacccgaaacgggttacccttaaccttcccgtaacttacccgttaaccgtaacccttacggtacggacggggtccgggggtccttacggggaaccgaacgggtccgacgtagtaacg

SEQ ID NO: 78594 - DNA, 602 bp, Homo sapiens
  misc_feature: GYAE6OF01DBXEE.37.26.C04.1.454.CMB.1.raw
  modified_base (206)..(206): a, c, t, g, unknown or other
  misc_feature (206)..(206): n is a, c, g, or t
  modified_base (321)..(321): a, c, t, g, unknown or other
  misc_feature (321)..(321): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgnatactacgcagactccgtgacgggccgttcaccgtctccagagacaattccaagaatacggtctatctggaaatgaacagcctgagagccgaggacacggcccctctatttaccngtgcgagagatcagacgagtatagcagcagctctgactacgtggggccacggaaccctggtcaccgtctcctcacgccctccaccacgggcccatccggtccttcccccgtggccaccctcctacccaagacgccacctcgtcggggcctacgacgcccggacccgtcggggctcggtcccgtgggtaccaacgggtaccttaaccttcccacgttacctaacctaccttaacgtcgacgggccggggaccgtcgggaccgtaagggcccgacgtagtacg

SEQ ID NO: 78595 - DNA, 617 bp, Homo sapiens
  misc_feature: GYAE6OF01CS8N7.37.26.C04.1.454.CMB.1.raw
  modified_base (248)..(248): a, c, t, g, unknown or other
  misc_feature (248)..(248): n is a, c, g, or t
  modified_base (580)..(580): a, c, t, g, unknown or other
  misc_feature (580)..(580): n is a, c, g, or t
  modified_base (608)..(608): a, c, t, g, unknown or other
  misc_feature (608)..(608): n is a, c, g, or t
tcagtagtgtagatcacgaccggtgctcgatttagtctagcgactttgggtttgggggaggcttggtacagccgtgggggtccctgagactctcctgtgcagcctctggtttcatctttagcaactacgccatgagctgggtccgccaggctccgagggaagggctggagtgggtctcaggtattactggtagtggtaataccgcatactacgcagactcggtgacgggccgttcaccgtctccaganacaattcaagaatcggtatatctaggaaaatgaacagcctaggaagtacggccgaaggaccaccggtcccttacgttaataccgtgtacgacgaagagactaccgaaggacgaagttacgagaccaagcctaagtcctttgaacgaccgttacggcggggacccaacgggtaaccctgggtaccaccggttcaccgttgacgtcccaccgaccgaacggccctagtccgttcctccccgtaggccacccgtcctacgacgacgcaccgtgtacgggcacgacggcgcccgtggctcgcgtacgactaggccttactaccattaccgactacncgtcgaggaccggctacgacgaagccgngtaagtacg

SEQ ID NO: 78596 - DNA, 546 bp, Homo sapiens
  misc_feature: GYAE6OF01A2LG3.37.26.C04.1.454.CMB.1.raw
  modified_base (362)..(362): a, c, t, g, unknown or other
  misc_feature (362)..(362): n is a, c, g, or t
  modified_base (519)..(519): a, c, t, g, unknown or other
  misc_feature (519)..(519): n is a, c, g, or t
  modified_base (541)..(541): a, c, t, g, unknown or other
  misc_feature (541)..(541): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccgttcaccgtctccagagacaattccaagaatacggtctatctggaaatgaaacagcctgagagccgaggacacggccctctattactgtgcgagagatcagacggatatagcaggcagctctgactacgnggggacccacggaaccctggtccaccgtctcctcacgcctccaccgaacggcccagtccgtccttcccccgtgcccaccctccctacaacgacgccacctcgtcgggcacgacgccggcccgtgggctcgcctggcaagctactccatctacatacngacgcggctggacgaaggcagngtacg

SEQ ID NO: 78597 - DNA, 739 bp, Homo sapiens
  misc_feature: GYAE6OF01DJVBJ.37.26.C04.1.454.CMB.1.raw
  modified_base (261)..(261): a, c, t, g, unknown or other
  misc_feature (261)..(261): n is a, c, g, or t
  modified_base (728)..(728): a, c, t, g, unknown or other
  misc_feature (728)..(728): n is a, c, g, or t
  modified_base (732)..(732): a, c, t, g, unknown or other
  misc_feature (732)..(732): n is a, c, g, or t
tcagtagtgtagatcacgaccggtgctcgatttagtctagcgactttggggtttgggggaggcttggtacagcctggggggtccctgagactctcctgtgcagcctctggtttcatctttagcaactacgcatgagctgggtccgccaggctccgaggggaaggggctgggagtgggtctcgaggtattacgtgggtagtggtaataccgcatactacgcagtactccggtggaccgggtccgttcaccggtctccgaganactaattaccaagaatacggtactatctaggaaactgaacagcctaggaacgacggccgaaggaccacccgggtcccttacttaagtttacgtggtggaccggtaaggagtactcggaaggacgggtaataagtacgactagcacggtaccttcgagtaacccggttacggtacgggggacccctaaacccggggtaacccgttcgggaccctacccggttcccttaccccgtcgaccgtcccctaacccgaacccgggtaaccggaccccgttacgttcccggttacccccttccccggtacggccctaaccccgtccctaccgaaacgtccgacctacccgttcgggaccgggacaccggacggtcccgggacccggtcgggtctccggtccgtaacggtccaaacggtccttacctactacgtacctaaccgacgttaccgtggcggaccggtcgtacgacggngacngaagtcg

SEQ ID NO: 78598 - DNA, 600 bp, Homo sapiens
  misc_feature: GYAE6OF01ES990.37.26.C04.1.454.CMB.1.raw
  modified_base (312)..(312): a, c, t, g, unknown or other
  misc_feature (312)..(312): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcccctntattactgtgcgagagatcagacggagtatagcagcagctctgactacgtggggcccacgggaaccctggtccaccgtctcctcacgccctccgaccaacgggccacgtccggtcccttcccccgcggccacccctccctacccaacgacgccaccgtccgtggggcctacgacgccgggcccgtcgggtccgtcgtccgtcggtacgaacggtactaccgttacctactccgtaacctaccgttactcggacggccgggtcgtcggacgaacgggccgcgagtacgg

SEQ ID NO: 78599 - DNA, 570 bp, Homo sapiens
  misc_feature: GYAE6OF01BA8ND.37.26.C04.1.454.CMB.1.raw
  modified_base (355)..(355): a, c, t, g, unknown or other
  misc_feature (355)..(355): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagcccgaggacacggcccctctatttactgtgcgagagatcaggacgagtatagcagcagctntgactacgtggggccacgggaaccctggtccaccgtctcctcacgccctccaccaagggccccatcggtccttccccctggccaccctccctccaagcgcacctcgtcggggcacgaggccggcccgtgggctcgccgtcggtcgaaggtacctacttcccgattccgtacaccttactggacgccgggacgtcgggactaaggccgcgatacgg

SEQ ID NO: 78600 - DNA, 609 bp, Homo sapiens
  misc_feature: GYAE6OF01A7W6F.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacggccgttcaccgtctccagagacaattccaagaatacggtctatctggaaatgaacagcctgagagccgaggacacggcctctattactgtgcgagagatcagacggagtatagcagcagctctgaactacgtggggaccacggaaccctggtccaccgtctacctcacgccctaccaccgaacggccctaagtccggtccttcccccgtggccctacccctccctaccaacgacgccacctcgtacggggaccacgacggccggcccgtgggcctcgcccgttggtaccaacgggtacctaccgttcccgtaacgttccgtaaccgtacctacggtggaccggtccgggacgttacgggacgtaaacgggccgtacgagtacg

SEQ ID NO: 78601 - DNA, 604 bp, Homo sapiens
  misc_feature: GYAE6OF01EMHSW.37.26.C04.1.454.CMB.1.raw
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
  modified_base (340)..(340): a, c, t, g, unknown or other
  misc_feature (340)..(340): n is a, c, g, or t
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
  modified_base (483)..(483): a, c, t, g, unknown or other
  misc_feature (483)..(483): n is a, c, g, or t
  modified_base (502)..(502): a, c, t, g, unknown or other
  misc_feature (502)..(502): n is a, c, g, or t
  modified_base (575)..(575): a, c, t, g, unknown or other
  misc_feature (575)..(575): n is a, c, g, or t
  modified_base (596)..(596): a, c, t, g, unknown or other
  misc_feature (596)..(596): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggggaagggctgggagtgggtctcaggttatttacgtgggtagtggtaaactaccgcatacctacgcagacctccgtggaccgggtccgttcacccgtctccagagaacaattccaaagaatacggtctatctaggaaatgaaacngcctgagacgccgagaccacggcccttntattactgngcgaganatcgaggacggtatanacgcgagccagtccctgtacgtactacggcggggacccaaccgggtaaccctggtcccacccgttctccgtcacgtcccctaccaccgaccggccctacgtccgtccctcccgtcgcccnccctcctccgaagcgaccnccgtcggcgggaccacgcgccggccgtcggctcgccgtgacgacgtcctacctccactctactactacgcggnggccggcgtcggacgacggcncgaagtcg

SEQ ID NO: 78602 - DNA, 646 bp, Homo sapiens
  misc_feature: GYAE6OF01DV5HH.37.26.C04.1.454.CMB.1.raw
  modified_base (640)..(640): a, c, t, g, unknown or other
  misc_feature (640)..(640): n is a, c, g, or t
  modified_base (646)..(646): a, c, t, g, unknown or other
  misc_feature (646)..(646): n is a, c, g, or t
tcagtagtgtagatcacgaccggtgctcgatttagtctagcgactttgggtttgggggaggcttggtacagcctggggggtccctgagactctcctgtgtagcctctgaattccccctttacggctttattggatgagctgggtccgccaggctccaggggaaggggctggagtgggtggccaacataaaagcaagatggaagtaagaaggagtatgtggactctgtggaagggtcctttcaccatcctccagagacaacgccaaagaacctccgtgcatctgacaaatgaacagtctgagacgccgaggaccacggtcttaattttattacgtgccgcgaagaggaaggacgtggggtccggtttacgactacggtcggggccaacggggtaacccctgggtcccacccgtctccctcgacgtccctccgaaccgaacgggcccctagttcccggttcccttcccccgtggcccgccctcgcctccgacggacgccaccgtaccgagacgaccacgacggcccggcccgtgggcctcggccgtacggtacgaacggtaccttaccttccaacttcctaacctaccgtacgtacggacggtccggggtcgtcgggacgaagggcccgagtacgtaggcanctgcgn

SEQ ID NO: 78603 - DNA, 643 bp, Homo sapiens
  misc_feature: GYAE6OF01D2XV7.37.26.C04.1.454.CMB.1.raw
  modified_base (314)..(314): a, c, t, g, unknown or other
  misc_feature (314)..(314): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgaccgggccgttcaccgtctccagagacaattccaagaatacggtctatctggaaatgaacagcctgagagccgaggacaccggccctntattactggtgcgagagatcgaggacggagtatagcagcagctctagtactacggtcggggacccaaccgggtaacccctgggtaccacccgttcctccctcacgccctcccgaacccgaacgggccccaacgttcccggttacccctttcccccgtcggccctaccccctccctacccgaaacgaccgctaaccccgtcggtcgggggaccacgacggcccggcccggtcgggtccgtcgcccgttggtaccgaacggtaccttaccttcctacttacctaacctacgttacgtggacggccggtcgtcggacgacggcgcgagtacg

SEQ ID NO: 78604 - DNA, 606 bp, Homo sapiens
  misc_feature: GYAE6OF01BCAXX.37.26.C04.1.454.CMB.1.raw
  modified_base (288)..(288): a, c, t, g, unknown or other
  misc_feature (288)..(288): n is a, c, g, or t
  modified_base (327)..(327): a, c, t, g, unknown or other
  misc_feature (327)..(327): n is a, c, g, or t
  modified_base (364)..(364): a, c, t, g, unknown or other
  misc_feature (364)..(364): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctgggagtgggtctcaggtattactggtagtggtaataccgcatactacgcagactccggtgacgggccgttcaccgtctccagagacaattccaagaatacggtctatctggaaatgaacngcctgagagccgagcacggcctactatactgtgcgaganatcgaagacggataatagcagcagctgtgacttacgngggacccacggacctggcaccgtctccncncgcctccacgacggccacgtccgtcctcccgtcggccacccgtccctacgaacgcgaccctaccgtcggtcgggccacggacggccggtcccgtagggcctaccggccgtacgggaccgtaaacggaccttaccttccgtactacccgtacctaacgtaccgtcggaacggtccgggtacgttacgggaccgaagggcccgtagtacgtagg

SEQ ID NO: 78605 - DNA, 615 bp, Homo sapiens
  misc_feature: GYAE6OF01AVCHX.37.26.C04.1.454.CMB.1.raw
  modified_base (603)..(603): a, c, t, g, unknown or other
  misc_feature (603)..(603): n is a, c, g, or t
tcagtagtgtagatcacgaccggtgctcgatttagtctagcgactttgggtttgggggaggcttggtacagcctggggggtccctgagactctcctgtgcagcctctggattcaactttggtagctattggatggactgggtccgccagtctccagggaaggggctggagtgggtggccaacatacagggaggtggtggtacgaaaaactatgtggactctgtgcggggccgattcaccatctccagagacaacgccaaaaactcactgtatctgacaaatggacggcctgagatccgaggacacggctgtgtattatgtgcgagagtatttagacttaacgaaaagtttcgagtgactggtatgatgcttatgaactaccggtggggaccgaaaggggaccagtcggtaccacccggttctccttccacgtcccctacccgaacccgaaacgggccccaacgttcccgggttcccttccccccgtggccccgtccctcgccctccgacggcgacccgacccgtccgacgacgccaacgcggcccggcccgtgggctccggccgtgggaccgaacggacttactaccctatcctacacctagnggacggcgggcg

SEQ ID NO: 78606 - DNA, 609 bp, Homo sapiens
  misc_feature: GYAE6OF01DA3QW.37.26.C04.1.454.CMB.1.raw
  modified_base (317)..(317): a, c, t, g, unknown or other
  misc_feature (317)..(317): n is a, c, g, or t
  modified_base (357)..(357): a, c, t, g, unknown or other
  misc_feature (357)..(357): n is a, c, g, or t
  modified_base (601)..(601): a, c, t, g, unknown or other
  misc_feature (601)..(601): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctaggaatgaacagcctgagagccgaggacacggcctctattacngtgcgagagatcaggaacggagtaatagcagcagcttacngtaacctacgtcggggaccaaccgggaaccctggtacctacccgtcctcctacacgccctaccaccgaacgggcccacgtccgtcccttccccgtcggaccctacccctcctaccgaacgacgcctaccgtcgcggggccacgacggccggcccgtcgggtctcgtccgtcggtacgaacggtaccttactacctactcctaacctacgtacgtcggacggccggcgtcgggaacgaggaccgngtagtacg

SEQ ID NO: 78607 - DNA, 602 bp, Homo sapiens
  misc_feature: GYAE6OF01BTTIH.37.26.C04.1.454.CMB.1.raw
  modified_base (376)..(376): a, c, t, g, unknown or other
  misc_feature (376)..(376): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (472)..(472): a, c, t, g, unknown or other
  misc_feature (472)..(472): n is a, c, g, or t
  modified_base (559)..(559): a, c, t, g, unknown or other
  misc_feature (559)..(559): n is a, c, g, or t
  modified_base (596)..(596): a, c, t, g, unknown or other
  misc_feature (596)..(596): n is a, c, g, or t
tcagtagtgtagatcacgaccggtgctcgattttagtctagcgactttgggtttggggggtaggggcgttggtaacgagcctgggggggtccctgaggactctcctgtgcgacgccgtctcggtttcattctttacgcaactacgccatgagctgggtccgccaggctccgagggaaggggctggagtgggtctcaggtattactggtagtgtaatccgcatacacgcagactccgtgacggccgttcacgtctcagagacaattccaaagaatacggtctatctggaaatgaaccagcctgagacgccggaggacaccggtcctcgtattacgtgtggacgaagagatcgaggacggagtagtagccagcagctntcgactacgcggggaccaaccgggacctggtcaaccgttctcctcgacgtcctccaacgacggccagtccgtctcccgngaccnccctctacgaancactctcgtcgggacacgcgaccggccgcggactcgaccgtggtaccgaacggtcctaacgttcctacgttctacgaacgttacggnggtaccggcgggtaaccgtcgacggtaaggccgaagnggtacg

SEQ ID NO: 78608 - DNA, 650 bp, Homo sapiens
  misc_feature: GYAE6OF01ASILB.37.26.C04.1.454.CMB.1.raw
  modified_base (486)..(486): a, c, t, g, unknown or other
  misc_feature (486)..(486): n is a, c, g, or t
tcagtagtgtagatcacgaccggtgctcgatttagtctagcgactttgggtttgggggaggcttggtacagcctggggggtccctgagactctcctgtgcagcctctgatttcatctttagcaactacgccatgagctgggtccgccaggctccagggaaggggctggagtgggtctcaggtattactggtagtggtaataccgcatactacgcagactccgtggacgggccggttcaccgtctccagagacaattccaaagaatacggtactatctaggaaatgaacagcctgagagaccgaggacaccggccctctattactgtcgcgagagatcaaggacggagtaagtagcagcagcctcgtacgaaccgttacggtcggggaccaaccggaacccgtcggtacctacccgtcgtccctacgacgtccctaccgaacccgaaccgggccctacgtcccggttcccttcccccgtcggccccncccctacccgtaccaacgaccgtaccaccgtccggtcggggccacggaccggcccggcccgtccgggtccgtccgtccgtaccggtacgaacggtaccttaccgtacctactacctaacaccgtacgaggacggtccgggtcgtacggacgaacggcgacgtag

SEQ ID NO: 78609 - DNA, 645 bp, Homo sapiens
  misc_feature: GYAE6OF01EPCJH.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaattacggtctatctaggaaaatgaacagcctgagagccgaggacacggccctatattactgtgcgagagatcgaagacggatatagcagcagctctagacctacggtcggggacccaaccgggaaccctggtaccacccggttcctcccgtcacgtcccctacccgaacccgaaccgggcccctacgttcccggttccccgttaccccccgtcggtccctaccccctacccctacccgaacgaccgacctacccgtcgtacggggaccacgcggcccggcccgtgggtcctcggccgtacggtaccgaacggtaccttaccgttacctactaccgtaactacgtacgtgacgggcgggtacgtcggacgaaggcgacgagtacg

SEQ ID NO: 78610 - DNA, 599 bp, Homo sapiens
  misc_feature: GYAE6OF01CIOBX.37.26.C04.1.454.CMB.1.raw
  modified_base (315)..(315): a, c, t, g, unknown or other
  misc_feature (315)..(315): n is a, c, g, or t
  modified_base (594)..(594): a, c, t, g, unknown or other
  misc_feature (594)..(594): n is a, c, g, or t
tcagtagtgtagatcacgaccggtgctcgatttagtctagcgacttttgggtttgggggaggcttggtacagcctggggggtccctgagactctcctgtgcagcctctggtttcatctttagcaactacgccatgagctgggtccgccaggctccgaggggaaggggctggagtgggtctcaggtattactggtagtggtaataccgcatactacgcagactccgtgaccgggccgttcaccgtctcagagacaattccaaagatacggtctatctaggaaatgaaacagcctgagagccgaggacacggccctntattactgtgcgagagatcaggacggagtatagcagcagtctactgactacgtcggggaccacggacctggtccaccgtctcctcgacgccctccaaccgacggcccacgtccggtcccttccccgtcgcctacccctcctaccaacgacgacctaccgtcggtcggggaccacgacggcccggtccgtcgggcctcggccgtggtaccaacggtaccttaccttcctactcctaacctactacgtcggacggtccgggcgtcgggacgaggccgacgngtacg

SEQ ID NO: 78611 - DNA, 772 bp, Homo sapiens
  misc_feature: GYAE6OF01BPRH4.37.26.C04.1.454.CMB.1.raw
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
  modified_base (766)..(766): a, c, t, g, unknown or other
  misc_feature (766)..(766): n is a, c, g, or t
  modified_base (771)..(771): a, c, t, g, unknown or other
  misc_feature (771)..(771): n is a, c, g, or t
tcagtagtgtagatcacgaccggtgctcgatttagtctagcgactttgggtttgggggaggcttggtacagccgtggggggtccctgagactctcctgtgcagcctctggtttcatcttagcaactacgccatgagcgtgggtccgcaggctccgaggggagggctgggagtgggtctcgaggtattacgtggtagtggtaactccgnatactacgcagacctccggngaccgggccgttcaccgtctccagaacgactaattccgaaagtaacgtacggtctatcgtaggaaaatcgaaacngcctaggaacgacgaccggaggaccaccggtccccttataagtttaccgtggtacggaccggaggacgtacgtacggaaggtaccgggtaattaacgtacggaccgaaggtcctacggtccttacgtacggtaaccgttacggccgggggaacccctaaacccgggtaacccgttcgggtaccctacccggttcctacccgtacgtaaccgtccccgtacccgaacccggtaaccgggtaccccgtaccggttccccgggttacccccgttacccccggtaccggtacccctacccccgtacccgtaacccgaaccgaccgtacccgtacccgtccgggtacggggacctaccggacggtcccggtcccggtacgggtccgtacgtccgtacggtaccgtacgtaccgttactaccgtacgtcgtacctacgtacggcgacggcgacgtacggaccgaggcgngtagng

SEQ ID NO: 78612 - DNA, 199 bp, Homo sapiens
  misc_feature: GYAE6OF01CT3NG.37.26.C04.1.454.CMB.1.raw
  modified_base (183)..(199): a, c, t, g, unknown or other
  misc_feature (183)..(199): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactaccgccatgagctgggtccgccaggctccgagggaaggggctggagtgggtctacgnnnnnnnnnnnnnnnnn

SEQ ID NO: 78613 - DNA, 601 bp, Homo sapiens
  misc_feature: GYAE6OF01BSXIH.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggattcaactttggtagctattggatggactgggtccgccagtctccagggaaggggctggagtgggtggccaacatacagggaggtggtggtaacgaaaaactatgtggactctgtgcggggccgattcaccatctccagagacaacgccaaaaaactcaactgtatctgacaaatggacggcctgagatccgaggacacggctgtgtattattgtgcgagagtatttagactaactaaagtttcgaagtgactggtatgattctatgataccgtgggaccaagggaccagtcggtcaccgtctctcacgcctccaacgaacgggccctagttccggtcccttcccccgtggcccgtccctcgcctccgaaggaccgcaccctccgagacgaccacgacgccgaccgtgggaccctgccgtggtaccgaacggtacctaaccttcctaacgtacctaacctaacctaccgtagacgggtcccggtgtaccggg

SEQ ID NO: 78614 - DNA, 623 bp, Homo sapiens
  misc_feature: GYAE6OF01CDL9T.37.26.C04.1.454.CMB.1.raw
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
tcagtagtgtagatcacgaccggtgctcgatttagtctagcgactttgggtttgggggaggcttggtacagcctgggggtccctgagactctcctgtgcagcctctggtttcatctttagcaactacgccatgagctgggtccgccaggctccgagggaagggctggagtgggtctcaggtattactggtagtggtaataccgcatactacgcagactccgtgacggccgttcacgtctcagagacaattccaagaatacggtctatctaggaaatgaacagcctgagagccgaaggacacggcctactattacngtcncgagagatcaagacggatatagcagcacgctatgactacggtcggggacccaacgggaaccctggtaccaccgtcttcccgacgacgccctaccgaccgaacggccctacgttcccggttccccttaccccgtcggtaccctaccctaccctaccgaacggcgaccctaccgtcggtacggggaccacggacggcccggtcccgtacgggtcctcggccgttcggtacgaacggtaccttacctccacttaccgtacctacgtacgtcgacggcggacgtacggacaacgggcaccgtagtacg

SEQ ID NO: 78615 - DNA, 722 bp, Homo sapiens
  misc_feature: GYAE6OF01ECQ8R.37.26.C04.1.454.CMB.1.raw
  modified_base (208)..(208): a, c, t, g, unknown or other
  misc_feature (208)..(208): n is a, c, g, or t
  modified_base (292)..(292): a, c, t, g, unknown or other
  misc_feature (292)..(292): n is a, c, g, or t
  modified_base (319)..(319): a, c, t, g, unknown or other
  misc_feature (319)..(319): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgaggggaagggctggagtgggtctcaggtattacgtggtagtggtaataccgnatactacgcacgaccccgtgaccgggccggttcaccgtctccagagacaattccaaagatacggtctatctaggaaatcgaacngcctgagacgccgaggacaccggcctntattactggtgacgagagactacgaggacggagtatagcagcagctcgtacgaacgtacggtaccggggaccgtaaccggtaaccccgttggtaccctaccccgttccttacccgtaccaccgtcccccgtaacccgaacccggaaccgggtacccctaacggttccccggtttacccccgtttcccccgtccggacccctacccctaccccgtacccgaaacgtacgccctaccggtccggtcggggaccacgaccggcccggtcccggtcggccgttaccggtcccgttacggtaaccggtaaccgtaccttaacccttaccgaccttacctacccgtaaccgttacgtacgggacgggtccgggtacggaccgggacggtaaccggcgtaacgagtgacg

SEQ ID NO: 78616 - DNA, 609 bp, Homo sapiens
  misc_feature: GYAE6OF01ESXAS.37.26.C04.1.454.CMB.1.raw
  modified_base (213)..(213): a, c, t, g, unknown or other
  misc_feature (213)..(213): n is a, c, g, or t
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
tcagtagtgtagatcacgaccggtgctcgatttagtctagcgactttgggtttgggggaggcttggtacagccgtggggggtccctgagactctcctgtgcagcctctggtttcatctttagcaactacgccatgagcgtgggtcccgccaggcctccgaggggaaggggctggagtgggtctcgaggtattacgtggtagtggtaataccgnatactacgcagactccgtgacgggccgttcaccgtctcagagacaattcaagatacgtctatctagaaatgaacagcctgagagccgaggacacggccctntattacgtgngcgagagatcaggacgagtanagcagcagctntagactacgngggacccaacggaaccctgccaccgtctccacacgccctaccaccgaaccggccacgtccgtcccttccccgcgtccctaccccgtccctaccgaacgcgaccaccgtcggtacggggccacgaccgccggacccgtcgggtaccgtcgccgtcggtaccgaacggtaccttaccttacctacttacccgtaactactaacggtcggaccggtcgggtcgtacgggacgaggccgacgatacg

SEQ ID NO: 78617 - DNA, 650 bp, Homo sapiens
  misc_feature: GYAE6OF01CNGLO.37.26.C04.1.454.CMB.1.raw
  modified_base (229)..(229): a, c, t, g, unknown or other
  misc_feature (229)..(229): n is a, c, g, or t
  modified_base (294)..(294): a, c, t, g, unknown or other
  misc_feature (294)..(294): n is a, c, g, or t
  modified_base (647)..(647): a, c, t, g, unknown or other
  misc_feature (647)..(647): n is a, c, g, or t
  modified_base (649)..(650): a, c, t, g, unknown or other
  misc_feature (649)..(650): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactctggcatgaacgtgggtccgccaggctccgaggcagtggggctgcaggtgggtctacaagtactagtgctccgtaggtaatagagcagactacgcagactcgngaacggtccgtacaccatctacagacgacaactacaagaacacgctactatctagacaatgaacngcctgagagaccgagacacgctatatactgtgagaaggcggtagggaggtcgggggactacggtcggggaccgaacggtacccgtggtccgaccggtcctcctacgcgtccctaccgaaccgacggacccacgttccggttccccttcccccgtacggacccacccccgttccaaccgaacgccgaccgtaccgtccgggtcggggaccacggacggccccggacccggtcgggacctccggtaccgttacgggaaccgtaacggtaacccgtttcctaacccgtaacttacctaccgttaacgtccgtacgggacggaccgggtcggtaccggcgaacggcgacgagtacgngnn

SEQ ID NO: 78618 - DNA, 599 bp, Homo sapiens
  misc_feature: GYAE6OF01B3CD3.37.26.C04.1.454.CMB.1.raw
  modified_base (386)..(386): a, c, t, g, unknown or other
  misc_feature (386)..(386): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacggcgttcacgtctccagagacaattccaagaatacggtctatctggaaatgaacagctgagagccgaggacacggcctctattactgtgcgagagatcagacggagtatagcagcagctctgactagtggggccacggaaccctggtaccaccgtctccncacgccctcccaccgaacgggcccacgtccggtccttccccgtcggcctacccctcctccaaacgacgacccaccgtcgtgggggaccacgacgccggacccgtcggggcctcgcgtcggtaccgaaacggaccttaaccttccgtacttcctaaccaccttaaccgtggtacggccgggtccgtcgggaccgaagggccgacgtagtaacgg

SEQ ID NO: 78619 - DNA, 623 bp, Homo sapiens
  misc_feature: GYAE6OF01D3P7S.37.26.C04.1.454.CMB.1.raw
  modified_base (585)..(585): a, c, t, g, unknown or other
  misc_feature (585)..(585): n is a, c, g, or t
tcagtagtgtagatcacgaccggtgctcgatttagtctagcgactttgggtttgggggaggcttggtacagcctggggggtccctgagactctcctgtgcagcctctggttcatctttagcaactacgccatgagctgggtccgccaggctccagggaaggggctggagtgggtctcaggtattacgtggtagtggtaataccgcatactacgcagactccgtggacgggccgttcaccgtctccagagactaattccaaagaatacggtctatctggaaatgaacagcctgaagagccgaggacacggcccttctattactgtgcgagagatcagacggatatagtagcagctctgaacgtacgtcggggaccaacggtaacccgtggtacctaccggtccttccctacgacgtcccctaccgaaccgaaccggggtaccccacgttacccggttccctttcccccccgtcggccctaccccgtccctaccgaacgacgccaccgtcggtcggggccacgacgccggcccgtcgggccgtcgccgtggtacacggtacctacttcctacgtcctaacaccgtanaggacgccgggtacgcggacgaacggcacgtagtgacg

SEQ ID NO: 78620 - DNA, 599 bp, Homo sapiens
  misc_feature: GYAE6OF01A7JBI.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccggttcaccgtctccagagacaattccaagatacggtctatctggaaatgaacagcctgagagccgaggacacggccctctattactgtgcgagagataagacggagtatagcagcagctctgactacgtggggccaacggaaccctggtaccaccgtctcctcacgccctccaccgaacgggcccagtccggtccttccccctcggccaccctcccaccgaacgacgccaccctcgtcggggccacgacggcccggcccgtcgggcctcgcccgttcggtaccgaacgggtaccttaccgttacctacttcctaacctaccttacgtcggtacggccgggcgtcgggaccgaacggccgacaagtaggc

SEQ ID NO: 78621 - DNA, 674 bp, Homo sapiens
  misc_feature: GYAE6OF01CEN2Y.37.26.C04.1.454.CMB.1.raw
  modified_base (255)..(255): a, c, t, g, unknown or other
  misc_feature (255)..(255): n is a, c, g, or t
  modified_base (370)..(370): a, c, t, g, unknown or other
  misc_feature (370)..(370): n is a, c, g, or t
tcagtagtgtagatcacgaccggtgctcgatttagtctagcgactttgggtttgggggaggcttggtacagcctgggggggtccctgagactctcctgtgcagcctctggattcaactttggtagctattggatggactgggtccgccagtctccgagggaaggggctggagtgggtggccaacatacgaggggaggtggtggtaacgaaaaactatgtggactctgtggcggggccgattcaccatctccaganacaacgaccaaaaactcactgtatctgacaaatggacggcctagagactccgagacacggctgtgtattatgtgcgagagtattagactaacaagttcgagtgacgtgatgatgnttagtagtataccgtaggggaccaaagggaccagtcgtccgtaccgtacgtcttaccgacgtccctacccgaacccgaaacgggtccccaacggtttcccggtaccccgtttccccccgtcgggtcccccgtccccgtccggcccgttacccggaacgggtaccgacccgtaacccgacccggaacgaaccgaccacgaccggcccggtcccggtgggcccgtacggcccgttacgggtacgtaaaccgggtacttacccctccgaacttcccgtaacctacgtacgtcgacgggtcgggcccg

SEQ ID NO: 78622 - DNA, 645 bp, Homo sapiens
  misc_feature: GYAE6OF01A8NIE.37.26.C04.1.454.CMB.1.raw
  modified_base (311)..(311): a, c, t, g, unknown or other
  misc_feature (311)..(311): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaagggctggagtgggtctcaggtattactggtagtggtaataccgcatactacgcagactccgtgacgggccgttcaccgtctccagagacaattccaagaatacggtctatctggaaatgaacagcctgaagagccgaggacacggccctntattactgtgcgagagatcgagacgagtatagcagcagctcgtgactacgtcggggacccaaccggtaaccctggtaccacccggttctcccgtcacgtccctacccgaaccgaacgggcccctacgtcccggttacccttcccccgtcggtccctacccctccctaccaacgaaccgcctaccgtcggtcggggacctacgacggccggcccgtgggtcctacggccgttacggtaccgtaacggtaccttaccgttacctacttaccgtaacctaccgttaacgtcggacggtacccgggcgttacgggacgaacgggccgacgtaagtacg

SEQ ID NO: 78623 - DNA, 620 bp, Homo sapiens
  misc_feature: GYAE6OF01A3R2Z.37.26.C04.1.454.CMB.1.raw
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
  modified_base (363)..(363): a, c, t, g, unknown or other
  misc_feature (363)..(363): n is a, c, g, or t
  modified_base (392)..(392): a, c, t, g, unknown or other
  misc_feature (392)..(392): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccggttcaccgtctccagagacaattccaagaatacggtntatctggaaatgaacngcctgagagccgaggacacggccctactattactgtgcgtagagatcagacggatatagcagcagctctgactacgngggccacggaaccctggacaccgtctccncacgccctccaccgaacggcccacgtccggtcccttcccccgtcggccctacccctcctacccgaacgacgtccacccgtcgtcggggccacgacggccggcccggtgggcctcgccgtcgggtaccgtaaacggtacctaccgttcccaacgttaccgtaccgtaccgttaacgtcggaaccggcggggtacccgtcgggacccgaaacgggccgtaacgtagtacg

SEQ ID NO: 78624 - DNA, 646 bp, Homo sapiens
  misc_feature: GYAE6OF01COP0E.37.26.C04.1.454.CMB.1.raw
  modified_base (314)..(314): a, c, t, g, unknown or other
  misc_feature (314)..(314): n is a, c, g, or t
  modified_base (330)..(330): a, c, t, g, unknown or other
  misc_feature (330)..(330): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccggttcaccgtctccagagacaattccaaagaatacggtctatcgtggaaatgaacagcctgagagccgaggacacggccctntatactgtgcgagagntacagacggagtaatagacagcagcttcgagactacgtggggaccaaccggacccgtggtaccaccggttcctcccgtcacgccctacccaccgaaccgggcccacgtccgtccccttccccgtcggaccctacccctccctaccaacgacgcccgtaccgtcggtcggggaccacgaccgccgggcccgttcggggtaccttcggtcccgttagggtaccgtaacgggtaccttacccgttcctacgttacctaaccgtacgttaacgtcgggacggtccgggacgtacgggacgtaacgggcgaccgaagtacg

SEQ ID NO: 78625 - DNA, 629 bp, Homo sapiens
  misc_feature: GYAE6OF01A8ZKU.37.26.C04.1.454.CMB.1.raw
tcagtagtgtagatcacgaccggtgctcgatttagtctagcgactttgggtttgggggaggcttggtacagcctggggggtccccgagactctcctgtgcagcctctggtttcatctttagcaactacgccatgagctgggtccgccaggctccagggaaggggctgggagtgggtctcaggtattactggtagtggtaataccgcatactacgcagactccgtgacgggccggttcaccgtctccagagacaattccaagaatacggtctatctaggaaatgaacagcctgagagccgaggacacggccctctattactgtgcgagagatcagacggagtatagcagcagctctgactacgtcggggaccacggaccctggtccacccgtctcctcacgccctccaccgacggcccagtccggtcccttccccgtcggcctacccctcctaccgaacgacgccaccgtccgtcggggccaccgtacgcccggtcccgtcgggccgtacggtccgttacggtaccgtaacgggtacccttaccgttaccctacttacccgttaacctaaccgttaccgtacgggaacggccggggtacgttcgggaacgaaccgggcgacgtagagtcg

SEQ ID NO: 78626 - DNA, 713 bp, Homo sapiens
  misc_feature: GYAE6OF01A9LO2.37.26.C04.1.454.CMB.1.raw
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (325)..(325): a, c, t, g, unknown or other
  misc_feature (325)..(325): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgaggggaaggggctggagtgggtctcgaggtattacgtggtagtggtaataccgcatactacgcaagactccggtgaccgggtccgttcaccgtctcaganacaattccaaagaatcggtntatcgtaggaaatgaacagcctaggagacgccgaggaccacggcccctnttaattacgtgtcggacgagagtactcgaaggacggattaagacgcacggcaagctcgtacgacgtacggtcggggaccccaaccgggtaaccctgggtaccctacccggttctaccccgtacacccgcccgtacccgaaccggtaacccgggcccctaacggttcccggttacccccttccccccggtcgggacccccttaccccgtcccgtaacccggacggtacccgccctacccgtacccggaacgaccgaacccgacggaccgggtcccgggccccgtcggggaccttccggaccgtcggtaaccgacgtaccgttccctaccgtactacctactacccgttacggcggacgggccggcgtacgggaccaggtccgagtaacg

SEQ ID NO: 78627 - DNA, 581 bp, Homo sapiens
  misc_feature: GYAE6OF01EMX87.37.26.C04.1.454.CMB.1.raw
  modified_base (362)..(362): a, c, t, g, unknown or other
  misc_feature (362)..(362): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
  modified_base (575)..(575): a, c, t, g, unknown or other
  misc_feature (575)..(575): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggtccgttcaccgtctccagagacaattccaagatacggtctatctggaaatgaacagcctgagagccgaggacacggccctctattactgtgcgagagatcgagacggagtatagcagcagctcgtgactacgnggggccacggaacccgtggtccaccgtctcctcgacgccctccaccgaacgggccctagtcccggtcccttccccncggccnccctcccaccaagcgccacctcggtcgggccacgcggccggcccgtgggtcctcgccgtaggtaccgaacggccttaccttccattcctaacctacctacgtggacggcgggcgtcggacgaaggccgtanagtacg

SEQ ID NO: 78628 - DNA, 552 bp, Homo sapiens
  misc_feature: GYAE6OF01DRVEY.37.26.C04.1.454.CMB.1.raw
  modified_base (145)..(145): a, c, t, g, unknown or other
  misc_feature (145)..(145): n is a, c, g, or t
  modified_base (178)..(178): a, c, t, g, unknown or other
  misc_feature (178)..(178): n is a, c, g, or t
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
  modified_base (310)..(310): a, c, t, g, unknown or other
  misc_feature (310)..(310): n is a, c, g, or t
  modified_base (545)..(545): a, c, t, g, unknown or other
  misc_feature (545)..(545): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccnccaggctccagggaaggggctggagtgggtctnaggtattactggtagtggtaataccgcatactacgnagactccgtgacgggccgttcaccgtcnccagagacaattccaaagatacggtctatctaggaaatgaacagcctgagagccgaggacacggcctntattactgtgcgagagatcagacggagtatagcagcagctcgtgacgtacgtggggccaacggaaccctggtccacgtctcctcacgcctcaccgacggccagtccgtcctcccgcggccaccctcctccaagcgcacctcggcgggaccacgacgcggcccgtcgggctcgccgtagtccgaagtacctacgtccatcctacacttactgacggtcggcgtacggacgaaggcncagtacg

SEQ ID NO: 78629 - DNA, 673 bp, Homo sapiens
  misc_feature: GYAE6OF01BR16P.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaggaacactctatatctgcaaatgaacagcctgagagccgacgacacggccatatattattgtgacgaaacgaccccaacggtgaaccaacgattggagtcttttgacttcgtggggaccaaagggacaacggtcacccgtctcttcagccctaccaccgaacgggccctactccgggtccttcccccgcggtccgccccgttgccctacccgaacgggtacgacccacccgtccgaacgacggaccacgacgcccgggtccccgtagggggccttcggcccgttcggtacgaaacggtacccgttaaccgtttcccaaacgtttcctaaacccgtacgttaaacccgttgggaaccgggaccgggggtccgttacggggtaacccgaaaccggggtcccgaacgtaacggttacgg

SEQ ID NO: 78630 - DNA, 615 bp, Homo sapiens
  misc_feature: GYAE6OF01BN0GM.37.26.C04.1.454.CMB.1.raw
  modified_base (309)..(309): a, c, t, g, unknown or other
  misc_feature (309)..(309): n is a, c, g, or t
  modified_base (316)..(316): a, c, t, g, unknown or other
  misc_feature (316)..(316): n is a, c, g, or t
  modified_base (610)..(610): a, c, t, g, unknown or other
  misc_feature (610)..(610): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaaagaatacggtctatctaggaaatgaacagcctgagagccgagacacggcctntattacngtgcgagagatcgaggacggagtatagcagccagctcgtagacgttacgtcggggacccaaccgggtaacccgtcggtaccacccgttcctaccctcgacgtccctacccacccgaacggcccctacgttcccggttcccttcccccgtcggaccctaccccgtccctaccgaacgcgaccaccgtcggtacggggccacgacggccggtcccgtgggtcctcgtccgtggtacaacggtctaccttccactcctacgtactacgtcggacggcggcgtcggacgaggcgacgngtacg

SEQ ID NO: 78631 - DNA, 606 bp, Homo sapiens
  misc_feature: GYAE6OF01EFXMF.37.26.C04.1.454.CMB.1.raw
  modified_base (601)..(602): a, c, t, g, unknown or other
  misc_feature (601)..(602): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
tcagtagtgtagatcacgaccggtgctcgatttagtctagcgactttgggtttgggggaggcttggtacagcctggggggtccctgagactctcctgcatagactcatacttgagtatgagttcattcttcatgggctgggcccgccagtctccagggaaggggctggagtgggtggccaacatagcgagcgatggaagtgagagaaattatgtggactctgtgaagggccattcaccatctcagagacaactccaagactcagtgtatctacacatagaacaaccttagagtcgaggacacggtctgtttattactgtaagaaaaggccaatagtggagtcgtggggccgagggaccacggtccaccgtctcctcacgccctccaccgaacgggcccagtccggtcccttcccccgtggcccgtccccgtgccctccgacggacgccacccgtccggagacgccacgcggccggtcccgtgggcctcggcccgttgggtaccgaaacgggtaccttaccttacccgacttacctaacctaccgttaacgtcgggaaccggtccggggtacgtcgggacgaacggccgacgtaagtacggnngngn

SEQ ID NO: 78632 - DNA, 912 bp, Homo sapiens
  misc_feature: GYAE6OF01DV4OQ.37.26.C04.1.454.CMB.1.raw
  modified_base (214)..(214): a, c, t, g, unknown or other
  misc_feature (214)..(214): n is a, c, g, or t
tcagtagtgtagatcacgaccggtgctcgatttagtctagcgactttgggtttgggggaggcttggtacagccgtggggggtccctgagactctcctgtgcagcctctggtttcatctttagcaactacgccatgagcgtgggtccgccaggcctccgaggggaaggggctggagtgggtctcgaggttattacgtggtagtggtaaataccgnaatactacgcagactccggtgacgggtccgttcaccgtctaccgagagaactaattccaaaggaacttacggtctaattcgtaggaaactgaaacaggtacctggaacgacggaccggaaggaccaccgggcccctttactaagtttacgtggtcgacggagaacgaacttcgaagggtacgggaagttaagacggacaacggacgtaacggtccttacgtaacggtaaccgttaccgggtaccgggggaaccccaacccggggttaaaccccgttgggttaacccccgtaaccccggtttccccgttacccgtaccgaacccggttacccccgtaaccccgaaacccgggtaacccgggtacccccgtaaccggtttccccccgggtttaacccccgtttcccccccggtaacccgggtccccccttaaccccccgttaccccgttaacccggaaacggtacccgtaccccgtaacccgggttcccggggttacccgggggaaccctaaccgggaccgggtaccccgggtcccggttcccggggtacccgtaccgggtaccccggttaccgggtaacccgtaaaccgggttaaccctttacccgttacccaacgtttaacccgtaaccgttaaccgtacggtacgggaccgggtaccgggtaccgtacggacggaaccgggcgtaacgtaagtacgg

SEQ ID NO: 78633 - DNA, 652 bp, Homo sapiens
  misc_feature: GYAE6OF01DE94Z.37.26.C04.1.454.CMB.1.raw
  modified_base (412)..(412): a, c, t, g, unknown or other
  misc_feature (412)..(412): n is a, c, g, or t
  modified_base (421)..(421): a, c, t, g, unknown or other
  misc_feature (421)..(421): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggcctccgaggggaaggggctgggagtgggtctcaggtattacgtggtagtggtaactaccgcatactacgcagactccgtgacgggccgttcaccgtctccagagacaattccaaagaatacggtactatcgtaggaaaatgaacagcctagagacgaccgaaggaccgaccggccctcttaattactgtagcgagagactcaaggacggaatagtacgcagctagctcgtagactacggcgggaccaaccggacctgtaccnccgtctccncacgccctaccgaccgacggtcccacgtaccggtcccttaccccgtcggaccctacctacccgaccgaacgaccgcctacccgtcggtacggggaccaccgtaccggcccggtcccgttcgggccttccggccgttacgggtaccgtaaaccggtacttacccggttacctacttacccgtaactaccgtacgtcggacggccgggtcgtacggacgacgacggctagtag

SEQ ID NO: 78634 - DNA, 541 bp, Homo sapiens
  misc_feature: GYAE6OF01AFC2R.37.26.C04.1.454.CMB.1.raw
  modified_base (237)..(237): a, c, t, g, unknown or other
  misc_feature (237)..(237): n is a, c, g, or t
  modified_base (538)..(538): a, c, t, g, unknown or other
  misc_feature (538)..(538): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtggggtctcaggtattactggtagtggtaataccgcatactacgcagactccgtgacgggccggttnaccgtctccagagacaattccaagaatacggtctatctggaaatgaacagcctgagagccgaggacacggccctctattactgtgcgagagatcagacggagtatagcagcagctctgactactggggccacggaaccctgggtcaccgtctcctcagcctccaccaagggcccatcggtccttccccctcggccacccctccctcccaacgacgcacctctgggggcacgagcggccctggggctgcctggtcaaggactacttccatctacactactgacgcgggctgggcaaggcgcntag

SEQ ID NO: 78635 - DNA, 666 bp, Homo sapiens
  misc_feature: GYAE6OF01DRZ8V.37.26.C04.1.454.CMB.1.raw
  modified_base (209)..(209): a, c, t, g, unknown or other
  misc_feature (209)..(209): n is a, c, g, or t
  modified_base (320)..(320): a, c, t, g, unknown or other
  misc_feature (320)..(320): n is a, c, g, or t
  modified_base (345)..(345): a, c, t, g, unknown or other
  misc_feature (345)..(345): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgcccaggctccgagggaaggggctggagtgggtctcaggtattacgtggtagtggtaataccgnatactacgcagactccgtgacgggccggttcacgtctcagagacaattcaaagatacggtctatctggaaatgaacagcctgacgagccgaggacaccggcctctattacnggtcacgagagatacgagacggtanagtacgcagcagtctcgcgactacgtcggggacccaacggtaccctggtacaccgtcctcctcgacgccctaccgaccgaacggccctagtcccgtccttaccccgcgtcccaccctcctaccaacgtcgccgtacccgtcggtcgggaccaccgacggcccggtcccggtacgggtccgtaccggtccgttacgggtaccgaacggttacccttaaccgttacccgtacgtaccgttaacccgtaaccgttaccggtacggtaccgggtccggggaccgttacggggaacccggtaaggacccgggtagtaaccgtacgg

SEQ ID NO: 78636 - DNA, 648 bp, Homo sapiens
  misc_feature: GYAE6OF01E5L9H.37.26.C04.1.454.CMB.1.raw
  modified_base (242)..(242): a, c, t, g, unknown or other
  misc_feature (242)..(242): n is a, c, g, or t
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaagggctggagtggtctcaggtattacgtggtagtggtaataccgcatactacgcagactccgtgacgggtccgtcaccgtcnccagacgacaattccaagactacggtctatctaggaaatgaacngcctgagacgccgaggaccacggtccctntattacgngtgcgagagatcgaagtacggatatagacgagcgagcctacgtacgacgtacggcggggacccgaaccggtaacccgtggtacccacccgttcctccctcgaccgtccctacccgaccgaccgggaccctacggttcccggttcccttaccccgcggtaccctacccctcctaccgaacggaccaccgtaccgtcggtcggggaccaccggacgccgggccgtacgggccgtcgtcccgtaggtaccgaacggtacttaccgttacacttaccgtaacctactacgtcggacggccgggtacgtcgggacgaaggcgacgtagtg

SEQ ID NO: 78637 - DNA, 859 bp, Homo sapiens
  misc_feature: GYAE6OF01ELS4C.37.26.C04.1.454.CMB.1.raw
  modified_base (220)..(220): a, c, t, g, unknown or other
  misc_feature (220)..(220): n is a, c, g, or t
  modified_base (344)..(344): a, c, t, g, unknown or other
  misc_feature (344)..(344): n is a, c, g, or t
tcagtagtgtagatcacgaccggtgctcgatttagtctagcgactttgggtttgggggaggcttggtacagccgtggggggtccctgagactctcctgtgcagcctcttggtttcatctttagcaacctacgccatgagcgtgggtcccgccgaggctccgaggggaaggggctgggaggtgggtctcgaggttatttacgtggtagtggtaactaccgnaatactacgcagactccggtggaccgggtccggtttcaccgtctaccgagaacgactaattccgaaagtaacgtacggtctaatcgtaggaaatgaacagcctgagagcgagacgacggccctntattacgtgtgcgagagatcgaggacggagtaatagcgagcgagtctcgtagaccgttaccggtcggggaccccaaaccggggtaaccccgttcgggtacccgtaaccccggttcccttaccccttacccgacccggtccccgttaccccgaaccccggtaaacccggggtacccccgtaaccggtttcccccgggtttccccccgttttcccccccggttaccggtacccccgtaacccccccgttacccccgttaaccccgaaaccgggtaccgtacccgtaacccccggttccgggttacccggggggaccctaaccgggaccgggacccccggggtccccggttacgggggtcccgttccgggtccccggttaggggttaaccccgtaaacgggtaccccgttaaccgtttaccccgtaacgtttacccgtaacccgtaaccgttaccggtcgggtacccgggtacccggggaccgttacgggaccggaaagggtccgaacgtaaggtacg

SEQ ID NO: 78638 - DNA, 644 bp, Homo sapiens
  misc_feature: GYAE6OF01BA82M.37.26.C04.1.454.CMB.1.raw
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (338)..(338): a, c, t, g, unknown or other
  misc_feature (338)..(338): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactcgtgacgggccggttcaccgtctccagagacaattccaagaatacggtctatctaggaatgaacngcctgagagccgaggacacggcctntatactgtgcgagagatcaggtacgagtanagcagcagctcgtgactacgtggggacccacggaacctggtaccaccgtctcctcacgcctaccgaccgaacgggtccccacgttccgtacccttccccgtcggtaccctacccgtaccctacccgaaggaccgacccgtaccctccggaacgacgaccgaccgacggccgggacccctggggccctaggtccccggttagggttacccgaaacgggttacccttaccttaccctacgttaccctaccctacgttaccgcggacgggtcccgggacttacgggaccgtaacgggccctgtaaacgg

SEQ ID NO: 78639 - DNA, 769 bp, Homo sapiens
  misc_feature: GYAE6OF01D3C0D.37.26.C04.1.454.CMB.1.raw
  modified_base (214)..(214): a, c, t, g, unknown or other
  misc_feature (214)..(214): n is a, c, g, or t
  modified_base (760)..(760): a, c, t, g, unknown or other
  misc_feature (760)..(760): n is a, c, g, or t
tcagtagtgtagatcacgaccggtgctcgatttagtctagcgactttgggtttgggggaggcttggtacagccgtggggggtccctgagactctcctgtgcagcctctggtttcatctttagcaactacgccatgagcgtgggtccgccaggcctccgaggggaagggctgggagtgggtctcgaggttattacgtggtagtggtaactaccgnatactacgcagacctccgtggacgggtccgttcaccgtctcgagacgaactaacttaccaaagtaacgttacggtctattacgtaggaaattcgaactcgcctaggaacgacgtaccggagaccgtaccggtccccttacttaacgtttacggtggtacggaccggtaaggacgtacgtacgaaggggtaaccggtaagttaatacggacaaggtccacgtccgtcgtacggtacgtaccggtacggggaacccaaccggtacccgtcggtaccctaccggttcctaccgtacgacccggccctacccgaccgtacccgggtaccctacggttccccgttccccgttcccgaccggtaccctacccccgtaccgtaaccgacgtacccgtaccgtaccggtcgggtacgggaccaccggtaccgggtcccggcccggttacggaccgttccgtcccgttacggtaccgaacggtacccttacgtacctacttacccgtaccgtacgttacgcggaccggtaccgggacgttacggaccgaagggcncgtagtacg

SEQ ID NO: 78640 - DNA, 720 bp, Homo sapiens
  misc_feature: GYAE6OF01D221M.37.26.C04.1.454.CMB.1.raw
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
  modified_base (335)..(335): a, c, t, g, unknown or other
  misc_feature (335)..(335): n is a, c, g, or t
tcagtagtgtagatcacgaccggtgctcgatttagtctagcgactttgggtttgggggaggcttggtacagcctggggggtccctgagactctcctgtgcagcctctggtttcattctttagcaactacgccatgagcgtgggtccgccaggcctccgaggggaagggctggagtgggtctcgaggttattacgtggtagtgtaaactaccgnatactacgcagactcggnggacgggtccgttcaccgtctcgagagactaatccaagaactacggtctatcgtagaatacgaacncgccgtgagacgacggagacnccggccttatacttcgngtagacgagagactcgaaggacggtagtaacgtacgcgtacgctacggtcttacgacgtaccgtacgggtcggggaaccccaacgggttaaccccgtggaacccctcccgttccgtacccgtacgacccgttccgtacccgaaccgaaccgggtcccctacggttccccgttacccccgtccccgacgtacccctaaccccttacccgtaaccgaacgacccgtacccgtacccggtccgggtacggaccacgggacccggtcccgggtccggacggtccgtaccgcgttacggaccgaacgtaccttactaccgtactacccgtacgttaccggtacgtcgggacccgggtcgggacgtacgggtacggaacggcctagtcgag

SEQ ID NO: 78641 - DNA, 636 bp, Homo sapiens
  misc_feature: GYAE6OF01D5TMC.37.26.C04.1.454.CMB.1.raw
  modified_base (204)..(204): a, c, t, g, unknown or other
  misc_feature (204)..(204): n is a, c, g, or t
  modified_base (268)..(268): a, c, t, g, unknown or other
  misc_feature (268)..(268): n is a, c, g, or t
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
  modified_base (388)..(388): a, c, t, g, unknown or other
  misc_feature (388)..(388): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgcatgagctgggtccgccaggctccagggaaggggctggagtgggtctcaggtattactggtagtggtaataccgnatactacgcagactccgtgacgggccgttcaccgtctccagagacaattccaaagaatacggtntatctggaaatgaacagcctgagagccgaggacacggcccctntatttactgtgcgagagatcgaagacggatanagcagcagctctgactacgtgggacccaacggtaccctggtaccncccgttctcctcgaccgtccctacccaaccgaacggcccctacgtccggttcccttcccccgtcggtccctacccctcccgtacccgaaacgaccgacctacccgtccggtcgggggtaccaccgacgggcccgggtcccggtcggggtccgtccgtccgttaggtaccgaacggtacctaccttccacgttaccgtaacctaccttacgtcgacgggccggacgtacggacgaacggccgcgagtag

SEQ ID NO: 78642 - DNA, 807 bp, Homo sapiens
  misc_feature: GYAE6OF01AVHHV.37.26.C04.1.454.CMB.1.raw
  modified_base (415)..(415): a, c, t, g, unknown or other
  misc_feature (415)..(415): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgagggaggggctggagtgggtctcgaggtattacgtggtagtggtaactccgcatacgacgcagacctccggtggaccgggccgttcaccgtctccgagacgactaacttaccgaaagtaacgtaccggtctaactcgtaaggtaaatacgaaacgacgcccgtaggaacgacggacccgaacgggaaccgaacccggtccccttacttaagttaccgttgtcggaacgaaggagacgttacgaaggtaacggagttaanacggacacggtcgacgtcgtacgtacgtaaccgttaacggggccgggtaccccgtaaaccgggtaacccgttcgggtaccctaacccggttcctacccgtaccgaacccgtcccccgtaccgtaaacccgggaccggtacccccgtaacggttcccccggtttacccccgtaccccgtccggacccctaaccccctcccgtaacccgaaagtacccgactaccccggttcgggaccgggacccgacggccggtacccggtccggtcggtaccgtccgtaccggtaggttaaccaccggtacctttaccgaccccgtatttaacccgaccgtaaccttcgggtaccggacggggtacccgtcggtaaccggacggtaccggactacggtagcg

SEQ ID NO: 78643 - DNA, 745 bp, Homo sapiens
  misc_feature: GYAE6OF01DJE8I.37.26.C04.1.454.CMB.1.raw
tcagtagtgtagatcacgaccggtgctcgatttagtctagcgactttggggtttgggggaggcttggtacagcctggggggtccctgagactctcctgtgcagcctctggtttcatctttagcaactacgccatgagctgggtccgccaggctccagggaaggggctggagtgggtctcgaggtattactggtagtggtaataccgcatactacgcagactccgtgaccgggccgttcaccgtctccagagacaattccaaagaactacggtctatctaggaaatgaacagcctagagagccgaggacacggtcctatattactggtgacgagacgatcgaaggacgtatagagcaagcagtctactagaccttacggcggggacccaaccggtaacccttggtaccctacccgttcctacccgtcgaaccgtcccctacccgaacccggaacgggtaccccgtacgttcccgggtttcccctttcccccgtacggtacccctaaccccctcccgttaacccgaaacggacccgacccgtaccccgtcgggtacgggggacccaaccggacgggaccccgggtccccggtaccggggtcctcggtcccggtacgggttaaccgaaccgggtaccctttaaccggttaccctaacgttacccctaaacccgtaacctttaaccggtacgggtaccgggtaccgggccggttaccgggaaccggaacgggacccgagtaaccgtaag

SEQ ID NO: 78644 - DNA, 584 bp, Homo sapiens
  misc_feature: GYAE6OF01DOSVM.37.26.C04.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (268)..(268): a, c, t, g, unknown or other
  misc_feature (268)..(268): n is a, c, g, or t
  modified_base (309)..(309): a, c, t, g, unknown or other
  misc_feature (309)..(309): n is a, c, g, or t
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgnatactacgnagactccgtgacgggccgttcacgtctcagagacaattccaaagaatacggtntatctggaaatgaacagcctgagagccgaggacacggcctntattactgtgcgagagatcagacggatanagcagcagctcngactacgnggggaccacggaaccctggcaccgtctcctcacgtcctccaccgacggaccacgtacgtcccttccctcggccacccctcctaccgaacgacgacaccgtcgtcggggcacgacgccggcccgtcgggccgtcgtccgttcggacgtaacggtaacctaccgttacctacttccgtaccaacgttacgtcgacggcacgggggggggtcacggaggcgcgagtacg

SEQ ID NO: 78645 - DNA, 735 bp, Homo sapiens
  misc_feature: GYAE6OF01A1FG9.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcgaggtattacgtggtagtggtaataccgcatactacgcagactccgtgacgggccgttcaccgtctccgagagactaacttccaaagtaattcggtctaatctaggaaatgaacagcctgagacgccgaaggaccaccggccttctattacgtgtgcgagagatcaaggacggagtagtgacagacgagctcgtagaactacggtcggggaccctaaccggtaacccgtggtaccctaccggtcctccgtcgaccgtcccctacccgacccggaaccgggtacccctacgttccccggttaccccttccccccgtcggtacccctacccccgttaccctacccgaacggaccgtaccccgtaacccgttcggtacggggacccaaccggaccgggccccggtacccggttccgggaccgttcggtcccgttacgggtacccgtaaccgtacccgttacccttacccgtaaccgttaccgttaaccgtaaccgttacgggtaccggaccgggttccgggacccgttcgggaacccgtaacgggccgaacgtaacgtg

SEQ ID NO: 78646 - DNA, 689 bp, Homo sapiens
  misc_feature: GYAE6OF01A8E8I.37.26.C04.1.454.CMB.1.raw
  modified_base (211)..(211): a, c, t, g, unknown or other
  misc_feature (211)..(211): n is a, c, g, or t
  modified_base (682)..(682): a, c, t, g, unknown or other
  misc_feature (682)..(682): n is a, c, g, or t
  modified_base (688)..(688): a, c, t, g, unknown or other
  misc_feature (688)..(688): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctggagtgggtctcgaggttattacgtggtagtggtaactaccgnatactacgcagactccgtggaccgggccgttcaccgtctccagagactaattccaagtaatcggtctatctaggaaatgaaacagcctaggagacgccggaaggaccaccggtcccctgttaattacgtggtcgcgaagagtactcgaaggacggtatagtacgcagcagtctcgtagacgtacggtcgggacccaaccgggaacccgttcggtacctacccgttcctccgtccgacccgtccctacccgaaccgaaccgggcccctacggttcccggttcccccttccccgtcggtacccctccccgtcccgtaccgaacgtcgacccgtaccgtcgggtcggggacctaacgcggcccgggtcccgtcgggtccgtaccggtccgttacgggtaccgtaacggtaccttacctaccgtactacccgtacctaccgtacgtcggaccggtccggacgtcggacgacggcncgtagng

SEQ ID NO: 78647 - DNA, 623 bp, Homo sapiens
  misc_feature: GYAE6OF01EZUKK.37.26.C04.1.454.CMB.1.raw
  modified_base (206)..(206): a, c, t, g, unknown or other
  misc_feature (206)..(206): n is a, c, g, or t
  modified_base (286)..(286): a, c, t, g, unknown or other
  misc_feature (286)..(286): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgnatactacgcagactccgtgacgggccgttcaccgtctccagagacaattccaagaatacggtctatctaggaaatgaacngctgagagcgaggacgacgccctctattactgtgcgagagatcgagaggagtatagcgagcagctactgacgtacgtcggggacccaccggtaacccgtgtaccacccgtcgtccctcgacgtccctacccacccgtaaccggccctacgttcccggttcccttcccccgtcgtccctacccctccctaccgaacgacgacccgtaccgtcggtacggggccaacgccggacccggtcccgtcggggtcctcggtccgtcggtacgaacggtacttaccttccacgttacgtacctactacgtcggacggtcgggcgtcggacgaacggcgcacgtg

SEQ ID NO: 78648 - DNA, 566 bp, Homo sapiens
  misc_feature: GYAE6OF01D9ZMQ.37.26.C04.1.454.CMB.1.raw
  modified_base (319)..(319): a, c, t, g, unknown or other
  misc_feature (319)..(319): n is a, c, g, or t
  modified_base (368)..(368): a, c, t, g, unknown or other
  misc_feature (368)..(368): n is a, c, g, or t
  modified_base (442)..(442): a, c, t, g, unknown or other
  misc_feature (442)..(442): n is a, c, g, or t
  modified_base (539)..(539): a, c, t, g, unknown or other
  misc_feature (539)..(539): n is a, c, g, or t
  modified_base (564)..(564): a, c, t, g, unknown or other
  misc_feature (564)..(564): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagcgtgggtccgccaggctccaggggaaggggctggagtgggtctcaggtattactggtagtggtaaataccgcatactacgcagactccgtgacgggccggttcaccgtctccagagacaattccaaagaatacggtctatctaggaaatgaacagcctgaagagccgaaggacacggccctntaatactgtgcgagagatcagacgagtatagcagcagctctgactacgnggggaccaaccggaaccctggcaccgtctcctcagccctaccaccaacgggcccagtccggttccttcccccgnggcccacccctccctacaacgagcctacctcgtcggggcacgacgccggcccgtgggctgcctggtacaacggactaacttccatcctaacactacnggacgcgggctggacaaggccgcanag

SEQ ID NO: 78649 - DNA, 614 bp, Homo sapiens
  misc_feature: GYAE6OF01B3ES7.37.26.C04.1.454.CMB.1.raw
  modified_base (609)..(609): a, c, t, g, unknown or other
  misc_feature (609)..(609): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagacgacaattccaaagaatacggtctatctggaaatgaacagcctgagagccgaggacaccggccctctattactgtgcgagagatcagacggagtatagcagcagctctgactacgtggggcccacggaaccctggtccaccgtctccctcacgccctccaacccgacgggccccacgtccggttcccttcccccgtcggccctacccctccctacccgaagaccgccctacccgttcggtcgggggaccacgaccggtaccgggccccgtgggtaccgtcggtccgttcgggtaccaacggtacctaccttcccattaccctacgtactacgtcggacggccgggtcgtcggacgaggccgnagtcg

SEQ ID NO: 78650 - DNA, 587 bp, Homo sapiens
  misc_feature: GYAE6OF01DWF8O.37.26.C04.1.454.CMB.1.raw
  modified_base (315)..(315): a, c, t, g, unknown or other
  misc_feature (315)..(315): n is a, c, g, or t
  modified_base (391)..(391): a, c, t, g, unknown or other
  misc_feature (391)..(391): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagacctccgtgacgggccgttcaccgtctccagagacaattccaaagatacggtctatctaggaaatgaacagcctagagagccgaggacaccggccctntattactgtgcgagagatcagacggatatagcagcagctctgactacgtcgggccaacggaccctggccaccgtcncctcacgcctccaccgaacggcccagtccggtccctttccccgcggccctacccctcctaccgaacgacgccaccgtcgtacggggccacgacgccggcccgtcgggcctacgcccgttcggtacaacggtaccttaccttccgtaacttcctactaacttacggtcgacggccggcgtcggacgaggcgcagtcg

SEQ ID NO: 78651 - DNA, 836 bp, Homo sapiens
  misc_feature: GYAE6OF01CMBDA.37.26.C04.1.454.CMB.1.raw
  modified_base (313)..(313): a, c, t, g, unknown or other
  misc_feature (313)..(313): n is a, c, g, or t
  modified_base (827)..(827): a, c, t, g, unknown or other
  misc_feature (827)..(827): n is a, c, g, or t
tcagtagtgtagatcacgaccggtgctcgatttagtctagcgactttggggtttgggggaggcttggtacagcctggggggtccctgagactctcctgtgcagcctctggtttcattctttagcaactacgccatgagcgtgggtccgccgaggcctcgaagggggaaggggctgggaggtgggtctcgtaggttattacgtggtagtaggtaaactaccgctaatacgtacgcagtacctccggtggaccgggtccggttacaccgttcaccgaaggaacgaactaacgttaccaaaggtaacgttacggtnttaacgttcgtaagggaaattacggaaactacgccgtaggaacggacggcccgggaaaggacccgaccgggtcccctttacgttaactttacgtacggtcggaacggaacgaagtacgtacggaacggtaacgggtaagttaacgaacggcgtaacggcgaccggtacttagtaacggtaccggtaacgggtccggggaaccccgaacccgggtaacctttcgggtaccctacccggttcctaccgtaccgaccgacccctaccgaacccggaaccggtcccctacgttcccggttcccccgttccccgtcggtacccctaccccgtaccgtaacccgaacggacccgcctacccggtcggggtacgggacctaaccggaccggtccccgggtccgggtccgggtccgtccgggtaccggttacggtaccgtaacgttaccttcctacccgtacttaccgtaacctcggtaacggtcggaccgggtcgggtaccggtaggtaccgaacggtcgngtaacggtc

SEQ ID NO: 78652 - DNA, 683 bp, Homo sapiens
  misc_feature: GYAE6OF01CWEDC.37.26.C04.1.454.CMB.1.raw
  modified_base (146)..(146): a, c, t, g, unknown or other
  misc_feature (146)..(146): n is a, c, g, or t
  modified_base (322)..(322): a, c, t, g, unknown or other
  misc_feature (322)..(322): n is a, c, g, or t
  modified_base (583)..(583): a, c, t, g, unknown or other
  misc_feature (583)..(583): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccnccaggcctccgagggaaggggctggagtgggtctcgaggtattactggtagtggtaataccgcatactacgcagactccgtgaccgggccgttcaccgtctccagagactaatccaaagaatacggtctatctaggaaatgaacagcctgagagccgaggacacgcctctattacngtgcgagacgatacgaaggacggtaatagtacgacgacgcaacggtcttacgtacgaacgttaccggtacgggggaccccaaaccgggtaaccccgtgggttacccacccggttacctcccgttaccgaccgcccctacccgaaccgaaaccgggcccctaacgttcccgggtcccttcccccgtcggaccccaccccttaccctaccgaaacgtaccgccaacccgtcggtcggggaccaacgaccggccggttcccggnggtccgtcgccgtcgtacgaacggtaccttacgtaccgtataccgtaacctacgtaactcggtaacggccgggacgtcggacctagggccgtagacgtag

SEQ ID NO: 78653 - DNA, 605 bp, Homo sapiens
  misc_feature: GYAE6OF01BZ16K.37.26.C04.1.454.CMB.1.raw
  modified_base (205)..(205): a, c, t, g, unknown or other
  misc_feature (205)..(205): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgnatactacgcagactccgtgacgggccgttcaccgtctccagagacaattccaagaatacggtctatctggaaatgaacagcctgagagccgaggacaccggccctctattactgtgcgagagatcgagacggagtatagcagcagctctgactcgtggggccacggaaccctggtccaccgtctcctcacgccctccgaccgaacgggcccagtccggttcccttcccccgtcggccctacccctcccaccaagccgccacccgtcggtcggggccacgacggcccggcccggtggggtcctcggcccgtgggtaccgaacgggaccttaccttccacttccgtaaccacttaccggtggaccgggtccgggcgtcgggaccgaaggccgacgagtacgg

SEQ ID NO: 78654 - DNA, 632 bp, Homo sapiens
  misc_feature: GYAE6OF01DDETJ.37.26.C04.1.454.CMB.1.raw
  modified_base (319)..(319): a, c, t, g, unknown or other
  misc_feature (319)..(319): n is a, c, g, or t
  modified_base (326)..(326): a, c, t, g, unknown or other
  misc_feature (326)..(326): n is a, c, g, or t
  modified_base (626)..(627): a, c, t, g, unknown or other
  misc_feature (626)..(627): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctgggagtgggtctcaggtattactggtagtggtaataccgcatactacgcagacctccgtgaccgggccggttcaccgtctccagagacaattccaaagtaatacggtctatctaggaaatgaacagcctgagacgccgagacacggccctntattacngtgcgagagatcaggacggagtacagcagcagctctcgactcggtcggggacccacgggacctgggtcctaccggtctccgtcacgtccctacccaaccgacggccctacgtaccggtccccttccccgtcggccctacccctaccctaccgtaacggaccgccgtacccgttcggtcgggggtaccacgaccggcccgggcccggtcgggccgtcggccgttacggtaccgaacggtacccttactaccacttaccgtacctaccgtacgtgacggtcgggtcgtacggacgacggcgnngtacg

SEQ ID NO: 78655 - DNA, 586 bp, Homo sapiens
  misc_feature: GYAE6OF01EAK2S.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctaggaaatgaacagcctgagagccgaggacacggccctctattactggtgcgagagatcagacggatatagcagcagctctgactacgtgggccaacggaccctggtccaccgtctcctcacgcctacaccgaacggccgactccggttcccttccccgtcggcctacccccgtcctaccaacgacgccgacctcgtacggggccacgacgccggccgtcgggctcgccgtgtacgtacggacctacttacccatacctactaccttacgtcggacggtccgggaccggtggacctaaggccgcgtaagtag

SEQ ID NO: 78656 - DNA, 717 bp, Homo sapiens
  misc_feature: GYAE6OF01DD32T.37.26.C04.1.454.CMB.1.raw
  modified_base (175)..(175): a, c, t, g, unknown or other
  misc_feature (175)..(175): n is a, c, g, or t
  modified_base (357)..(357): a, c, t, g, unknown or other
  misc_feature (357)..(357): n is a, c, g, or t
  modified_base (664)..(664): a, c, t, g, unknown or other
  misc_feature (664)..(664): n is a, c, g, or t
  modified_base (706)..(706): a, c, t, g, unknown or other
  misc_feature (706)..(706): n is a, c, g, or t
tcagtagtgtagatcacgaccggtgctcgatttagtctagcgactttgggtttgggggaggcttggtacagccgtggggggtccctgagactctcctgtgcagcctctggttcatcttagcaactacgcatgagctgggtccgccaggctccgagggaagggctggagtgggtcncgaggtattactggtagtggtaataccgcaatacacgcagactcgtggacgggccgttcaccgtctccgagagacaattccaaagtaatacggtctatgtaaggaaatcgaacgagcctaggagacgaccgaggtaacaccggcccctagttatacgtgtcgcgagagatcgagacggatanagacatcaagtctactgtaaccgtcggtacgggaccctaaccgggtaacccgtggtaccctacccgttctccgtacgaccgtccccaaccgaacccgaaacggtcccctaacgttccccgggttaccccttaccccggcggtaacccctaccccctaccgtaaccgaacgaccgtaccctaccggttacgggccgggacaaccggtacggccccgggtaccgttgggcccgtacggtaccggttaccgggaacgtaacggttacccttaaccgttacctaaccttaccgtaaccttaaacggttacncggggaaccgggtacgggtacgtcgggaaaaccgtgggaacncgttaacggaa

SEQ ID NO: 78657 - DNA, 570 bp, Homo sapiens
  misc_feature: GYAE6OF01BOQ6D.37.26.C04.1.454.CMB.1.raw
  modified_base (353)..(353): a, c, t, g, unknown or other
  misc_feature (353)..(353): n is a, c, g, or t
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
  modified_base (421)..(421): a, c, t, g, unknown or other
  misc_feature (421)..(421): n is a, c, g, or t
  modified_base (474)..(474): a, c, t, g, unknown or other
  misc_feature (474)..(474): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccggttcaccgtctccagagacaattccaagatacggtctatctggaaatgaacagcctgagagccgaggacacggccctcgtattactgtgcgagagatcagacggagtatagcagcagctntgactcgtgggccacggaccngtcacgtcncncacgtccnccaccacgggccagtccgtcccttcccncgccaccctccctctaacgcgccaccgtcgtacggggccacgcgccggcccgngggctcgccgtggtacaacggtacctacgttacccacttccctacgtaccctacgttcggacgtccgggcgtacgggacgaacgggcgcgagtacg

SEQ ID NO: 78658 - DNA, 602 bp, Homo sapiens
  misc_feature: GYAE6OF01AOUQG.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaaacagcctgagagcccgaggacacggcccctctatttactgtgcgagagatcagacggatatagcagcagctctgactactggggccacggaaccctgggtaccaccgtctccctccagccctcccaccaacgggccccacgtccggttcccttcccccgtgggcccacccgtccctccaagcgcaccctcgtcggggcacgcgccggcccgtgggcctggcccgttcggtccgaagggtaccttacccttccgacttacccgtactacccttaacgtcggacggtccggggtcgtcgggaccgaagggccgcgagtacgg

SEQ ID NO: 78659 - DNA, 576 bp, Homo sapiens
  misc_feature: GYAE6OF01A4SVV.37.26.C04.1.454.CMB.1.raw
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
  modified_base (428)..(428): a, c, t, g, unknown or other
  misc_feature (428)..(428): n is a, c, g, or t
  modified_base (571)..(571): a, c, t, g, unknown or other
  misc_feature (571)..(571): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgnatactacgcagactccgtgacgggccgttcacgtcncagagacaattccaagatacggctatctggaaatgaacagcctagagagccgaggacacggcctctattactgtgcgagagatcagacgagtatagcagcagctctgactacgtcggggaccaacggacctggccaccggtctcctcacgccctccaccgaacggcccactcggtcccttcccccgnggaccaccccgtccctaccaagacgaccaccgtcggtcggggccaacgcggccggcccgtgggtcctcgtccgtacggtacaacgaccttacctccaagttacctaactactacgtggacggcggacgtcggacgaaggcgcngtacg

SEQ ID NO: 78660 - DNA, 603 bp, Homo sapiens
  misc_feature: GYAE6OF01DDGME.37.26.C04.1.454.CMB.1.raw
  modified_base (317)..(317): a, c, t, g, unknown or other
  misc_feature (317)..(317): n is a, c, g, or t
  modified_base (347)..(347): a, c, t, g, unknown or other
  misc_feature (347)..(347): n is a, c, g, or t
  modified_base (599)..(599): a, c, t, g, unknown or other
  misc_feature (599)..(599): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaactaccgcatactacgcagactccgtgaccgggccggttcaccgtctccagagacaattccaaagaatacggtctatctaggaaatgaacagcctgagagccgaggacacggcccttntattactgtgcgagagatcgagacggatanagcagcagctctagactacgtcggggacccaacggaccctggccaccgtcctcctacacgtccctaccgaccgaacggcccacgtccggttccccttccccgcggaccctacccctccctaccgaacgacgaccaccgttcggcggggaccacgacggccggtcccggtcgggcctcgccgtcggtacgaacggtcctacgttacccatacctactactacgtgggacggcggcgtcggacgaaggccggangtag

SEQ ID NO: 78661 - DNA, 575 bp, Homo sapiens
  misc_feature: GYAE6OF01DW8C8.37.26.C04.1.454.CMB.1.raw
  modified_base (248)..(248): a, c, t, g, unknown or other
  misc_feature (248)..(248): n is a, c, g, or t
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
  modified_base (353)..(353): a, c, t, g, unknown or other
  misc_feature (353)..(353): n is a, c, g, or t
  modified_base (391)..(391): a, c, t, g, unknown or other
  misc_feature (391)..(391): n is a, c, g, or t
  modified_base (450)..(450): a, c, t, g, unknown or other
  misc_feature (450)..(450): n is a, c, g, or t
tcagtagtgtagatcacgaccggtgctcgatttagtctagcgactttgggtttgggggaggcttggtacagcctggggggtccctgagactctcctgtgcagcctctggttcatctttagcaactacgccatgagctgggtccgccaggctccagggaaggggctggagtgggtctcaggtattactggtagtggtaataccgcatactacgcagactccgtgaccgggccgttcaccgtctccaganacaattccaagaatacggtctatctaggaaatgaacagcctgagngccgaggacacggccctntattactgtgcgagagatcgagacggagtatagcagcagctngactacgtcgggaccacggacctggcctaccgtctccnacgccctaccacgacggccctagtccgtcccttcccgcgccaccctccctacaacgacncctcctacggtcgggaccacgacgccggccgtcggcgtcgtccgtacggtcaacggtccttaccgtccacttaccgtacctacgtcgtcggacgggccgggcgtcggacgtaaggcgcgtagtag

SEQ ID NO: 78662 - DNA, 831 bp, Homo sapiens
  misc_feature: GYAE6OF01ATELJ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctggagtgggtctcaggttattactgggtagtggtaactaccgcatactacgcagactccggtggacgggccgttcaccgtctccagagacaattccaaagaatacggtctaatctaggaaatcgaacagcctgagacgccgaggacaccggccctatactttactgtgacgaggagtactacgacggacgggtaagtaagttacgacgaacggcgtaacggtcctaccgttaggtacccttaaccgggttcgggggaaccccgtaaacccgggaacccgttccgggtacccgttacccgttcccgttaccccgtcgtaaccgtccccctacccggaaccccgaaccggggtccccgtaaccggtttccccgggtttccccgtttacccccccggttccgggacccctaccccccgttacccccgtaccgtaaaccggcccgaacccttacccggtcccgggttccgggggaacctaaccgggaccggtcccccgggtcccggttaccggggtcccttacgggtccccgttgggtacccggtaaaccgggtacctttaccccggttcctaaccttaccgttaacccgttaccttaccggttcgggaacccggggtcccgggaccgttacggggtaccgggaaggttcccggacgttaacgtcggg

SEQ ID NO: 78663 - DNA, 720 bp, Homo sapiens
  misc_feature: GYAE6OF01A78H7.37.26.C04.1.454.CMB.1.raw
  modified_base (143)..(143): a, c, t, g, unknown or other
  misc_feature (143)..(143): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (375)..(375): a, c, t, g, unknown or other
  misc_feature (375)..(375): n is a, c, g, or t
tcagtagtgtagatcacgaccggtgctcgatttagtctagcgactttgggtttgggggaggcttggtacagcctggggggtccctgagactctcctgtgcagcctctggttcatctttagcaactacgcatgagctgggtccncaggctccaggggaagggctggagtgggtctcgaggttattacgtggtagtaggtaactaccggctaatactacgcagtcctccggtgaccgggtccggttcaccgtctaccagacgactaacttccgaaagacgttacggtctatccgttaggaaattgaacacgcctagagacgccgaaggaccaccggccctntaattcgngtcgacgagacgatcgaagacggattanacgcagctacgcttcgcgaactacggtcgggacccaaccgggtaacctcggtaccaccgttctcccgtcaccgtccctacccgaaccgaccgggtccctaccggttcccgttccccttacccccgtccgacccttacccccgtccctaaccgaacggtaccgtacccgtaacccggtccgggtacggggacctacggaccggtccccggggtcccgtacggggtccgttccggtaccgttacgggtaaccgaaccggttacccttaccgttaccacgttaccctaccgtacttacggtcggacggtaccgggtccggtacgggaacggagtaccgtagaaggtac

SEQ ID NO: 78664 - DNA, 723 bp, Homo sapiens
  misc_feature: GYAE6OF01ACYMZ.37.26.C04.1.454.CMB.1.raw
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctggagtgggtctcaggtattactggtagtggtaactaccgcaatactacgcagacctccggtggaccggggtccgttcaccgttctccgagagaactaacttaccaaagtactacggtctaatcgtaggaaatgaacngcctgagngccgagccacggcctctatttacgngtcgcgagagactacgagacgggatanacgcagcagctcgtcgaacgtcggtcggggacccaaccgggtacccttcggtacccacccggttcctcctccgaccgtccccgtacccgaaccggaaccgggccctacgttcccggttccccttccccggtccggacccctaccccgtacccgtaccgaacggtaccgcccgtaccggtccgggtacggggacccacggaccggcccgggtacccggtcgggtccgtccggtccggttaccggtaccgaacggttacccttacccgttacccgtaaccttacccgtaacccgtaccgtttacggtcgggtaccgggtaccggggtacgtcgggaacgaaccgggcgaccgtaggtacg

SEQ ID NO: 78665 - DNA, 637 bp, Homo sapiens
  misc_feature: GYAE6OF01AETNO.37.26.C04.1.454.CMB.1.raw
  modified_base (179)..(179): a, c, t, g, unknown or other
  misc_feature (179)..(179): n is a, c, g, or t
  modified_base (362)..(362): a, c, t, g, unknown or other
  misc_feature (362)..(362): n is a, c, g, or t
  modified_base (412)..(412): a, c, t, g, unknown or other
  misc_feature (412)..(412): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctnaggtattacgtggtagtggtaataccgcatactacgcagactccgtgacgggccgttcaccgtctccagagacaacttccaagaatacggtctatcgtaggaaatgaacagcctagagagccgaggaccacggcctctattactgtgcgagagatacgaggacggagtatagcagcagctcgngactacggcgggacccgaccggtaaccgtggtcccaccgttctccctacncgccctaccgaccgaaccggtcccagtcccggtcccttaccccgtcggcccctaccccgtccctaccgaagaccgaccgtacccgtcgggtcggggacctacgaccggcccggcccgtcggggcctccggtccgtacggtaccgaacgtaccttccttacctacttacccgtaccgaccgttacgtcggaccgggcggtcgtacggaacgagggccagtacgtag

SEQ ID NO: 78666 - DNA, 808 bp, Homo sapiens
  misc_feature: GYAE6OF01EBN6X.37.26.C04.1.454.CMB.1.raw
  modified_base (380)..(380): a, c, t, g, unknown or other
  misc_feature (380)..(380): n is a, c, g, or t
  modified_base (504)..(504): a, c, t, g, unknown or other
  misc_feature (504)..(504): n is a, c, g, or t
  modified_base (514)..(514): a, c, t, g, unknown or other
  misc_feature (514)..(514): n is a, c, g, or t
tcagtagtgtagatcacgaccggtgctcgatttagtctagcgactttgggtttgggggaggcttggtacagccgtggggggtccctgagactctcctgtgcagcctctgttcatcttagcaactacgccatgagcgtggtccgccaggcctccgaggggaagggctggagtgggtctacgaggtattacgtggtagtggtaaactccgatatacctacgcagacctccggtaggaccgggccggtttccaccgtctaccgaagacgaactaacttccaaaagaacgttacggtctaagttcgtaaggaaaatcgaaactacggccgtagacggacggacccggaggaaccctaccggccctttacgttaacgtttaccgnggttcggacgaaggaagacgtaccgaaggtaacgggtaattaacgagaccgaacggcgtactccgtacggtactaccggtaccggtcggggtaccccgaaccggtaacccgttgggtaaccccnccgtttcccncccgttacgacccgtaccctacccgaacccggaccggtacccgtacgtttccccgttacccccgttaccccgcggtaaccccctccccgtttacccgaacccgttacgaaccccgtcccgtaaccgtcccggggtacgggaccgtaacggcccggtcccggtcccggtacgggtccgtccggtacccgtacggtacccgtaacgggtaccctttacccgtacctaacttaccgtaccgtaacgtcggacggttcccggcgggtacgtacggaccggtacgtccgtagtgtacgg

SEQ ID NO: 78667 - DNA, 719 bp, Homo sapiens
  misc_feature: GYAE6OF01AQRWY.37.26.C04.1.454.CMB.1.raw
  modified_base (208)..(208): a, c, t, g, unknown or other
  misc_feature (208)..(208): n is a, c, g, or t
  modified_base (315)..(315): a, c, t, g, unknown or other
  misc_feature (315)..(315): n is a, c, g, or t
  modified_base (322)..(322): a, c, t, g, unknown or other
  misc_feature (322)..(322): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattacgtggtagtggtaaataccgnatactacgcagactccgtgacgggccgttcaccgtctccagagacaattccaaagaatacggtctatctaggaaatgaacagcctggagagccgagacacggccctntattacngtgcgaagagatcgagacgatagtagcacgcagctcgacgacgtacggtcggggaccaaccggtaccgtggaccctaccggttcctccacgacgtcccctacccgaaccgaaccggtacccctacgttccccggttccccttcccccgtacggacccctaccccgttcccctacccgaaacggtaccgacccgttaacccgttccgggtaccgggggtaccaacggacccgggtcccgggtccccggtacggggcccgttccgggtcccggttaccggtaccggtaaaccggttacccttaccgttacccgtaccttaccgtaacccgtaacccgttacgtcggggtaaccggtcccgggtaccgtacgggtacaaacggggcctaacggtgtaacg

SEQ ID NO: 78668 - DNA, 824 bp, Homo sapiens
  misc_feature: GYAE6OF01A6FTH.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgaggggaaggggctggagtgggtctcgaggtattacgtggtagtggtaactaccgcatactacgcagactccgtgacgggccgttcaccgtctcagagacaattccaagatacggtctatctaggaaatcgaacacgcctaggagacgccgaaggaccaccggcccttacgttaattacgtggtcgacgagagactcgaggacggtaagtatacgacacgcacgtctacgtacgacgttacggccgggtaacccaaaccgggtaacccgtcgggtacctacccggttctaccccgtacgacccgtccctaaccccgtaaaccggaacccgggtaccccgtaaccggttaccccgggtttccccccgtttaccccccgtacccgggtacccccttaaccccccgttaccccgttaaccccggaaaccggtacccggaccccgttaaccccggttacccgggtacccggggggtaaccctaacccggaaccgggtcccccgggttcccccgggtaccggggtccccgttaccgggttacccggttacgggtaacggtaaaccgggtaacccttaccgttacccgtaaccgttaccgttaacccgtaacgtaaccggtccggtacgggtccggtaccgggtacgggaccggtaacgggccgagtaacgtacg

SEQ ID NO: 78669 - DNA, 630 bp, Homo sapiens
  misc_feature: GYAE6OF01DPFAR.37.26.C04.1.454.CMB.1.raw
  modified_base (145)..(145): a, c, t, g, unknown or other
  misc_feature (145)..(145): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
  modified_base (347)..(347): a, c, t, g, unknown or other
  misc_feature (347)..(347): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccnccaggctccgaggggaaggggctggagtgggtctcaggtattactggtagtggtaataccgcatactacgcagactccgtgacgggccggttcaccgtctccagagacaattccaagaatacggtctatctaggaaatgaacagcctagagacgccgagacacggccctntatttacngtgcgagagatcgagacggtatanagcagcagctctgactagcggggccaaccgggaacctcggtcacccgtctccctcgaaccgccctacccgaaccgaaccgggcccctagttaccgggtccccctttcccccgtcggtccctacccctccctaccgaacgtacgaccacccgttacgtcggggaccaccgacggcccggacccgtgggctccggccgttggtacgaacggtaccttaccttaccgacttacgtaacctacgtacgtacggacggccgggacgtcgggacaacgggcagtagtag

SEQ ID NO: 78670 - DNA, 758 bp, Homo sapiens
  misc_feature: GYAE6OF01A6COF.37.26.C04.1.454.CMB.1.raw
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
  modified_base (294)..(294): a, c, t, g, unknown or other
  misc_feature (294)..(294): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgaggggaggggctggagtgggtctcaggtattacgtggtagtggtaatccgnatactacgcagactccggtgacgggtccgttcaccgtcnccagacgactaacttccaaagtatacggtctatcgtaggaaatgaacngcctgagcgccgagacacgcctntatcngtgcgagagatcgagacggtatagtacgacagcaggccttacgtacggtaaccgtaacggtccgggggtaacccaaacccgggtacccgttcgggtacccgtaccccgttacccgttccctacgacccgtccccgtaacccgtaacccggaaccgggtaccccgtaaccggttcccggttacccccgtttcccccggtaccggtacccctacccccgttacccctacccgtaaaccggtacccgtacccgtacccggtaccgggtacggggtacccgaaccggtaccgggcccgggtccccgggtaccgggttcccggtaccggttcccggtacgggttaccgaaccggtacccttaccgttcccgtaacgttaccgtaccgtacgtacggtcggacgggtccgggacggtacggacggaacggccgagtcgtacg

SEQ ID NO: 78671 - DNA, 565 bp, Homo sapiens
  misc_feature: GYAE6OF01B9YPD.37.26.C04.1.454.CMB.1.raw
  modified_base (322)..(322): a, c, t, g, unknown or other
  misc_feature (322)..(322): n is a, c, g, or t
  modified_base (360)..(360): a, c, t, g, unknown or other
  misc_feature (360)..(360): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattacgtggtagtggtaataccgcatactacgcagactccgtgacgggccgttcaccgtctccagagacaattccaaagaatacggtctatcgtaggaaaatgaaacagcctagagagccggaggaccacggtcccctntaactttacgtgtgcgaagagatcgaaggacggagtanagcaagcagctcagactacgcgggaccacggaacctgtccacgtctccnacncctccacgacgccactcgtcctcccgcgccaccctccncaacgcncacctcgcggacgacgcgcgccgcggtctcgtcgtaggtacgaacgtacctactacctactacgtacactacgtcgacgcgggtcgtacggacgaaggcacgtagtag

SEQ ID NO: 78672 - DNA, 582 bp, Homo sapiens
  misc_feature: GYAE6OF01BDFPU.37.26.C04.1.454.CMB.1.raw
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (547)..(547): a, c, t, g, unknown or other
  misc_feature (547)..(547): n is a, c, g, or t
  modified_base (576)..(576): a, c, t, g, unknown or other
  misc_feature (576)..(576): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcccctctatttactgtgcgagagatcagacgagtatagcagcagctcngactcgnggggccacggaaccctggtcaccgtctcctcacgccctccaccaacgggcccagtccggtccttcccccgtcggcccacccctccctcccaaggacgccacccgtcgtcgggggccaccgacgccggccccgtgggccgtcggcctcgggtcaacggtacctaccttcccatcctacacctaccgnggtacggccgggcgtcggacaagggccgngagtag

SEQ ID NO: 78673 - DNA, 760 bp, Homo sapiens
  misc_feature: GYAE6OF01C251E.37.26.C04.1.454.CMB.1.raw
  modified_base (214)..(214): a, c, t, g, unknown or other
  misc_feature (214)..(214): n is a, c, g, or t
  modified_base (315)..(315): a, c, t, g, unknown or other
  misc_feature (315)..(315): n is a, c, g, or t
tcagtagtgtagatcacgaccggtgctcgatttagtctagcgactttgggtttgggggaggcttggtacagcctggggggtccctgagactctcctgtgcagcctctggttcatcttagcaactacgccatgagcgtgggtccgccaggcctaccgaggggaaggggctgggaggtgggtctcgaaggtattacgtggtagtcggtaataccgntatacctacgcaagtactccggtaggaccgggtccgttcaccgtctaccgaagaacgaacacttaccgaagaatccggtatatcgtaaggaaatggaaccngccgtaaggacgacggaccgaacgggtaccaccggtcccttattagttaccgtggtaagaccgtaagacgaacgtacgaaggtaacggtattaagaggacacgtacagtccttgaacgtacctcgggtaccggggacccaaccgggtaccttgggccctaccggtcctaccacgaacccgtccctacccgaaccggaccggtacctacgtacccggttcccctcccgtaccgtacccgtacccttaccaccgtaacgtccgaccgtaccggtcggtacggggaccacggaacccggccggtcccggtcgggtacccgttcggtccggtaacggtaccgaacggtacccttaccgttaccgtacgttaacccgtaaccgacgttaccggtgggaacccgggtcgggtaccggtaaccgggtaacggaacccggacgtacgtgtacg

SEQ ID NO: 78674 - DNA, 787 bp, Homo sapiens
  misc_feature: GYAE6OF01AKPMG.37.26.C04.1.454.CMB.1.raw
  modified_base (179)..(179): a, c, t, g, unknown or other
  misc_feature (179)..(179): n is a, c, g, or t
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccaggggaagggctggagtgggtctnaggtattactggtagtggtaaataccgcatactacgcagactccggtgaccggggccgttcaccgtctccagagacaattaccaagaatacggtctatctaggaaatgaacagcctagagacgccgagacacggcctntattacgngtcgacgagagatacaaggacggtaataatacgcaaggcacgtctagcgtaacgtacgtacggggacccaaaccgggtaccccgtaggtccctaacccggttccttccctaccgaccgtaccctaccccgaaccgtaaacccgggacccctaaccggttcccggttacccccgtttacccccccggtaccgggtaccccgtaacccccccgtttaccccgtaaccccgaaaccggtaaccggtacccgtaccccggtttaccggtacggggggtaaccccaacccggtaaccgggccccggggttaccccggtccgggggttacccgaccggttccccgttacgggtaaccgtaaaccgggtacccgttaacccgttaccctaaccgtaccttaaaccgtaccgttaaccgtacggacgggtccgggtacccgtacggacgaaacgggccgacgtagtaacg

SEQ ID NO: 78675 - DNA, 814 bp, Homo sapiens
  misc_feature: GYAE6OF01DU995.37.26.C04.1.454.CMB.1.raw
  modified_base (207)..(207): a, c, t, g, unknown or other
  misc_feature (207)..(207): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgagggaagggctggagtgggtctcgaggtattactggtagtggtaataccgnatactacgcagactccgtgacggccgttcaccgtctccagagacaattccaaagaatacggtctatctaggaaatgaacagccgtgacgagccgaggaccaccggccctagtattactgtgcgagagatcgaagacggatagtagacagacagtctcgtagtaccgtacggtacgggggacccaacccgggtaacccgttcgggtaccctaacccggtttccttcccgttaccgaaccgtcccccgttacccgaaacccggtaaaccggggtccccctacggttccccggtttccccgttaccccccgtcggtaaccccctaccccgttaccctaaccgaaacggtcccgtaccgtaacccccgtttgggtaccgggggaccctaaacgtacccgggtaccccgggtcccccggttgggggtacccctttcgggtaccccggttaccgggtaacccgtaaacggttacccccgtttaacccgtttaccccgtaaacgtttaccccgttaaacccgttaaacccgttaacggtccgggtaacccgggtacgggtacccgggttacgggaacccggtaaacggggcccgttaaccgtaagttaaccggg

SEQ ID NO: 78676 - DNA, 711 bp, Homo sapiens
  misc_feature: GYAE6OF01A74U7.37.26.C04.1.454.CMB.1.raw
  modified_base (245)..(245): a, c, t, g, unknown or other
  misc_feature (245)..(245): n is a, c, g, or t
  modified_base (329)..(329): a, c, t, g, unknown or other
  misc_feature (329)..(329): n is a, c, g, or t
  modified_base (341)..(341): a, c, t, g, unknown or other
  misc_feature (341)..(341): n is a, c, g, or t
  modified_base (425)..(425): a, c, t, g, unknown or other
  misc_feature (425)..(425): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcgaggtattactgggtagtggtaataccgcatactacgcagactccgtgacgggccgttcaccgtcnccagagacaattccaagaatacggtctatctaggaaatgaaacacgcctgagacgccgaagaccacggcccctactatttaccnggtcgacgaganatcgaaggacggtaagtatagcagccagcctacgtgaacgtacggtcgggacccaacgggaacccgttggtaccacccggttcnccgttaccgaccgtccctacccgaaccgtaaccgggcccacgttacccggttccccttacccccgtcggcccctaccccgtccctacccgaacgaccgaccctacccgtcggtcggggacctaccggacggcccggtccccggtcgggtaccttaccggcccgttcggtaccggtaaccggtaccgttaccgttaccctaccgttaccgtaaccgttaacctaccggttcggacggtacccggggtaccgttacgggacggaaccgggtccgaaccgtacgtacgg

SEQ ID NO: 78677 - DNA, 815 bp, Homo sapiens
  misc_feature: GYAE6OF01CWRJ3.37.26.C04.1.454.CMB.1.raw
tcagtagtgtagatcacgaccggtgctcgatttagtctagcgactttggggtttgggggaggcttggtacagccgtggggggtccctgagactctcctgtgcagcctctggtttcatctttagcaactacgccatgagcgtcgggtccgccaggctccggaggggaacgggctgggaggtgggtctcgaggttattacgtggtagtggtaactaccgcatactacgcaaggacctccggtgaccgggtccgttcaccgtcaccgagacgaacaattaccaagaactacggtctatcgtaggaatgaactgacctggaacggacggaccggtaggaacccaccggtcccttacttaagtttactcggtaggaccgaaggacgtacgtacgaacgggaacgggtaatagtaggaccgaaggactacggtcctttacgaccgggttaaaccgtacggggttacgggggaacccccttaaaccgggggtaacccccgttgggtaccccctacccggttccctacccgtaccgaccgttacccccgtacccgtaacccggaaccgggtacccctaaccggtttccccggtcccccgtttaccccggtcccggtaacccctaaccccgtacccgtaaccgaaccgttaaccgccgtacccggtcgggtacgggggaccctaacgggccgggtcccggtccggtccgggtccgtaccgggtcggttacggtacggtaaccggtaccttaccctaccgtaactccgtaccgtaactcggtcggaccgggcgggtacgtacgggaacggacggccgagtgacgg

SEQ ID NO: 78678 - DNA, 751 bp, Homo sapiens
  misc_feature: GYAE6OF01DBX7D.37.26.C04.1.454.CMB.1.raw
  modified_base (282)..(282): a, c, t, g, unknown or other
  misc_feature (282)..(282): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggcctccgaaggggaagggctgggagtgggtcctgaggtattacgtggtagtaggtaactaccgcatactacgcagactccggtggacgggtccgttcaccgtctcgagacgactataccaagaactacggtnttatcgtaggaaatacgaacagccgtaggagacgaccggaggaccaccggtccctacgtacttacgtggtagacgaagtagtacgtacgaacggaacggagttaacgacgacgagacgtagtccttacgtacgtaccgtaccgggtaccggggacccgtaacccggtaccggttaccgtccgtacccgtcctccaccgaccgtacccgacccgaacgaccggtaccccgtacgttcccggtcccctttaccccggtaccgtcccgtaccccgtacccgtaccgaaacggtccgacccgtaccggtaccgggtccgggaaccgacggaccgggcccggttacccggccggtccgtccggtacggttaacccggtaacgtaccggtaaccttacccggttccaacgttacccgtacgaccgttacgccgggacggcggtacggtacggaaccggtacggctacgtagtacg

SEQ ID NO: 78679 - DNA, 619 bp, Homo sapiens
  misc_feature: GYAE6OF01CX64D.37.26.C04.1.454.CMB.1.raw
  modified_base (324)..(324): a, c, t, g, unknown or other
  misc_feature (324)..(324): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccgttcaccgtctccagagacaattccaaagaatacggtctatctaggaaactgaacagcctgagagccgaggacacggccctgtattactgtncgagagatcgagacggagtatacgcagcagctctgactacgtcggggcacggaccctggtccaccgtcctctacagtccctaccaccgaacgggccccagtccggttcccttcccccgtggacccctccctaccctaccgaaacgacgcctaccgttcggcggggtaccacgacggtcccgggacccgtcggggcctcgtccgttaggtaccgaaggtacccttactcccgtaattcccgtaaccgtaaccttacgtcggacggtcgggccgttggaacgaggcgacgtagtacg

SEQ ID NO: 78680 - DNA, 728 bp, Homo sapiens
  misc_feature: GYAE6OF01ANYEO.37.26.C04.1.454.CMB.1.raw
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (307)..(307): a, c, t, g, unknown or other
  misc_feature (307)..(307): n is a, c, g, or t
  modified_base (331)..(331): a, c, t, g, unknown or other
  misc_feature (331)..(331): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctgggagtgggtctcaggtattacgtggtagtggtaataccgcatactacgcagacctccgtgaccgggccgttcaccgtcncaganacaattccaagatacggtctatctaggaaatgaacagcctgagacgccgaggacnccggccctctattactgtgcgagngtatcgaggacggagtaagtagactagcgactctcgtacgagtaaccggtcgggggaccccaaccgggtaacccgttcggtaccctaacccggtcccttacccctacggaacccgtcccgttaccccgaacccgtaaccgggtacccccgtacgttccccgggttacccccgtttcccccgtaccgggtacccctacccccgttcccaacccgtaacggtacccgccgtaaccccgtcgggtaccgggggacccaacggccggcccgggtcccgtcggggtacctcggtccgtacggtaccgaacggtaccctaccgttaccgaacttccctaaacgtacctaccggttcgggaacggccgggtacccgtacggggacctaaggacctaagtacgag

SEQ ID NO: 78681 - DNA, 732 bp, Homo sapiens
  misc_feature: GYAE6OF01E1M6X.37.26.C04.1.454.CMB.1.raw
  modified_base (225)..(225): a, c, t, g, unknown or other
  misc_feature (225)..(225): n is a, c, g, or t
  modified_base (356)..(356): a, c, t, g, unknown or other
  misc_feature (356)..(356): n is a, c, g, or t
tcagtagtgtagatcacgaccggtgctcgatttagtctagcgactttgggttggggaggcttggtacagcctgggggtccctgagactctcctgtgcagcctctggttcatcttagcactcgcctatgagctcgggtccgcctaggcctaccggaggggaaggggcttgggacgtcggtcctcgtaggttacttacgtggtagtggttaacaccgactagttacncgcacgccgtcggtgaccgggtcctcgaccgtcaccagacgactagttaccgaagtacgtccggtactagtccgtagaacacgaacgacgtacgagacgacgacgtacgtaccgtaccgtaccttaacgtnaaccgttacgtattaccggaagacggtaacgtacgtaacggtaccggaagtacgtaacgtccgtacgtacgtaccgtacgtcggtaccgtaacgtacccggtacgggtaccgtacccgtaccgtccgtaccgaccgtaccgtacccgtaccacggacccgtaccgtacccgacgtacccgtccgtaccgtcccgttaccccgtccgtaccaacctcccgtaccgaacgtaggcccaaccgtccgtcggggtccacgtacgtccgggtccctgggtacctacggtcccttacggtccgaacggtacctaaccgtacctacgaccgttaccgaccgttacgtcggacgtcggaccgtacgtacgaaggcgtcgacgtg

SEQ ID NO: 78682 - DNA, 741 bp, Homo sapiens
  misc_feature: GYAE6OF01EA4U7.37.26.C04.1.454.CMB.1.raw
  modified_base (144)..(144): a, c, t, g, unknown or other
  misc_feature (144)..(144): n is a, c, g, or t
  modified_base (284)..(284): a, c, t, g, unknown or other
  misc_feature (284)..(284): n is a, c, g, or t
  modified_base (736)..(736): a, c, t, g, unknown or other
  misc_feature (736)..(736): n is a, c, g, or t
tcagtagtgtagatcacgaccggtgctcgatttagtctagcgactttgggtttgggggaggcttggtacagccgggggggtccctgagactctcctgtgcagcctctgtttcatctttagcaactacgccatgagctgggtccnccaggctccagggaagggctggagtgggtctcgaggtattacgtggtagtggtaataccgcatactacgcagtactccgtgacgggccggttcaccgtctcagagacaattccaagatacggtctatctaggaatgaacngcctagagagccgaggacaccggcctcttagtactgagcgagtacgactacgaacgacggtaatagtacggacgccaagtacgtccgtacgtacgtaacctacggttcggtacggacccgtaaccccggaaccggttacggtaccctacccgtccttacccacgtacccgtacccgtacccgaacccgggaaccggtccctaccggttccgtttccccccggttacccgtcccgacccgtaccccccgttaccctaacccgaacgaccgtcctacccggtcgggtaccgggaccgtaccggaccggtacccgggtccccgggtagggtccggtacccgttccgggttacggtaacccggaacgttacctttaccgttacccaagttaccccgttacgaaacccgtttcgcgggtaccggcggtaccggtacggaacccgacggcgtaaacgngtacg

SEQ ID NO: 78683 - DNA, 727 bp, Homo sapiens
  misc_feature: GYAE6OF01A6WPF.37.26.C04.1.454.CMB.1.raw
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaagggctggagtgggtctcaggtattactggtagtggtaataccgnatactacgcagactcgtgacgggccgttcaccgtcncagagacattccaagaatacggtctatctaggaaatgaacagcctagagagccgaaggtaccacggtcccttctaatttaccgtgtgacgtaagagactagaacggacgggagtaatacggctaaggcaggtcctcgtacgtactacggtcggggacccaaccgggtaacccgtggtacccaccccggttctacccgccgacgtaccctacccgaaccgaacgggcccctaggttcccgggttccccgttcccccgtacggacccctaccccgtcccgtaaccgtaacgaccgtaccgtacccgtcggtaccggggaccaccgaccggcccgggaccccggtcggggacctccggttaccgtacgggtacccgtaacggtacccgttaacccgttaccctaacgttaccctaacccgtaacgtacctacgggtacgggacccggggttacgtaccggggaccggaagggtaccggcgtaagtacgg

SEQ ID NO: 78684 - DNA, 726 bp, Homo sapiens
  misc_feature: GYAE6OF01AV6Z5.37.26.C04.1.454.CMB.1.raw
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
tcagtagtgtagatcacgaccggtgctcgatttagtctagcgactttgggtttgggggaggcgttggttacagccgtggggggtccctgagactctcctgtcgcagcctctggttcatctttagcaactacgccatgacgctgggtccgccaggctccagggaaggggctggagtgggtctcgaggtattacgtgggtagtggtaataccgcatacgtacgtcagactccgtggacgggccggttcaccgtctccagacgacaattccaagtaactcggtctatcgtaggaaatggaacagcctggagcgccgaggacaccggtccctgtattaccnggtcgcgaganatccgaaggacggagttanagcagccaggtcctacgtgaacttacggtcggggaccctaaccgggtaaacccttgggtaccccacccggtttccctaccgtacgaccgttccccttaccgaacccggtaaccgggtcccctaacgttcccgggttcccccgttaccccgtccggtacccctaccccgttacccgtacccgaaacggtaccgacccgtaccccgtccggtaccgggggtaccaaccggaccggcccgggtcccgtacggggtcctccgtaccgtccggtaccgaacggtacccttaccttaccgtaaccttaccgtacctacgttacgtcggacggtacgggcgtacggacgaacgggccgacgagtcg

SEQ ID NO: 78685 - DNA, 634 bp, Homo sapiens
  misc_feature: GYAE6OF01C8K8A.37.26.C04.1.454.CMB.1.raw
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (353)..(353): a, c, t, g, unknown or other
  misc_feature (353)..(353): n is a, c, g, or t
  modified_base (392)..(392): a, c, t, g, unknown or other
  misc_feature (392)..(392): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctaggaaatgaacagcctgagagccgaggacacggcctntattacngtgacgagagatcagacgagtatagcagcagctcngactgcgggccaacggacctggacctaccgtctccgtanaccgtccctaccaaccgaaccggaccctacgtcccggttacccgttccccgtcggtaccctacccctacccgtaccgaacgacgcctaacccgtcggtacgggggacctaccgacggcccgggtcccggtacggggtccgtccggtccgtacggtaccgtaacggtaccttacctaccgtactaccgtaaccgtactacggtcgacgggtacggccgtacggacgacgggtcacgtagtacg

SEQ ID NO: 78686 - DNA, 604 bp, Homo sapiens
  misc_feature: GYAE6OF01EJQDL.37.26.C04.1.454.CMB.1.raw
  modified_base (145)..(145): a, c, t, g, unknown or other
  misc_feature (145)..(145): n is a, c, g, or t
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccncaggctccgagggaagggctggagtgggtctcaggtattacgtggtagtggtaataccgnatactacgcagacctcgtggacgggtccgttcaccgtctccagagacaattccaagatacggtctatctaggaaatggaacagcctgagagccgaggacncggccctntatactgtgcganagancagacggagtangcagcagcctntgactacgngggaccaacgggaaccctggtaccaccgttctccgtcacgccctaccgaccgaaccgggccacgttccggttacccttccccgtcgcccaccccgtcctaccgaacgcgccacccgtcggtcgggcacgcgaccggcccggtcggcgtcgtccgtggtacaacggtccttaccttccacttaccgtaacctacgttacgtcggacgggccggtacgtacgggaccgaacgggcgtgagtacg

SEQ ID NO: 78687 - DNA, 920 bp, Homo sapiens
  misc_feature: GYAE6OF01CJQS8.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctgggagtggggtctcaggtattacgtggtagtggtaataccgcatactacgcagactccgtggaccgggtccgttcaccgtctccgagacgaactaattccaaagtaagttaccggtcttatctagggaaaattggaaaccacgcctggaaggacggacccggaaggaccgaccgggtccccttacttaatttaccgtggtgaccggaagaggatccgaaggtacgggatagtacgcgaagcagtcctctacgtaccgtacgtacggggacccctaaccgggaacccgtggggtaccctaacccggttcctaccccgtcgaccggtacccctaccccgaaacccggtaacccggggaccccctaacgggtttccccggttaccccccgtttaccccccggtcccgggtaccccctaaccccccgttacccccgttaaccccggtaaaaccgggccccgtaacccccttaaccccggggtttacccggggtaccgggggggtaaccccctaaccggggtaacccggggtacccccggggtcccccgggttccggggggttacccgttccgggtaacccccggtttacgggggtaacccgtaaaaacccggggttaccccgttttaaaccccgttaccccgttaacccgtttacccgttaaacccggtaacccgtttaaccggtcggggtaacccggggtccggggtacccggtacggggaacccgggtaacgggccggtaaccggtaagtacgg

SEQ ID NO: 78688 - DNA, 724 bp, Homo sapiens
  misc_feature: GYAE6OF01DX7ZU.37.26.C04.1.454.CMB.1.raw
  modified_base (149)..(149): a, c, t, g, unknown or other
  misc_feature (149)..(149): n is a, c, g, or t
  modified_base (282)..(282): a, c, t, g, unknown or other
  misc_feature (282)..(282): n is a, c, g, or t
  modified_base (382)..(382): a, c, t, g, unknown or other
  misc_feature (382)..(382): n is a, c, g, or t
  modified_base (720)..(720): a, c, t, g, unknown or other
  misc_feature (720)..(720): n is a, c, g, or t
tcagtagtgtagatcacgaccggtgctcgatttagtctagcgacttttggggtttgggggaggcttggtacagccgtgggggggtccctgagactctcctgtgcagcctcttggtttcatctttagcaactacgcatgagctgggtccnccaggctccgaggggaagggctggagtgggtctacaaggtattacgtggtagtggtaataccgcatactacgcagacctccggtgacgggtccgttcaccgtctccagagacaattccaaagaatcggtctanctaggaaatgaaacagcctaggaagacggccgaaggtaccaccggtccccttattacttacgtggtcgacggaagaaggatacgaggaacggagttaaancggacacggacaacgtcgttacacggaaacgttccgggtagggggacccctaaacgggaaccccgttgggtacctaccccggttcttaccctacgaaccgtccctaacccgaacccgtaaccgggacccctaacgttccccgggttacccctttcccccgtacgggtacccctaacccccggtttacccaacccgaaacgtccggaccctacccgttacgggtacgggacccacgaccgggtccgccggtcgggccttcgccgtacgacgaacgtacctacgttccatccgtaactcgtaacgtggaacgggccggcgtaggacccgtaaggccgtangacg

SEQ ID NO: 78689 - DNA, 646 bp, Homo sapiens
  misc_feature: GYAE6OF01AL04L.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcccctctattactgtgcgagagatcagacggagtatagcagcagctctgactacgtcggggccacgggaaccctggtccacccgtctccctcgacgccctccacccgaagggccccacgtccgggttcccttccccccgtcggccctacccctccctacccgaagaccgtccaccctcggtcgggggcctaccgacgcccgggtccccgtcggggtcctcggcccgttcgggtacccgaaacgggtacctacccgtttacccacttacccgtacctacccgttaccgttcggacggtcccggggtccgtacgggaccgaaacgggcctacgtagtaacgg

SEQ ID NO: 78690 - DNA, 641 bp, Homo sapiens
  misc_feature: GYAE6OF01EK1MG.37.26.C04.1.454.CMB.1.raw
  modified_base (286)..(286): a, c, t, g, unknown or other
  misc_feature (286)..(286): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattaatgggaatggtgataccacatactacgcagactccgtagaagggccggttcaccatcctccagggacaatccaagaacacactgtctctgcaaatgaacngcctgagagtcgaggacacggccttaattattactgtgtagaagggacctctagccccttatagcacgcggtctggtcctggtacgtttgacgtacgtggggccgtacgggaacccgtcggtacctacccggttccttccctcaacgccccttacccacccgaaccggggcccctaacgtccggtccgttccccccgtcggcccgtccctccgcctccgacggacgccacccgtccgacggacgaccgaccgcgcccggcccgtcgggcctccgtccgtgggtaccgaacggtaccttaccgttaccaacttacctacctaaccttacgtacggacggcgggccggttggaccgg

SEQ ID NO: 78691 - DNA, 627 bp, Homo sapiens
  misc_feature: GYAE6OF01DWJGP.37.26.C04.1.454.CMB.1.raw
  modified_base (316)..(316): a, c, t, g, unknown or other
  misc_feature (316)..(316): n is a, c, g, or t
  modified_base (622)..(622): a, c, t, g, unknown or other
  misc_feature (622)..(622): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgaggggaaggggctggagtgggtctcaggtattactggtagtggtaataccgcatactacgcagactccgtgacgggtccgttcaccgtctccagagacaattccaagaatacggtctatctaggaaatgaacagcctagagagccgaggacacggccctntattactgtgcgagagatcgagacggtagtatagcagcagctctcgaactacgtggggaccaaccggaaccctgggtaccaccgtcctcctcacgccctaccaaccgacggacccacgtcccggttcccttccccgtcggaccctaccccctccctacccgaacgaccgaccctacccgttcggtccgggggtaccacggaccgtacccgggccccggtcggggccgtcggccgtcggtacgaacggtacctaccttccctactacgtacctactacgtgacggtccggcgtcggacgaggcgcgngtacg

SEQ ID NO: 78692 - DNA, 797 bp, Homo sapiens
  misc_feature: GYAE6OF01BSYYS.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgaccgggtccggttcaccgtctccagagacaattccaagaatacggtctatctaggaaatagaacagcctgagacgccgaagggaccaccgggccctactacttacctgtcgcgaggaagactacgaaggaccggagttaagtacgacgaacgcgagacctcgtacggtaaccgttaccggtcgggggacccctaacccgggtaacccgtcgggttaccctaaccccggttctaccccgtacgaccgtccccgtacccgaacccggaaaccgggtccccgtaaccgttccccgggttacccccgtttaccccccggtacggtaccccctaaccccccgttccccgttaaccccgaaacgtaccgaccccgtacccgttccgggtccgggggaccaccggaccgggaccccgggttcccggtcggggttaccgtccggttacccggttacggtaccgggtaaacgttacccgttaacccggttcccttaacgtacccgttacctaacccgttaccgtcgggaaccggggtccggggtacctacgggtacggtaaccgggtcccgagtaacgtacgg

SEQ ID NO: 78693 - DNA, 790 bp, Homo sapiens
  misc_feature: GYAE6OF01B61BN.37.26.C04.1.454.CMB.1.raw
  modified_base (145)..(145): a, c, t, g, unknown or other
  misc_feature (145)..(145): n is a, c, g, or t
  modified_base (265)..(265): a, c, t, g, unknown or other
  misc_feature (265)..(265): n is a, c, g, or t
  modified_base (358)..(358): a, c, t, g, unknown or other
  misc_feature (358)..(358): n is a, c, g, or t
  modified_base (390)..(390): a, c, t, g, unknown or other
  misc_feature (390)..(390): n is a, c, g, or t
tcagtagtgtagatcacgaccggtgctcgatttagtctagcgactttgggtttgggggaggcttggtacagcctggggggtccctgagactctcctgtgcagcctctggtttcatcttagcaactacgccatgagcgtgggtccnccaggctccgaggggaagggctgggagtgggtctcgaggttattacgtggtaggtgtaactaccggctatactacgcagtaccgtcggtagaccgggtccgttcaccgttctaccagganactaattccgaaagtactacggtactatcgaggaaatcgaacgagcctaggaagacgccgaaggtaccgaccggtccctactagttacctggncgaagtacgatccgaaggaacggtatagtacncgagcgaacgtctacgaggtaaccgttcgggaccgggacccgaaccgggtaacccgtttggtaaccctacccggttccttaccccgacgaaccgtaccccgttccccgaacggtaacccggtccctaacggttcccggtaccccgtttcccgaccggtacccctacccctaccccgtaacggtaacgtcccgtaccgtacccggtcgggtaccgggtaacccgaaccgtacggggtcccccgggttacccggtggggtacccgtaccgggttaccgtaccgggtaaccgtaaaccgggttacccttaacgttacccgtacttaacccggtaactacccgtaggttaccggaccggggttcggtaccgggtacggaaccggtaaggccgaaggtccgtaag

SEQ ID NO: 78694 - DNA, 633 bp, Homo sapiens
  misc_feature: GYAE6OF01EGKRP.37.26.C04.1.454.CMB.1.raw
  modified_base (206)..(206): a, c, t, g, unknown or other
  misc_feature (206)..(206): n is a, c, g, or t
tcagtagtgtagatcacgaccggtgctcgatttagtctagcgactttgggtttgggggaggcttggtacagcctggggggtccctgagactctcctgtgcagcctctggcttcatctttagcaactacgccatgagctgggtccgccaggctccgaggggaagggctggagtgggtctcaggtattactggtagtggtaataccgnatactacgcagactccgtgacggccggttcaccgtctccagacgacaattccgaaaagaattacggtctatctaggaaatgaacacgcctgagagccggagacacggccctacgtattactgtgcgagagatacgagaacggagtatgacagcagctctgacgtcgtacgggcccaacggaaccctgtccaccgtcctcctcacgccctacccgaccgaacgggaccctacgtcccggttaccttccccgtcggccctacccctccctaccaagacgccaccgtcgtcggggctaccgacggcccggtacccgtgggccgtacgtccgtacggtacgaaacgggtaccttaccttaccgacgttacctaacgtaccttacgtacggtacggtcgggaccgtacgggacctaacgggccgtacgaacg

SEQ ID NO: 78695 - DNA, 949 bp, Homo sapiens
  misc_feature: GYAE6OF01B0T7Y.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagcgtcgggtccgccaggcctccgagggggaagggctggagtgggtctcgaggttattacgtggtagtggtaactccgcatactacgcagtacctccggtggaccggggtccgttcaccgtctaccgaggaagactaacttaccgaaagtaagttaccggtacttagtacggtaaggaaaactcggaaaccacggtccgtaggaacgacggaccggacggaccgtacccggtaccccttagttaactttacggtcggtacggaccggtaagaaggtacgtacggaaggtaacgggtaattaacgtaacgtacgacggtaccaacggttccttaccggtaacgtacccggttaacccgggtaccggggtaaccccgaaaccccggggttaacccgttcggggtaaccccctacccgggtttacctccccggtaccgtaacccggtcccccttaaccccggaaaccgggtaacccgggtaccccttaaccgggtttcccccggtttcccccgtttaccccccggtaccgggtacccccttaaccccccggtttacccgtaacccggtaaaccggtacccgtaccccgtaaccggtttccgggggtacccggggaccctaacgggtcccggtaccccgggtaccccggtggggttcccgttaccggttcccggttacgggtaaccgaaccgggtttacccttaccggtttacccctaacttaacccggttaaccgtaacccggttacggttacccggggaaccgggttcccgggtacgtaaccggggttacggaaccgggttccgaacggtagtacgg

SEQ ID NO: 78696 - DNA, 741 bp, Homo sapiens
  misc_feature: GYAE6OF01A70QE.37.26.C04.1.454.CMB.1.raw
  modified_base (331)..(331): a, c, t, g, unknown or other
  misc_feature (331)..(331): n is a, c, g, or t
tcagtagtgtagatcacgaccggtgctcgatttagtctagcgactttggggtttgggggaggcttggtacagcctgggggggtccctgagactctcctgtgcagcctctggtttcatctttagcaactacgccatgagctgggtccgccaggctccgaggggaaggggctggagtgggtctcaggtattacgtggtagtggtaaataccgcatactacgcagactccggtggaccgggccgttcaccgtctcagagacaattccaagaatacggtctatctaggaaatgaacagcctgagagccgaaggacaccggccctagtaattacgnggtgacgagagatacgaaggacggaagtatagacaggcaaggtcctacgtagaaccttacggacggggaccctaaaccgggtaacccgttgggtacccaacccggttcctacccgtacgacgtacccctaccgaaaccccggacgggtacccctaacggttcccgggttccccctttacccccggacggtacccctaaccccccgttaccccgtaccgaaacggtaccgtaacccgtaccccggttccggggaaccggggaccaaccggaaccgggccccgggtcccggtacgggtcccgtacgtcccgtaacgggtactaaaccgggtccttaaccgttcccaacttacccgaaccgtaccgtaacggtcggacgggcggtaccgtaggaccggaacggcacgagtacg

SEQ ID NO: 78697 - DNA, 173 bp, Homo sapiens
  misc_feature: GYAE6OF01C3L6J.37.26.C04.1.454.CMB.1.raw
tcagtagtgtagatcacgaccggtgctcgatttagtctagcgactttgggtttgggggaagaggaagactgacggtccccccaggagttcaggtgctgggcacagcggccctgggctgcctggtcaaggactacttccatctacactactgagcgggctggcaaggcgcatag

SEQ ID NO: 78698 - DNA, 875 bp, Homo sapiens
  misc_feature: GYAE6OF01E0JE8.37.26.C04.1.454.CMB.1.raw
  modified_base (144)..(144): a, c, t, g, unknown or other
  misc_feature (144)..(144): n is a, c, g, or t
  modified_base (202)..(202): a, c, t, g, unknown or other
  misc_feature (202)..(202): n is a, c, g, or t
tcagtagtgtagatcacgaccggtgctcgatttagtctagcgactttgggttgggggaggcttggtacagcctggggggtccctgagactctcctgtgtagcctctgaattcccctttacggcttattggatgagctgggtccncaggctccagggagggctggagtggtctcgaggtattacgtggtagtggtaataccgnatactacgcagactccgtgacgggccgttcaccgtctccagagactaattccaagaatccggtatatcgtaggaaatgaacagcctgagagccgaggacacggccttatattactggtcgcggagagatcgaaggacggagtatagcgagcagctcgtacgactacggtcggggacccaaccggtaaccgttgggtaccctaacccgggttcccttaccggtaccaaccggtccccccgtaaaccctaaccccgggaacgggggtaccccctaacggtttaccccgggtttacccccgtttacccccccgggttaccggtaacccccgttaccccccgttaccccgttaacccggaaaccggtaacccgtaccccggttaacccccggttacggggttacccggggggtaaccctaaccgggtaccccgggtaccccgggttaacccccgggttcggggtaacccccgttccgggtacccccgggttaaccgggtttaaacccgggtaaaaccggttaaccccgtttaaccccgtttaaccgttaaaccccggttaacccgttaaaccccggttaacccgttaaccgggttaccgggtaacggggttacccggggtaccggttaccgggtaaccggtaaacccgggtccgtaacgtaacggttacagtcgtac

SEQ ID NO: 78699 - DNA, 686 bp, Homo sapiens
  misc_feature: GYAE6OF01AYI8H.37.26.C04.1.454.CMB.1.raw
  modified_base (331)..(331): a, c, t, g, unknown or other
  misc_feature (331)..(331): n is a, c, g, or t
tcagtagtgtagatcacgaccggtgctcgatttagtctagcgactttgggtttgggggaggcttggtacagcctgggggggtccctgagactctcctgtgcagcctctggattcaactttggtagctattggatggactgggtccgccagtctccagggaaggggctggagtgggtggccaacatacaggggaggtggtggtaacgaaaaactatgtggactctgtgcggggccattcaccatctccagacgacaacgaccaaaaactcactgtactctgacaaagtcggacgcctagagatccggagacgacggctggtgtattattggngacgagtagtatttagactaataaagtttcgagtagagtggtatgatgtcttatgatacggtcggggaccgaaggtacctagtcggtaccaccgttcttccttacgaccgtcccgtacccgaaccggtaaccgggccctacgttcccggttccccttccccggtcgggccccgtcccgttcgcccgtaccgacgggaccgacctacccgtaccggagtaccgaccgaccgtccgggccggtacccggcgggtcgtccggacccggttacggtacccgtaaacgggtacccttaacccgttccgtaaccgttacccgtaactacccgttaacggtcgggtacggtcccgggtacgg

SEQ ID NO: 78700 - DNA, 726 bp, Homo sapiens
  misc_feature: GYAE6OF01DKFC5.37.26.C04.1.454.CMB.1.raw
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
  modified_base (271)..(271): a, c, t, g, unknown or other
  misc_feature (271)..(271): n is a, c, g, or t
  modified_base (465)..(465): a, c, t, g, unknown or other
  misc_feature (465)..(465): n is a, c, g, or t
tcagtagtgtagatcacgaccggtgctcgatttagtctagcgactttgggtttgggggaggcttggtacagcctggggggtccctgagactctcctgtgcagcctctggtttcatcttagcaactacgcatgagctgggtccgccaggctccgaggggaaggggctggagtgggtctcaggtattacgtggtagtggtaactaccgnaatactacgcaggactccggtgacgggtccgttcacctntctaccagagacaattccaagaacncctgtctctgacaaatcgaacaacctgagagccgagacacggcctattacttacgtagtaacgaaaagtcggaccgtacggattaactgtaactaacgttagttcgggtacgttacggttactttcgaacgttcttccgggtgggggtccgttacgggacctaacccgttggttccacgtttcgttccttcccnctaaccgtccccgtacccgaacccggtaaccgggtacccctaacgtttcccgggtttaccccttcccccggtcgggtaccccggtccccttacggcccgtacggaacgggacgacccctacccgttacggaacgtacggacccacgggacggcccgggtccctggggtactccgtacccggttggaacgtaaccggtcccttacgtaccttacgtaccctaactacttaaccgtggacccggtgggactcgggactacggg

SEQ ID NO: 78701 - DNA, 571 bp, Homo sapiens
  misc_feature: GYAE6OF01CIK24.37.26.C04.1.454.CMB.1.raw
  modified_base (270)..(270): a, c, t, g, unknown or other
  misc_feature (270)..(270): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
  modified_base (469)..(469): a, c, t, g, unknown or other
  misc_feature (469)..(469): n is a, c, g, or t
  modified_base (561)..(561): a, c, t, g, unknown or other
  misc_feature (561)..(561): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaagggctggagtgggtctcaggtattactggtagtggtaataccgcatactacgcagactccgtgacgggccggttcaccgtctccagagacaattccaaagaatacggtntatctgacaaatgaacagcctgagagccgaagacaccggccctatattactagtaacgaaaatggacctacggatatgaactactagttgggactggtacttcgatcgtcgtgggccgtcgcacccgtggtcactcgtctcctcacgcctccaccgaacgggccctagtccgtcctcccnggccncctcgcctcgagcncaccgtcgagacgacacgcgccgccgtagcgtcgcctggtaccaaggtaccttactcctaatcctaacctactacgtacgacggaccgggtncggcgaacgg

SEQ ID NO: 78702 - DNA, 721 bp, Homo sapiens
  misc_feature: GYAE6OF01C9LTL.37.26.C04.1.454.CMB.1.raw
  modified_base (207)..(207): a, c, t, g, unknown or other
  misc_feature (207)..(207): n is a, c, g, or t
  modified_base (272)..(272): a, c, t, g, unknown or other
  misc_feature (272)..(272): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattacgtggtagtggtaataccgnatactacgcagactccggtgaccgggccgttcaccgtctccagagaacattccaagaatacggtntatctaggaaatgaaacagcctagagacgccgaggacacggccctctattacngtgcgagantcgagacgagtanagcagcagctcacgtactacggtcggggacccaaccgggtaacctcgggtcctacccgtctccctcgacgtccctacccgaaccgaaccgggcccctacggttacccggtccccctttccccccgtacggtacccctacccccttccccgtaacccgaacggtaccgacccgtacccggttccggggtcggggaccctaaccggcgggcccggtccccggttcggggccgttaccgggcccgttacgggtaccgaaaccggttacccttaaccgttcccctaaacgttcccgtaaaccgtacccgttaaccggtcgggaaccgggtccggggacccgtcgggtaaacggaccggggtaccgtcgtaacggtacg

SEQ ID NO: 78703 - DNA, 871 bp, Homo sapiens
  misc_feature: GYAE6OF01BWIVY.37.26.C04.1.454.CMB.1.raw
  modified_base (249)..(249): a, c, t, g, unknown or other
  misc_feature (249)..(249): n is a, c, g, or t
tcagtagtgtagatcacgaccggtgctcgatttagtctagcgactttgggtttgggggaggcttggtacagccgtggggggtccctgagactctcctgtgcagcctctggtttcatctttagcaactacgccatgagcgtgggtccgccaggctccgaggggaaggggctgggaggtgggtctcgaggtattacgtggtagtggtaaactaccgcatactacgcagactcgtgacgggcgtcaccgtcncagagacaattccaagaactacggtctatcgtaggaaaatcgaaactacgccgtaggaagaacggcccggaaggacccgtacccgggtacccctttacgttaacgtttacgtgggtacggacggaaggaagtactacggaaacgggaacggtaagttaacgtacggacgaacggaccgtacggtccttacggttaacggtaaacccgttaaccggggaccggggggtaacccccctaaaaccggggtaaccccgttcgggtaaccccgtaccccggtttaccctacccggtaccgtaaccccggtccccttaacccccggaaacccgggtaacccgggtacccccttacggtttcccccggttcccccttttacccccggcggtaacccccttaccccgttacccggtaaaccgaaaccggtacccgtacccctaaccggttcgggtaaccgggaccctaacggcccgggtcccggtacccggcggggttccctccgggtaccgggtacgtaaccgaaaccgtttacccgtttaccctaccgtaacgttaccctaacgtaacccggtttggaaccgggcgggtcccgggtaactcgggaaacccggacggacgtagagtacg

SEQ ID NO: 78704 - DNA, 581 bp, Homo sapiens
  misc_feature: GYAE6OF01A7P2G.37.26.C04.1.454.CMB.1.raw
  modified_base (294)..(294): a, c, t, g, unknown or other
  misc_feature (294)..(294): n is a, c, g, or t
  modified_base (322)..(322): a, c, t, g, unknown or other
  misc_feature (322)..(322): n is a, c, g, or t
  modified_base (404)..(404): a, c, t, g, unknown or other
  misc_feature (404)..(404): n is a, c, g, or t
  modified_base (563)..(563): a, c, t, g, unknown or other
  misc_feature (563)..(563): n is a, c, g, or t
  modified_base (574)..(574): a, c, t, g, unknown or other
  misc_feature (574)..(574): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccaggggaaggggctggagtgggtctcaggtattactggtagtggtaataccgcatactacgcagactccggtgacgggtccgttcaccgtctccagagacaattccaagaatcggtctatctggaaatgaacagcctganagccgaggaccacggccctctattaccngtgcgagagactcagacgagtatagcagcagctctgactacgtcgggccaacggacccgtgtccaccgttctcctcacgccncctaccgaacgggcccacgtccggtcccttcccccgtcggccaccccctcctaccgaacgacgccaccctggttcgggaccacgcgccggacccgtggggctcggtcctcgggtacgaacggtacctaccttcacgtcctacaccttgcgagtcgggcncggacgaggcngaagtcg

SEQ ID NO: 78705 - DNA, 899 bp, Homo sapiens
  misc_feature: GYAE6OF01B09BD.37.26.C04.1.454.CMB.1.raw
  modified_base (365)..(365): a, c, t, g, unknown or other
  misc_feature (365)..(365): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtcccgccaggctccgaggggaaggggctggagtgggtctcgaggtattacgtggtagtggtaactaccgcatactacgcagacctccggtgacgggccgttcaccgtctccgagagactaattccaaagaatacggtctaatcgtaggaaatacgaacgagcctaggaaggacggacccggaaaggaccgacccggtcccccttagttaacgtttaccgtggngtaccggaagagtacgtaccgaaggaacgggtaagtaagtacggacgtacggctaacggtccgttaccgtagtaccgttaaccggtaccggggggaaccccctaaaacccgggggttaaacccccgttcgggtaacccgtacccccgggtttccccgtaccccgtacgtaccccggtccccctaaaccccggaaccccgggaaaacccgggggtcccccctaaccggtttcccccgggtttacccccctttacccccccggtaccggtaaccccccgtaccccccgtttaaccccgtaacccgtaaaccggaccgtaccccgtaacccgtcggggttaccgggggaccctaaccgggcccggtacccggggtccccggtcggggtcccgtaccgggttacccggtaccgggtaaccgtaaaccgggtaccctttaaccggtaccctacgttacccgtaacctacgttaaaccggtcgggaacccggtccggggtaccgtacgggaacccgggtaacggcccggagtaacggtag

SEQ ID NO: 78706 - DNA, 379 bp, Homo sapiens
  misc_feature: GYAE6OF01D25NS.37.26.C04.1.454.CMB.1.raw
  modified_base (335)..(335): a, c, t, g, unknown or other
  misc_feature (335)..(335): n is a, c, g, or t
  modified_base (363)..(379): a, c, t, g, unknown or other
  misc_feature (363)..(379): n is a, c, g, or t
tcagtagtgtagatcacgaccggtgctcgatttagtctagcgactttggggtttgggggaggcttggtacagccgtggggggtccctgagactctcctgtgcagcctctggtttcattctttagcaactacgccatgagcgtgggtccgccaggcctcgaggggaagggctggagtgggtctcgaaggttattacgtggtaggtggtaaaactaccgctaagttaacctacggcaaggtaccgtccggtaggaccggggtccggttacaaccggtctaccgaagacgaaactaattccaaaagaactacggtctaagtctaggaaatagaaacancgtgagagccgaggaccacggcccttannnnnnnnnnnnnnnnn

SEQ ID NO: 78707 - DNA, 1016 bp, Homo sapiens
  misc_feature: GYAE6OF01C5IWN.37.26.C04.1.454.CMB.1.raw
  modified_base (210)..(210): a, c, t, g, unknown or other
  misc_feature (210)..(210): n is a, c, g, or t
tcagtagtgtagatcacgaccggtgctcgatttagtctagcgactttgggtttgggggagcttggtacagcctggggggtccctgagactctcctgtgcagcctctggttcatctttagcaactacgccatgagcgtgggtcccgccgaggctccgaggggagggctggagtgggtctcgaggtattacgtggtagtggtaaactaccgnaattacgtacgcagaccgttccggaggaccggggtccgttaccacccggttcctaccgagtaacgaacctaacgttacccaaaggtaacttaccggttccttaagtccgtagggaaaattacggaaaccagcccttaggaagggacgacccggaaggaaccgtaacccgggccccctttattaacgtttaccgtggttaccggacggaaaggtaagtactacgaacgggaacggggtaatacgtacgcgagccgagtccttacggtacgaaccgtacggttccggggaccccgaaaccgggtaaccccgttcgggtacccaaccccgtttcctacccgtccctacggtcccccgttaccccgaaaccccggtaacccggggacccccgttaaccgttccccgggtttcccccccgtttccccccggttaacccgggtcccccgtaacccccccctttacccgttaaccccgtaaaccgggtacccggtaccccgttaccccggtttaacccggggtccgggggtaacccctaacccgggtaacccggtcccccgggggtacccccggtttccggggggtacccgtttacccggggttaccccgggtttaacgggttaccccgggtaaaaccgggtttaaccccgttttaaccccgtttacccccggttaaacctttacccccccgtttaaaacgtaacccccggttttaacccgggtcccgggggttaaccgggcccccgggggttaacgggtaacccggggtaccggtaaacccggggccccgttaaaccgggttaccgtaacgg

SEQ ID NO: 78708 - DNA, 842 bp, Homo sapiens
  misc_feature: GYAE6OF01C8AWM.37.26.C04.1.454.CMB.1.raw
  modified_base (230)..(230): a, c, t, g, unknown or other
  misc_feature (230)..(230): n is a, c, g, or t
tcagtagtgtagatcacgaccggtgctcgatttagtctagcgactttgggtttgggggtaggccttggtacagccgtggggggtccctgacgacctctcctggtcgcacgtccgtctggtttacatctttaggcaaccgtaccgccatggagcgtcgggtccgccacggctcccgagggaaggggctgggagtgggtctcgagggtatacctggtagtggtaataccggntatacgtacggcaggacctccggtggaccgggtccggtacgaaccggtctaccgaagtacgactaagttaccaaagtacttacggtactagtcgtaggaattacgaacgtagccgttagacgtacgaccgaaggacaaccggtcccctagttaacttacgttcggtcgtacggaacggaactaccgttacgaacgggaaaccggttagtaacgttaacggacccgtaagtcggaacttcgttaccgtacggtaacgaccggggtccgggtacccaaccgggtacccgtcggtaccggttaacccgttccgtacctacggacgtccccgtaccggaacccggacccggtccgtaacgttacccgggttccctttaccccggtaggtaccctacccccgtttcgtaacccgaacgtacccgtcgtaccgtcggggacgggacctacccggaacgggtcccgggtacccggtaggtaccgtcggtaccggttcggtacccgaacgttacccttaccgtcccgttaagtccccgtaaacgttacccggttactaccgggggtcccgtacccggacggttacccggaaccgttacgggaccctacgtaacggtaccg

SEQ ID NO: 78709 - DNA, 700 bp, Homo sapiens
  misc_feature: GYAE6OF01BQYW3.37.26.C04.1.454.CMB.1.raw
  modified_base (256)..(256): a, c, t, g, unknown or other
  misc_feature (256)..(256): n is a, c, g, or t
  modified_base (304)..(304): a, c, t, g, unknown or other
  misc_feature (304)..(304): n is a, c, g, or t
  modified_base (347)..(347): a, c, t, g, unknown or other
  misc_feature (347)..(347): n is a, c, g, or t
  modified_base (699)..(699): a, c, t, g, unknown or other
  misc_feature (699)..(699): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggcctccgaggggaagggctggaggtgggtctcgaggtattacgtggtagtggtaataccgcaatactacgcagacctccggtggaccgggtccgttcacccgttcnccagagactaattccaaagtaatacggtctatcgtaggaaatcgaacngcctaggagacggccgtaggaccaccggtcctacgtatttacnggtagacgagagatacgaaggacggtagtaagtacgacgaacgcgtacgtctagtacgaccgttacggccggggacccctaaccgggtaccttacgggtccctaccggttcctccctacgaccgtcccctaccgaaccgacggtcccctacgttcccgtccccgttccccgtacggcccctaaccccgtcctacccgtaacgaccgtccccgtaccggttccggggcgggacctaacggccggtaccggtcccggtcggtcgtccggccgttacggacggtaaccgtaccgtaccttcgaacgtcctaaccgacgtgtaccggcggtccggcgtacgggacaggccgatcgng

SEQ ID NO: 78710 - DNA, 745 bp, Homo sapiens
  misc_feature: GYAE6OF01CRXYW.37.26.C04.1.454.CMB.1.raw
  modified_base (300)..(300): a, c, t, g, unknown or other
  misc_feature (300)..(300): n is a, c, g, or t
tcagtagtgtagatcacgaccggtgctcgatttagtctagcgactttgggtttgggggaggcttggtacagccgtggggggtccctgagactctcctgtgcagcctctggtttcattctttagcaactacgccatgagcgtggggtccgccaggcctccgaagggggaaggggctggaggttgggtctctaggttattacgtgggtagtggtaataccgcataactacgacagcctccggtgaccggggtccgttcacccgttcaccgagagaactaacttccgaaaagtacgtacggtntatacgaaggaaatcgaaacagcctaggaacgacgccggaaggaccaccggccttactatttacgtgtagcgaagagatacgaaggaacggtaataacgtacgacgaagcgaacgtcttacgtcgtaaaccgtacggtccggggacccaacgggtaacccctggtaccctaccgtcctactcgactcccctaccgaaccggaccggaccctacggttcccgttccccgttcccccgtacggtacccctacccgttacctaaccgaacggtaccgaccgttacccggtcggtaccggggaccaccggtacggccccggtcccggtacggtccgccgtccgttacgggaccgaaccggttacttacccgttccaacgttaccctaacgtaccgtacggttcgggacggtccgggtacggtacgggacggacggtacgaagtagtacg

SEQ ID NO: 78711 - DNA, 943 bp, Homo sapiens
  misc_feature: GYAE6OF01DTVSU.37.26.C04.1.454.CMB.1.raw
  modified_base (210)..(210): a, c, t, g, unknown or other
  misc_feature (210)..(210): n is a, c, g, or t
  modified_base (278)..(278): a, c, t, g, unknown or other
  misc_feature (278)..(278): n is a, c, g, or t
tcagtagtgtagatcacgaccggtgctcgatttagtctagcgacttttgggtttgggggaggcttggtacagcctggggggtccctgagactctcctgtgcagcctctggtttcatctttagcaactacgccatgagctgggtccgccaggctccgaaggggaagggctggagtgggtctcgaggtattacgtggtagtggtaaatccgntataactacgcacgactccgtggacgggccgttcaccgtcacagagacaattcctaagaactacggtntaatgtagaaatgaacagcctagaagacggaccgaagaccaccggtcctacttattaccgtggtgacgtaagagtataccgtaaggacggtaataagtaacggccaagtacgacgtcttacgtacgtaaacccgttaccggtacgggggtaacccaaaccccgggttaaaccccgtttccggggtaccccttaaacccccggttcctttaacccccccgggtaaagttaccccggttaaccccccgtaacccccgtaaaacccccgggtaaaaaccggggttcccccccgttaaacgggttttcccccccgggtttaccccccgttttaaccccccccggttaacgggtacccccccgttaaacccccccgtttccccccgttaaaaccccggaaacgggtaacccggtaacccgtaaacccccggtttcggggtaacccgggggtaaccgaaaccgggtaaccgggacccccgggtaccccgggtcgggtaacccgttcgggttaacccccggtagggttaacccgtaaaccgggtaacccttaaccgttttacccgaaactttaacccggttaaaccctaaccgtttaaacccgggtggaaccgggtaccggggtacccgtaacggggaaacgtaaacccgggaccttaaacgaacgggtaac

SEQ ID NO: 78712 - DNA, 188 bp, Homo sapiens
  misc_feature: GYAE6OF01CF1W8.37.26.C04.1.454.CMB.1.raw
  modified_base (174)..(188): a, c, t, g, unknown or other
  misc_feature (174)..(188): n is a, c, g, or t
tcagtagtgtagatcacgaccggtgctcgatttagtctagcgactttgggtttgggggaagaggaagactgaccggtcccccagagttcaggtgctgggcacagccggccctgggctgcctggtcaaggactactccatcctacactactgagcgggctggcaaggcgcatagnnnnnnnnnnnnnnn

SEQ ID NO: 78713 - DNA, 616 bp, Homo sapiens
  misc_feature: GYAE6OF01CXS7R.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggattcaactttggtagctattggatggactgggtccgccagtctccgagggaaggggctggagtgggtggccaacatacgaggggaggtggtggtaacgaaaaactatgtggactctgtgcggggccgattcacatctcagagacaacgaccaaaactcactgtatctgacaaagtggacgctgagatccgagacaggctgtgtattatgtgcgagatattagactaataaagttcgagtgacgtggtatgatgtacttagtagagtaccggtgggacctaaaggggacctagtcggtacctaccgtcttactcgacgccctaccgaccgaaccggcccacgtccggtcccttccccgtcggcccgtccctcgcctccgacggacgccgaacccgtccggaagcgaccacgtaccggcccggcccgtgggcctcggaccgttcgggtaacgaaccgggttacctccttacccgattacccctaactacctacgcggacggcgggtacg

SEQ ID NO: 78714 - DNA, 629 bp, Homo sapiens
  misc_feature: GYAE6OF01AQRBQ.37.26.C04.1.454.CMB.1.raw
  modified_base (321)..(321): a, c, t, g, unknown or other
  misc_feature (321)..(321): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccgttcaccgtctccagagacaattccaagaatacggtctatctaggaaatgaacagcctgagagccgaggaccaccggccctctattacngtgcgagagatcgaaggacggagtaatagcagcagctctgactacgcgggacccacggacctggtccaccgtctcctcacgccctaccgaccgaccggccctacgtcccggttcccttccccgtcggacccctacccctcccgtaccgaacgcgacccgtacccgtcggtcggggaccaccgcggcccggcccggtcgggtccgtcggtccgttacggtaccgtaacggtaccttaccttacctacgtaccgtaaccgtaccgtacgtcggaccgggtcggtcgtacggacgaacgggcagtagtacg

SEQ ID NO: 78715 - DNA, 750 bp, Homo sapiens
  misc_feature: GYAE6OF01D8RUH.37.26.C04.1.454.CMB.1.raw
  modified_base (211)..(211): a, c, t, g, unknown or other
  misc_feature (211)..(211): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgagggaagggcctgggagtgggtctcgaggtattacgtgggtagtggtaataccgnatactacgcagaactccggtgaccgggtccgttcaccgtctaccgagagactaattaccgaagactacggtctatcgtaggaaatgaacacgcctagagacgccggaaggaccgaccggtccctcttaattacgtggtcggcgtaagagtatcgaacggacgtaagtatacgcaaggcacgacttcgtagaacgttcggaccggggacccaaccgggtaacccttggtacccgacccggttctcccgtaccaccggtacccgtacccgaacccggtaaccggccctaccggttcccgttacccgttcccccggccgtacccgtacccccttcccgtaaccgaaccgacgtaccctaccggtacccggtacggggacccaacggaccgtcccgggtccccggccgggttacggtaccggtcccggttacgacccggtaaaccgttaacccgtacccgtttaccaaccgttaaccctacccgtaacgttaccctggggtaaccgcgggtccgtacggaccgggtaacgcgtacgtaagacg

SEQ ID NO: 78716 - DNA, 896 bp, Homo sapiens
  misc_feature: GYAE6OF01ER6YC.37.26.C04.1.454.CMB.1.raw
  modified_base (494)..(494): a, c, t, g, unknown or other
  misc_feature (494)..(494): n is a, c, g, or t
tcagtagtgtagatcacgaccggtgctcgatttagtctagcgactttgggtttgggggaggcttggtacagccgtggggggtccctgagactctcctgtgcagcctctggtttcatctttagcaactacgccatgagcgtggtccgccaggcctccgaggggaacgggctggaggtggtctcgtaggtactttacgtgggtagtaggttaactaccgactaattaccgtacggaccaacggtaccgttcccggtagggaccggggtcccggtttaccacccggttacctaccgaaggaacgtaaccttaaacttaccgaaaaggtaacgttaccggtactagttacgtaggtaaaagtcgaaaccgacggtaccgtaggaacggaccggaccggaacgaaccccgtccgggtacccccctttagttaaacgttccgtggcggtaccgaagaaggtactcggaagtacgggattaagtacgacgaatcgacggtnttaccgtagaccggttacggccggggaaccctaaacccgggtaacccgttgggaccccttaccggttccctaccgttaccgacccgtaccctacccgaacccggtaacccgggtacctaccggttccccgtttaccccgttcccccggtaccgtacccccgtacccttacccggtaaccgaacccggtaccgtacccgtaacccgggtttccgggaccgggtaccgacccgggtcccggaccccgggtacccggttccggtccgttcccggttaccgttacgggaacccgttaaccgggttaaccttacccggtttacctaaaccgttcccgtaaaccgttaacgtacccggtacggaccgggtaccggacgtaccgggacgaaccggaccgtcgtaaggtc

SEQ ID NO: 78717 - DNA, 635 bp, Homo sapiens
  misc_feature: GYAE6OF01EIKB8.37.26.C04.1.454.CMB.1.raw
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
tcagtagtgtagatcacgaccggtgctcgatttagtctagcgactttgggtttgggggaggcttggtacagcctgggggtccctgagactctcctgtgcagcctctggtttcatctttagcaactacgccatgagctgggtccgccaggctccgagggaagggctggagtggtctcaggttattactggtagtaggtaatccgcatacgtacgcagactccgtggacggccgttcaccgtctccagagacaacttccaaagatacggtctatctaggaaatgaacngcctganagcgagacncggccctntattacgngtgcgaganatcagacgagtatagcagcagtctcagactcgcgggaccacggtaacccgtggtacccgtacgtcctcctacgacgtccctaccgaaccgtaaccgggccctagttcccggtccctttccccgcgtaccctaccccgtcccgtaccgaacgtaccgtacctacccgtcggttcggggaacctacgaccggccggtaccgtggggtcctcggtcctcggtaacaacgggtacttaccgttaccaacgtttaccaacgttacctacgtcgggacgtcgggacgtcggaacgtaacgggcgtccgagtacg

SEQ ID NO: 78718 - DNA, 809 bp, Homo sapiens
  misc_feature: GYAE6OF01ALTTV.37.26.C04.1.454.CMB.1.raw
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccgaggggaaggggctggaggtgggtctcgaggttattacgtggtagtggtaactaccgctatactacgcagtacctccggtggaccgggtccgttcaccgtctccagacgactaacttccaaagtacgtacggtntagtcgtaggaaatgaacncgcctaggagacgccggaggaccgaccggtccctatactttacgtgtcggacgagagactacgaacggaggtataagtacgacgagccacgtcctactcggaaccgtcgggtaccggggaacccctaacccgggtaacccgttcggtaccctaacccggtttcctacccgttaccgaccgtccctacccgaacccggaacccgggtccctaccggttccccggttccccttcccccggtcgtaccccgtacccctaccccgtaacccgtaacgaccgtacccgtcccggttacgggacgggtaccccgacggacccggggtcccggtcccgggtacgggtcccgtaccgggtaccggttacggtacccggtaaccggttaaccgttacccggttaccctaaccgttaacccgttaacccgtaacgttaccgggtaaccgggtcccggggtacccgggttacggtacccggggaaccgtaccggggacgtaacgtggtaacg

SEQ ID NO: 78719 - DNA, 557 bp, Homo sapiens
  misc_feature: GYAE6OF01BPJAB.37.26.C04.1.454.CMB.1.raw
  modified_base (267)..(267): a, c, t, g, unknown or other
  misc_feature (267)..(267): n is a, c, g, or t
  modified_base (385)..(385): a, c, t, g, unknown or other
  misc_feature (385)..(385): n is a, c, g, or t
  modified_base (424)..(424): a, c, t, g, unknown or other
  misc_feature (424)..(424): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (517)..(517): a, c, t, g, unknown or other
  misc_feature (517)..(517): n is a, c, g, or t
  modified_base (547)..(547): a, c, t, g, unknown or other
  misc_feature (547)..(547): n is a, c, g, or t
  modified_base (552)..(557): a, c, t, g, unknown or other
  misc_feature (552)..(557): n is a, c, g, or t
tcagtagtgtagatcacgaccggtgctcgatttagtctagcgactttgggtttgggggaggcttggtacagcctggggggtccctgagactctcctgtgtagcctctgaattccccctttacggcttattggatgagctgggtccgccaggctccagggaaggggctgggagtgggtgccaacataaagcaagatggaagtaagaaggagtatgtggactctgtgaagggcctttcaccatctccagagacaacgccaagactccgngcatctgacaaatgaacagtctgagacgccgaggacacggtctatttatactgcgcgagaggaaggacgtgggtcggtttcgactcgtggggccacgggacctggtccaccgtctccncacgtccctccaccgacggcccagtcccgtcctccccgnggccgccctcgcctccgaggacncctccnccgagcgcacgcggccgcccgtgggcctcggccgtggaccgaggtaccttacttccatactacnctacgtggaccggcgggctggacgacggcnagtcnnnnnn

SEQ ID NO: 78720 - DNA, 764 bp, Homo sapiens
  misc_feature: GYAE6OF01C9R9B.37.26.C04.1.454.CMB.1.raw
  modified_base (273)..(273): a, c, t, g, unknown or other
  misc_feature (273)..(273): n is a, c, g, or t
  modified_base (759)..(759): a, c, t, g, unknown or other
  misc_feature (759)..(759): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaagggctggagtgggtctcaggtattacgtggtagtggtaataccgctatactacgcagacctccggtgaccgggccgttcaccgtctccagagacaattccaagaatacggtntatcgtaggaatagaacagtcctagaggaacgccggaaggtaaccaccgggccccttcttaaacgtttacctggtacggacggaagaaggtactacgaacggtaacgggtaagttaagtacggaccgaacggccaagtccttacgtacggtaaacccgttacgggtcgggggacccctaaaccggggtaaccccgttcgggtacccgtaaccccgggtttccttacccgtaccaccggtaccccttaccccgaacccggtaaaccgggtacccctaacggttcccgggttacccctttcccccggtacggacccctaccccgtacccgttaaccgaaacgtaccgacccgtaacccgtcgggtcggggacccgaacgaccggtccggacccggtcgggctcggtcctacggtacgaacgggtactaccgtcctactccgtaactacgttacgcggaccggcgggtacgtcggacgaaggcgaccgngtacg

SEQ ID NO: 78721 - DNA, 611 bp, Homo sapiens
  misc_feature: GYAE6OF01A020X.37.26.C04.1.454.CMB.1.raw
  modified_base (522)..(522): a, c, t, g, unknown or other
  misc_feature (522)..(522): n is a, c, g, or t
  modified_base (567)..(567): a, c, t, g, unknown or other
  misc_feature (567)..(567): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccgttcaccgtctccagagacaattccaaagaatacggtctatctaggaaatgaacagcctgagagccgaggacacggccctctattactgtgcgagtagatcgagacgatatagcaggcagctacgtgacctacgcggggaccctaacggaacccgtcggtacaccccggttctccctcaacgtccctaccgaacgaaccgggaccctacgtccggttccttacccccgcgtcccacccctacctaccgtaacgcgccaccgtcggtcgggaccacgaacggccgtcccgngggtctcggtccgtcggtacaacgcttactccgaactcccgtaanaccgtagtcgacggtccgggactggaccgaaggcgccgagtacg

SEQ ID NO: 78722 - DNA, 921 bp, Homo sapiens
  misc_feature: GYAE6OF01CJ7J9.37.26.C04.1.454.CMB.1.raw
tcagtagtgtagatcacgaccggtgctcgatttagtctagcgactttgggtttgggggaggcttggtacagccgtggggggtccctgagactctcctgtgcagcctctggtttcattcttagcaactacgcatgagtcgtcgggtccgaccgaggcctaccggaaggggggaacggggtcgtgggtacggttcggggtccttaccgtaagggtttatttaaccggttggggttaagttagggtaaacctacccggactaacttaaccgaccgacgtaacgtacccgttaccgggtacggacccggggtccgtttaccaccggttcaaccgaagacgaactaacttaccgaaagtaacgtccggttactagttacgaaggtaaatacggaaacgtcgaccgtaggacggacgtaccggaacggtaccgaccggtcccttagttaacgttaccgttaggacgacggaagacgtacgtaggaacgggaacggtaagttagaaccggtacgaaccgacgtacgtacccgttagtaaccgtaacccggtacgggtacccggggaaccccgtaaaccccggtccggtaccggttacccgtaccccgtccctacccggtaccacccggttaccccgacccgaacccggtaaccggtaccccgtaccgggttccccgttccccccgttacccggtccccgtaccccttacccgtacccgtaccggaccgtaccgtaccctaccggtccgggtaccggacccgtaacggcccgggtccccggtaccgggtcccggtaccgtcccggtaccggttacccggtaccgtaaccgtaccccgtttaccgtacccgtaaccgtacccgtaacccgtaccggaccggtcgggtaccgggtacgaccggaaccggtaccgaccgtaacacgtacgcg

SEQ ID NO: 78723 - DNA, 698 bp, Homo sapiens
  misc_feature: GYAE6OF01B7BZ4.37.26.C04.1.454.CMB.1.raw
  modified_base (145)..(145): a, c, t, g, unknown or other
  misc_feature (145)..(145): n is a, c, g, or t
  modified_base (206)..(206): a, c, t, g, unknown or other
  misc_feature (206)..(206): n is a, c, g, or t
  modified_base (333)..(333): a, c, t, g, unknown or other
  misc_feature (333)..(333): n is a, c, g, or t
  modified_base (379)..(379): a, c, t, g, unknown or other
  misc_feature (379)..(379): n is a, c, g, or t
tcagtagtgtagatcacgaccggtgctcgatttagtctagcgactttgggtttgggggaggcttggtacagcctgggggtccctggagactctcctgtgccagcctctggttcatctttagcaactacgccatgagctgggtccnccaggctccgagggagggctgggacgtgggtctcaggtattacgtggtagtggtaatccgnatacgtacgcagactccggtggaccgggtccgttcaccgttctccagagactaacttccaaaagagtacggtctaatcgtaggaaatgaactagcctagagacgccggaaggccgacggtccccttntaacgttccgtggtacgccgaagaggactcgaaggtacggtagtanacggcaagtcaacgtctcgtagacgttacggtcggggacccaaaccgggtaccctgggtcccaccgttccacccgtcaaccgccctacccgaaccggtaacggccctagttcccggtccctccccgtcgtccctaccccgtccgtaaccaacgcctaccgtacccgttcgggacggggtaccaccgacgggcccggtcccggtcgggccttcggcccgttagggaacccgtaacggtaccttaccgtacccgtactacccgtacaccgttaggtcggacggccgggtcggaacggtaccgaaggtccgtacgaacgtcg

SEQ ID NO: 78724 - DNA, 728 bp, Homo sapiens
  misc_feature: GYAE6OF01DO8UA.37.26.C04.1.454.CMB.1.raw
  modified_base (253)..(253): a, c, t, g, unknown or other
  misc_feature (253)..(253): n is a, c, g, or t
  modified_base (278)..(278): a, c, t, g, unknown or other
  misc_feature (278)..(278): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctgggagtgggtctcgaggtattacgtggtagtggtaataccgcatactacgcagactccgtgacgggccgttcaccgtctccaganacaacttccaaagaatacggtctanctagaaatgaacagcctagagacgaccggagaacgaccggccctcttaattactggtgcgagagatcgaggaacggagtaatagcagctacgctaccgtgaaccgtacgtcgggggacccaaccgggtaaccctgggtaccctaccgtccctacccgtcaacgtcccctacccgaaccgaaccgggacccctacgtcccggttccccttccccgtacggacccctaccccttccccgtaaccaacgaccgcctacccgtcggtccggggtaccacggtaccggcccgggtaccccggtcgggtcgttccgggtacccgttagggttacccgaaacgggttaaccccttaacccgttaccgtaaccttaccgtaacctaacccgttaacccgtcgggaaccggggtccgggtaccgttcgggaaccgggtaaacggccgtacgaagtacgg

SEQ ID NO: 78725 - DNA, 885 bp, Homo sapiens
  misc_feature: GYAE6OF01BMXWS.37.26.C04.1.454.CMB.1.raw
  modified_base (885)..(885): a, c, t, g, unknown or other
  misc_feature (885)..(885): n is a, c, g, or t
tcagtagtgtagatcacgaccggtgctcgatttagtctagcgactttgggtttgggggaggcttggtacagccgtggggggtccctgagactctcctgtgcagcctctggtttcattctttagcaactacgccatgagcgtgggtccgccaggctccgagggaagggctggagtgggtctacgaggtattacgtggtagtggtaactaccgctatacctacgacaacgtactccggtaggaccggggtccggtttaccacccgttctacccaaggaacgaacctaaacgttccgaaaaaggtaaacgttaccggtacttaacgtacgtaagggtaaaaacttcggaaaacctacgtacgtaggaacggaccgacggaacgaccgtaccccgttactaactttacgtacgtggacgagtaaagacgtactacggaacggtaacggtaataacgacgacgaacgtacgtaaccgttccgttaagtaacccggtaaaccggttcggggggaacccgaacccggtaaacccggttccggtaccggtaacccgtcccttaaccgtacccgtacggtacccgtaccccgtaacccggaaccgggtaaccccgtaccgtaccggtttcccccgttcccccggtacccggtaccgtaacccccgttaccccgttaaccgtaaccggtaaccgtacccgtaacccggtacccgggttacggggacggttaacccgaccggtaccgggtacccccggtggttcccggtacggttacccgtacggtacggtaaaccgtaccggtaacctttacccgtactaacgttaccctaacgtaccgttaacggccggtagggtaccccggttaggaccgtaacggacgttacgagtaacggn

SEQ ID NO: 78726 - DNA, 755 bp, Homo sapiens
  misc_feature: GYAE6OF01CPAD6.37.26.C04.1.454.CMB.1.raw
  modified_base (229)..(229): a, c, t, g, unknown or other
  misc_feature (229)..(229): n is a, c, g, or t
  modified_base (291)..(291): a, c, t, g, unknown or other
  misc_feature (291)..(291): n is a, c, g, or t
  modified_base (333)..(333): a, c, t, g, unknown or other
  misc_feature (333)..(333): n is a, c, g, or t
  modified_base (752)..(752): a, c, t, g, unknown or other
  misc_feature (752)..(752): n is a, c, g, or t
tcagtagtgtagatcacgaccggtgctcgatttagtctagcgactttgggtttgggggaggtttggtacagccgtgggggggtccctgagactctcctgtgcagcctctggtttcattctttagcaactacgccatgagcgtgggtccgccgaggctaccggaaggggaaggggctgggagtgggtctacgtaaggttacttacgtgggtaagttaggtaaactaccgntaactactaacggcaagtacctccggtggaccggggtccgttcaaccggttcaccgaagaanaactaactcaaaagtacttacggctatcgaagaaatgaaacngcctaggagacgtaccggaggtacaccggtaccctagttaacttacgtggtgacggaacgagtactacgaaggacgggtaaataggacgcaggcgtaacgtccgtagtacggtaaacgtaccggggtaccgggacccgaaacggttaacccggttcggacccttaccggtcctacccgtacggacctacccgtaccgaaccgacggtaccctacgtcccggtacccttaccccgcgtccgtacccctacgtaacccgaagccgtaccgtaccgttacgggcgggtaccaaccgggtaccgggccgtacccgggttcgggtccgtccgtaccggttaggaaccgtaaccgttaccgttaactcctaactaccgtaactaccgtacggtagacgggccggagtaccggagacgagatacgngtc

SEQ ID NO: 78727 - DNA, 875 bp, Homo sapiens
  misc_feature: GYAE6OF01BLY1R.37.26.C04.1.454.CMB.1.raw
  modified_base (447)..(447): a, c, t, g, unknown or other
  misc_feature (447)..(447): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtcgggtccgccaggctccgaggggaagggctggagtcgggtctcgaggtattacgtgggtagtcggtaactaccgctaattactacgcacgacctccggtggaccggggtccggtttcaccggttctaccgaagagaactaattccaaagtaacgttaccggtctagtccgtaagggaaacttaggaaacacggtcctaggaacggacggcccggtaaggaacccgtaccggccccttagttaacttaccggtggtcggaccggaaggtacgtacgtacggaagggaacggtagtttaacgaaccgganacgggtacctacggtcgtacgttacggtaacccttacggggtaccgggggacccctaaacccgggtaacccgttcggggtaccctaacccggtttcctacccgtaccgaccggtacccccttacccgaaccggtacccgggaccccgttaccggttcccggtttacccccttccccgtccggtaaccccccttacccgttcccgtaaccgaacggcccgtaccccgaaccggttccggggacggggtaacccaccgggacccgggtacccggttcccggtcggggtaccctaccgggtacccggttacggtaccggtaaacccggtacccttaccgtccctaacgttacccgttaacctaacgtccggtacggtacccgggtaccgggtacggtccgggaagtaaacccggggtcgacgtaaggtacg

SEQ ID NO: 78728 - DNA, 720 bp, Homo sapiens
  misc_feature: GYAE6OF01BN4BW.37.26.C04.1.454.CMB.1.raw
  modified_base (242)..(242): a, c, t, g, unknown or other
  misc_feature (242)..(242): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggagggctggagtgggtctcaggtattacgtggtagtggtaataccgcatactacgcagactccgtgacgggccgttcaccgtcncagagacaattccaagtaatcggtctatctaggaaatgaacagcctgagacgccgagacacgcctntatacngtgcgagacgatcgagacggtagtatacggcaggcagtctgtacgacttacggtcggggaccctaaccgggtaaccctgggtacccacccggttcctcccgtaccgaccgtccccgtacccgaaccgaaccgggtcccgtacgttcccggttccccttcccccggtcggtaccctaccccttcccgtacccgaacgaccgacccgtacccgtcggtcggggacctaccgccgggtacccggtccccggtcgggtacccgttcggtaccccgttacgggtaccgtaaccggttaaccgttaccgttacccgtaaccgttacccgttaacccgtaaccgttaccggttacgggaccggtacccggggtcgttacgggaccgggaacgggtcccgtagtaacggtacgg

SEQ ID NO: 78729 - DNA, 643 bp, Homo sapiens
  misc_feature: GYAE6OF01BCSWF.37.26.C04.1.454.CMB.1.raw
  modified_base (637)..(637): a, c, t, g, unknown or other
  misc_feature (637)..(637): n is a, c, g, or t
  modified_base (642)..(642): a, c, t, g, unknown or other
  misc_feature (642)..(642): n is a, c, g, or t
tcagtagtgtagatcacgaccggtgctcgatttagtctagcgacttttgggtttgggggaggcttggtacagcctggggggtccctgagactctcctgtgcagcctctggtttcatctttagcaactacgccatgagctgggtccgccaggctccagggaaggggctgggagtgggtctcgaggtattacgtggtagtggtaataccgcatactacgcagactccgtgacgggcgttcaccgtctccagagacaacttccaaagaatacggtctatctaggaaatgaacacgcctgagagccggaaggaccaccggcccctacttattaccgtggtgacgagagatcaaggacggagtatagcaggcagtctcgtacgaccttacggtcgggggacccgaaccgggtaaccccgtggtacccaccgttcctcccgtcaccgtccctaccgaacccgaccgggccctacgtccggttccccttccccgtcggccctacccctccctaccgaacgcgacccgtaccgtcggcggggaccacggacggccggcccgtcgggcctcggtccgtcggtacgaacgtaccgtccttccaacttcctacgacttacgtggaccggcggacgtcggacgaggcgngtagng

SEQ ID NO: 78730 - DNA, 637 bp, Homo sapiens
  misc_feature: GYAE6OF01ENJJC.37.26.C04.1.454.CMB.1.raw
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
  modified_base (275)..(275): a, c, t, g, unknown or other
  misc_feature (275)..(275): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (629)..(629): a, c, t, g, unknown or other
  misc_feature (629)..(629): n is a, c, g, or t
tcagtagtgtagatcacgaccggtgctcgatttagtctagcgacttttgggtttgggggaggcttggtacagcctggggggtccctgagactctcctgtgcagcctctggtttcatctttagcaactacgccatgagctgggtccgccaggctccagggaagggctgggagtgggtctcaggtattactggtagtggtaataccgnatactacgcagactccgtgacgggccgttcaccgtntccagagacaacttccaagaatacggtctaatntggaaaatgaacagcctagagagccggtaagaccacggccccttattattaccgtgtgaccgagagtactcgagacgggtatatacgnaacgctagcttacgngacccttaacggnggcccaaccgggtaaccctgggtaccacccgtctcctacacgccctacccaccgacggtacccacgttccgtccgttccccgacgcccacccttcccgtactacgacaccaccgtcggtcggggcacgcgacccggtccgacgggtcgtccgccgttgggtaccgaaggtaccttacgttccacgttaccgtaccgtaacttacggtacggacgtcgggtaccgtggacggaagccgngtagtacg

SEQ ID NO: 78731 - DNA, 603 bp, Homo sapiens
  misc_feature: GYAE6OF01ASRQV.37.26.C04.1.454.CMB.1.raw
  modified_base (269)..(269): a, c, t, g, unknown or other
  misc_feature (269)..(269): n is a, c, g, or t
  modified_base (593)..(593): a, c, t, g, unknown or other
  misc_feature (593)..(593): n is a, c, g, or t
  modified_base (596)..(601): a, c, t, g, unknown or other
  misc_feature (596)..(601): n is a, c, g, or t
  modified_base (603)..(603): a, c, t, g, unknown or other
  misc_feature (603)..(603): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattacgtggtagtggtaataccgcatactacgcagactccgtgacgggccgttcaccgtctccagagacaattccaagatacgctntatctgcaaatgaacagcctgaagagccgaagacgacggccgtatattactgtgtagaaggcgtggggagtgggggactacggtcggggaccgaacgggaccgtggtccaccgtctcctcacgccctaccaaccggaacgggcccctacgtccggttcccttcccccgtcggaccctaccccttcccgtaaccgaacgaccgacccgtacccgtcggtcggggaccacgacggcccggccgtggcctcgccgtggtacacgtaccttactcctacttacacactacgtagacggccggtcgacggacgaacggccatacgtagnagnnnnnngn

SEQ ID NO: 78732 - DNA, 638 bp, Homo sapiens
  misc_feature: GYAE6OF01A9ZCX.37.26.C04.1.454.CMB.1.raw
  modified_base (143)..(143): a, c, t, g, unknown or other
  misc_feature (143)..(143): n is a, c, g, or t
  modified_base (205)..(205): a, c, t, g, unknown or other
  misc_feature (205)..(205): n is a, c, g, or t
  modified_base (298)..(298): a, c, t, g, unknown or other
  misc_feature (298)..(298): n is a, c, g, or t
tcagtagtgtagatcacgaccggtgctcgatttagtctagcgactttgggtttgggggaggcttggtacagcctgggggtccctgagactctctgtgcagcctctggtttcatctttagcaactacgccatgagctgggtccncaggcctccgaggggaagggctgggagtgggtctcaggttattactggtagtgtaactccgnatacgtacgcaggacctccggtgaccgggccgttcaccgtctcagacgaacaactttccgaagacgttacggtctagctaggaaatggaaacngtctgagacgccggaaggaccacggcccttatattaccgtggtggacgaagagtatcgaagacgggtatatacggcaggcctagcttcgagactacggcggggaccctacggaacccgtggttcccaaccgttctacccgacgacgtccccgtaccgacccgacggtcccgtacgtcccggttcccgttcccccgtcgacccgtccctcccgtaccgaacgacgtcgaccgtccggtacggcaccgcgaccggtccgtcggtcgtcgtcgtacgtacgacggtctaccgtccagtccgtacgagtacgtggacggtcggacgtggacgaggcgtgagtcg

SEQ ID NO: 78733 - DNA, 713 bp, Homo sapiens
  misc_feature: GYAE6OF01BC4KQ.37.26.C04.1.454.CMB.1.raw
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (348)..(348): a, c, t, g, unknown or other
  misc_feature (348)..(348): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgaccgggccggttcaccgtctccagagacaattccaaagaactacggtctatcgtaggaaatgaacagcctgagagccgagacncggccctntattacgtgtgcgagagactcgaggacgatanacgcagcagctcgtgactcggcggacccgaaccggtacccgtcggtaccgtcccgttcctccctacgaccgtacccctaccgaacccggaccggccctaccgttcccggtttaccccgttcccccgtcggacccctaccccgtacccgtaaccgaaccgaccgtacccgtacccgtcgggtaccggggaccaccggaccgggtcccggtcccggtcgggtcccgtaccggtcccgttacggtaaccgtaaccggtacctttacccgtacccttaaccgtacccgttaaaccgtacccgttacggtacgggacccgggtcccgggttacggtacccggaacggaccggtccgtaaccgtcggtacg

SEQ ID NO: 78734 - DNA, 690 bp, Homo sapiens
  misc_feature: GYAE6OF01CZWTD.37.26.C04.1.454.CMB.1.raw
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (683)..(683): a, c, t, g, unknown or other
  misc_feature (683)..(683): n is a, c, g, or t
tcagtagtgtagatcacgaccggtgctcgatttagtctagcgactttgggtttgggggaggcttggtacagcctggggggtccctgagactctcctgtgcagcctctggttcatctttagcaactacgccatgagcgtgggtccgccaggctccgaggggaaggggctggagtgggtctcgaggtattacgtggtagtggtaataccgcatactacgcagacctccggtggaccgggtccgttcaccgtctaccagagtaacaattaccaaagtaagtacggtctaatcgtaggaaaatgaacagctagagacgccgaggaccacggccctattatacngtgcgaganancaaggacgatanacgcagcagctacgtacgtaacgttacggccggggaacccaaccggaaccgttcgggtacctacccgttcctaccacgaccgccctacccgaaccgtaaccggccccgtacgtcccggttacccctccccgtacggacccctacccttacccgtaccgaaacgtacgacccgtaccggtccggtcgggggacctacggaccgggcccggtacccggtcggggtaccgtccggtccgtacgggtacgtaaccggtaccttacctcctaacgtacctaccgtacgtacgtcggtaccggcggtacggtacgacggaacgggcngtagacg

SEQ ID NO: 78735 - DNA, 796 bp, Homo sapiens
  misc_feature: GYAE6OF01D0TSD.37.26.C04.1.454.CMB.1.raw
  modified_base (207)..(207): a, c, t, g, unknown or other
  misc_feature (207)..(207): n is a, c, g, or t
  modified_base (414)..(414): a, c, t, g, unknown or other
  misc_feature (414)..(414): n is a, c, g, or t
  modified_base (749)..(749): a, c, t, g, unknown or other
  misc_feature (749)..(749): n is a, c, g, or t
tcagtagtgtagatcacgaccggtgctcgatttagtctagcgactttgggtttgggggaggcttggtacagccgtggggggtccctgagactctcctgtgcagcctctggttcatctttagcaactacgccatgagctgggtccgcgaggctcgagggaggggctggagtgggtctcgaggtattacgtggtagtggtaactaccgntaactacgtacgcagacctccggtggaccgggtccggttcaccgtcctaccgagacgaactaacttccgaaagtaacttacggtcttatcgtagaaaatgaaaccagccgtagacgacggccggaacggaccgacccggtcccttattaagtttacgtggtacgacggaacggacgtaataccgggaacggtaacgggtaagttaanacggaccgtaggaccgtaacgtccttacggtacgtaacccggttaccgggacgggggacccccctaaacgggtacccgttcgggtacccctacccggttacctaccccgtcgacccgtacccccgtacccgaaccggtaaccccggcccgtacgttcccgggttccccttaccccggtccgtacccctaccccgtcctaaccgtaacgaccgtccgtaccgtcgggcgggtaccaacggtcgggtaccccggtcggtcgggtccgttacgggtccgtacggaccgtaaacggttccttaccgttaccgaccttaccgtacccgtacggttacggngggtaaccggcgggtaccgtacgggacccggtaggccgtgtaacgtc

SEQ ID NO: 78736 - DNA, 810 bp, Homo sapiens
  misc_feature: GYAE6OF01EKNF2.37.26.C04.1.454.CMB.1.raw
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
  modified_base (768)..(768): a, c, t, g, unknown or other
  misc_feature (768)..(768): n is a, c, g, or t
tcagtagtgtagatcacgaccggtgctcgatttagtctagcgactttgggtttgggggaggcttggtacagcctggggggtccctgagactctcctgtgcagcctctggttcattctttagcaactacgcatgagcgtgggtccgccgaggcctccggaggggaagggcgtggaggttgggtctacgaggttattacgtggtagtaggtaactaaccgntaataccgtacgcgagaccgtccggnggaccgggtccggttccaccgttcctaccgagaacgactaacttaccgaaagacgttacggtactagtactagaaatacgaacacgcctagagacgaccggaacgaccgaccgaccccttagttacgtacgtggacggcggacgtagaacgtcgtaagggaacgtaagttaactggactaggacgtagtccgtcgtacggtaaccgtacggacgggtaccccgaacccgggtaaccgttcggtacccgtacccgttcctccgtaccgtacccgtcccgaaccgaaccccgggaacccggtcccgttaaccgtccccgggtttaccccccttccccggcccgtaaccccgtttacccccgacccgtaaccgaacggtaccccgacccgtacccgggttacccgggacgggacccgtaacccgccggggtccccggtcccggtacgggtcccttcccggtaacggttccgtaacggtaaccgttacccttaccgtacctacgtttaacccgacgttacgggaccngggtaccgggtcccgtaggtaccgaacggacgtccagtagtg

SEQ ID NO: 78737 - DNA, 687 bp, Homo sapiens
  misc_feature: GYAE6OF01CRK2P.37.26.C04.1.454.CMB.1.raw
  modified_base (303)..(303): a, c, t, g, unknown or other
  misc_feature (303)..(303): n is a, c, g, or t
  modified_base (492)..(492): a, c, t, g, unknown or other
  misc_feature (492)..(492): n is a, c, g, or t
  modified_base (566)..(566): a, c, t, g, unknown or other
  misc_feature (566)..(566): n is a, c, g, or t
  modified_base (647)..(647): a, c, t, g, unknown or other
  misc_feature (647)..(647): n is a, c, g, or t
  modified_base (664)..(664): a, c, t, g, unknown or other
  misc_feature (664)..(664): n is a, c, g, or t
  modified_base (683)..(683): a, c, t, g, unknown or other
  misc_feature (683)..(683): n is a, c, g, or t
tcagtagtgtagatcacgaccggtgctcgatttagtctagcgactttggggtttgggggaggcttggtacagcctggggggtccctgagactctcctgtgcagccttctggtttcattctttagcaacctacgccatgacgcgtgggtccgccaggcctccggaaggggaaggggtctgggacggtgggtacctcgaggtatttacgtggtagtggtaaacaccgcaattacgcgcagctccggtggaccgggtccgttcaccgtcaccaagacgacaaacttaccaaaagtacgtaacggtnttaactacgtaaggaaatcggaaacacgtccgtaggacggacggaccggacgggaaccgtaccggtcctttacgtaacgtcgtggtacgacgaaaggtacacgtacaacggtaagggattagacgactagcgtagctacgtagaaccgtcggtacggggaccaaccgtacgtccgtactcccgtctccncacgtcccaccgaaccgacgggcctcgtaccgttcccgttcccaccgtccctaccctaccgaccaacggtaccnccgacgtcgggacggccacggtaccgccgtccgtcgcgtcgtcgtacgacgaccgtacctactccgtataccgaccgtaanacggccggagtccggcnccgggacacgggacctagntacg

SEQ ID NO: 78738 - DNA, 828 bp, Homo sapiens
  misc_feature: GYAE6OF01DU6V3.37.26.C04.1.454.CMB.1.raw
tcagtagtgtagatcacgaccggtgctcgatttagtctagcgacttttggggtttgggggaggcttggtacagccctggggggtccctgagactctcctgtgcagcctctggtttcattctttagcaactacgccatgagcgtgggtcccgccaggcctccggaagggggaacggggctgggaggtgggtctcgaggttatttaacgtgggtagttagggtaaactaccggactaataaccgtacgcgaacgtaccgttccggtacggaccggggtcccggttctaacccggttctacccgaaggacgaaacctaacttaccgaaagtaacgttccggttacttaacgtacgtaaggaaaattcgaaaacgacgtccgtaggaacgaccggaccggaacggacccgaaccggtccccttatttaacgtttccgtggtcgacggaaggagtacgtacggaaggacggtaatagacgacgagcgtaactcgttagtacggtaacgtcgggtccggggaaccccaaaccgggtaccgttcgtaacccacccgttcctacccggctacccgacccgtacccgaacccggaaccggtccccgtaccgtttcccggttacccccgttccccggtcggtcccgtcccgtccgaccgttacccggaacggtccgaccccgtacccgacggtaaccggacaccggaaccgccgggacccggtccggtcggtaccggttaccgccggttaacggtaccgtaaccggttaccttaccgtaccgtacttacctaaccgtacgtccgacggtacggtcgggtacgaggaccgtggcctacg

SEQ ID NO: 78739 - DNA, 895 bp, Homo sapiens
  misc_feature: GYAE6OF01DL2AW.37.26.C04.1.454.CMB.1.raw
  modified_base (401)..(401): a, c, t, g, unknown or other
  misc_feature (401)..(401): n is a, c, g, or t
  modified_base (452)..(452): a, c, t, g, unknown or other
  misc_feature (452)..(452): n is a, c, g, or t
  modified_base (827)..(827): a, c, t, g, unknown or other
  misc_feature (827)..(827): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgagggaagggctggaggtgggtctcgaggtatttacgtggtagtaggtaacaccgcatacctacgcgtacgacctccggtaggaccgggtccggttcacccgttctccgaagacgaactaacgttaccaaaggaaagttaccggtcttaagtacgttaaggaaaacgttcggaaacgtaacgtcccgtaggaacggaacggacccggaacggaaccgaccggtcccccttagttaactttaaccgnggtacgacgtaaggacgtaatccgaaagggtacggtagttaagtacggacncggacgagtaccgtacgtaacggtaccgttaccggtacggggccccgtaacccgggtaacccggtcgtacccgtacccggttctaccccgttcgaaccgggtccctacccgaaccggaaccggccccgtacggttccccgttaccccttcccccggcggtaacccctacccccgttacccgaccgaacggtacccgtaccggttacccggttcgggacggggtacccacgggttaccccggtacccgggtcccgggtacggggttcccctccgggggttaacccgttacgggtaacccgtaaacccggggtttaccccttaaccttacccgtttaaacccgttaccccgttaaccggtaaacgtttacccccggnggggaccgggtacccggggaaaccggttccgggaaacggttaacccggccgttaaaggttccgaacgg

SEQ ID NO: 78740 - DNA, 865 bp, Homo sapiens
  misc_feature: GYAE6OF01CMT43.37.26.C04.1.454.CMB.1.raw
  modified_base (435)..(435): a, c, t, g, unknown or other
  misc_feature (435)..(435): n is a, c, g, or t
  modified_base (863)..(863): a, c, t, g, unknown or other
  misc_feature (863)..(863): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggcctccgaggggaaggggctgggaggtcgggtctcgtaggtattacgtgggtagtacggtaactaccgctataccgtacgcacgaccgtccggtaggaccggggtccgttacgacccgtctaccgaagaacgactaacttaccaaaggaacgttacggtcttaatcgaaggaaatacgaacacggtccgtagggaacgacggaccggaacggacccgaccggtccctacttagtacgttggcgacggaagacgtaactacggaacgggaacggtaagttaaacgnggaccgacggacctaacggtcttaccggtaacgtaaaccggtacccggttaccggggggaacccctaaacccggggtaacccgttcgggtaaccccctaacccgggtttcccttacccggaaccgacccgtacccccgtacccgaaacccggtaacccgggtccccgtaaccgttcccggtttcccccgtacccccggtacggtaccccctacccgtacccgtacccgaaaggtacccgacccggtacccggtaccggggtacggggaacccaaccgggtcccgggaccccgggtcccggtaccggggtcccgtccggttaccggtaccggaaccggtaaccgtccttacccgtacctaacgttaacccgtacctaccggtacggtacgggacgggtcccggaggtacggaaccgtagggcccagtancg

SEQ ID NO: 78741 - DNA, 947 bp, Homo sapiens
  misc_feature: GYAE6OF01EYNNA.37.26.C04.1.454.CMB.1.raw
  modified_base (933)..(933): a, c, t, g, unknown or other
  misc_feature (933)..(933): n is a, c, g, or t
  modified_base (939)..(941): a, c, t, g, unknown or other
  misc_feature (939)..(941): n is a, c, g, or t
  modified_base (943)..(943): a, c, t, g, unknown or other
  misc_feature (943)..(943): n is a, c, g, or t
tcagtagtgtagatcacgaccggtgctcgatttagtctagcgactttgggtttgggggaggcttggtacagcctggggggtccctgagactctcctgtgcagcctctggttcatctttagcaactacgccatgagctgggtccgccaggctccagggaaggggctggagtgggtctcaggtattactggtagtggtaataccgcatactacgcagactccgtgacgggccgttcaccgtctccagagacattccaagaacacgctctatctgacaaatagaacgagcctggagacggacccgaacgaaccgaccggtaccgtaagttaactttaacgtggttacggttagggaaaacgggtaccgggtggggggtaacgggttacggggggggggtaaccgttaaccggggttacggggggaccccgggtaaaccgggggtaacccccggttaacggggttacccgtaaccccgggtttaccccgttaccccgttacccgtaaccggtacccccgttaaccccgaaacccccgggtaaaacccggggggtcccccgtaaaccggttttccccggggtttcccccgttttacccccccccggtttacccggggtacccccttaacccccccccgttacccccgttaacccccgtaaacgggtaacccggtacccccgtaaacccccgttcccggggtccgggggggtacccgaacccgggtaccgggtccccggggtccccccggttaccggggggtcccgttacccggtccccgggttaccggggttaacccggtaaaccgggttaaacccgtttaaccccggtttccctaaccgtttacccttaacccgtaacccgtttacccggtacgggtacggtccgggggtaccgtaccgggaccggacgggtaccgaccgtaacggtaacgcgtacncgtcgnnngngtcg

SEQ ID NO: 78742 - DNA, 764 bp, Homo sapiens
  misc_feature: GYAE6OF01B98WV.37.26.C04.1.454.CMB.1.raw
  modified_base (255)..(255): a, c, t, g, unknown or other
  misc_feature (255)..(255): n is a, c, g, or t
  modified_base (288)..(288): a, c, t, g, unknown or other
  misc_feature (288)..(288): n is a, c, g, or t
  modified_base (578)..(578): a, c, t, g, unknown or other
  misc_feature (578)..(578): n is a, c, g, or t
tcagtagtgtagatcacgaccggtgctcgatttagtctagcgactttgggtttgggggaggcttggtacagcctggggggtccctgagactctcctgtgcagcctctgtttcatctttagcaactacgccatgagcgtgggtccgccaggcctccgaggggaaggggctggaggtgggtctcgaggtattacgtggtaagtggtaactaccgcatactacgcagacctccggtggaccgggtccgttcaccgtcnccagagacaacttccaaagaccaccctgtcctntgacaaatcgaaacaaccgttgacgacgccgacggacacgccttatacttactagtaacgaaaatcggacctaacggattagtagaaccgtacttaggttcgggacttcggttacttcgtatccgttacggtcggggtcccgtggtacccacccgttggtacctcgttacgttccctccgtcaaccgtcccctaccgtaacccggaacggggccccctaagtttccccgggtcccctttccccggacggtccccggtcccctggttaccccgtaccggaacgggtacccncccgtaaccccgtcgggaaccggaccggacctaacgggtaccggccccgggtcccgttacggggtcctccgtacccgggttacgggtccgtaaaacgggtccctttaaccgtcccgtaattacccgtaacgttaaccccgtacgcggggtacggccgggtaacggtcgggtaacgaccggggtacc

SEQ ID NO: 78743 - DNA, 911 bp, Homo sapiens
  misc_feature: GYAE6OF01CZMG4.37.26.C04.1.454.CMB.1.raw
  modified_base (101)..(101): a, c, t, g, unknown or other
  misc_feature (101)..(101): n is a, c, g, or t
tcagtagtgtagatcacgaccggtgctcgatttagtctagcgactttgggtttgggggaggcttggtacagcctggggggtccctgagactctcctgtgcngcctctggtttcatctttagcaactacgcatgagctcgggtccgccgaggctccgaggggaaggggctggaggtgggtctcgaggtattacgtggtagtagtaactaccgcatactacgcagtacctccggtggaccggggtccgttccaccggtctccaagagaactaacttaccgaaagtaaacgtacggtactaacgtcgtaaggaaatacgaacgacgccgtaggacgaacggacccgaagggaaccgtaccggtaccccttagttaacgtttaacgtggtcggacgaaggagtagtacgaaggacgggtaagttaacgacggaacgacggacgtacgtaccgttacgttacggtaacccgttaaccggggccggggtaccccggtaaacccgggtaacccggtttcggggtaacccctaacccggttccctacccgttaccggaacccgttcccccaaacccggaacccgggacccggtaccccgttaccgttccccggtttaccccccgttccccggttaccggacccccttaccccgtacccgtaacccgaaccggtacctccccggttaaccggttcgggggtaccggggacccaaccgggttacccgggccccgggttacccgggttccggggtacctcccgggtttacccggtaacgggttaaccgaaaacccgggtttacccctttacccgttaccgtacctttaacccggtaaacccgtacgtttaccgggtaaacggggccgggtacccgggttacgggtaccgggaaacccgggagggtccccgttaagaacggta

SEQ ID NO: 78744 - DNA, 603 bp, Homo sapiens
  misc_feature: GYAE6OF01C91X9.37.26.C04.1.454.CMB.1.raw
  modified_base (137)..(137): a, c, t, g, unknown or other
  misc_feature (137)..(137): n is a, c, g, or t
  modified_base (260)..(260): a, c, t, g, unknown or other
  misc_feature (260)..(260): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
  modified_base (495)..(495): a, c, t, g, unknown or other
  misc_feature (495)..(495): n is a, c, g, or t
tcagtagtgtagatcacgaccggtgctcgatttagtctagcgactttgggtttgggggaggcttggtacagccttggggggtccctgagactctcctgtgcagcctctggtttcatctttagcaactacgccatganctggtccgccaggctccgagggaaggggctggagtgggtctacgaggtatttacgtggtagtggtaactacccgcatacctacgcaggacctccgtggaccgggccgttcaccgtctccaganacaattccaagaatacggtctatcgtaggaatgaacacgcctagagagccgagacncgcctntagttacngtgacgagagatnaggagagtangacagcanctngactaggtcgggaccncggacctgccncgtcnctcgacncctcaccgacggccacgtcgtcccttcccgtacgaccctaccctacctaccgacgccgactcccgtcgtcgggcacgaccgccggtacccgngggacctcggccgtacggtaccgaacggtacccttaccgtaccctactaccgtaaccctacgtacgtacggaccgggcgggtacgtcggacgacggtcggcttaagag

SEQ ID NO: 78745 - DNA, 659 bp, Homo sapiens
  misc_feature: GYAE6OF01CT1EC.37.26.C04.1.454.CMB.1.raw
  modified_base (191)..(191): a, c, t, g, unknown or other
  misc_feature (191)..(191): n is a, c, g, or t
  modified_base (319)..(319): a, c, t, g, unknown or other
  misc_feature (319)..(319): n is a, c, g, or t
  modified_base (351)..(351): a, c, t, g, unknown or other
  misc_feature (351)..(351): n is a, c, g, or t
tcagtagtgtagatcacgaccggtgctcgatttagtctagcgactttgggtttgggggaggcttggtacagcctggggggtccctgagactctcctgtgcagcctctggtttcattctttagcaactacgccatgagctgggtccgccaggctccgagggaagggctggagtgggtctcgaggtattacgnggtagtgtaataccgcatactacgcagactccgtggacggccgtcaccgtctcaagagaactattccaaagatacggtctatctaggaatgaacagctagagacgacgagaccacgtcctatattacngtagcgtagacgtagaccaggaacgagttaanagacgaagcgaacgcctagacgtaacgttacggcggggaacccaccggtacctggtacctaccctctaccgtcacgtcctaccaaccgacgccacgtccgtacccttcccgacgccctaccctccgtaccaacgacgacctaccgtcggtacgggacctacggaccggtcccggcccggtacgggccgtaccgtaccggttacggtaaccggtaaaccgtaccgttaccctaccgtaaccttacctaaccgtaccttacggacggttaccggacgggtaccgtacgacggtaacggccgaagtgaacg

SEQ ID NO: 78746 - DNA, 611 bp, Homo sapiens
  misc_feature: GYAE6OF01BWTOX.37.26.C04.1.454.CMB.1.raw
  modified_base (340)..(340): a, c, t, g, unknown or other
  misc_feature (340)..(340): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccgttcaccgtctccagagacaattccaagaatacggtctatctaggaaatgaacagcctgagagccgagacacggcctctattactgtgcgagagatcaagacggatanagcagcagctcgtgactacgtcggggaccaacggtaaccctgggtcccaccgttctcctacacgccctaccaccgacggcccctacgtcccggttcccttcccccgtcggccctacccctccctaccgaacgacgaccgaccctccggtcggggccacgacggcccggtcccggtcgggccgtccgtccgtacggtacgtaacggtacctaccttccacttcctacctactacgtcggacggcgggcgtacggacgaaggcgcgtagtacg

SEQ ID NO: 78747 - DNA, 607 bp, Homo sapiens
  misc_feature: GYAE6OF01ADXL6.37.26.C04.1.454.CMB.1.raw
  modified_base (244)..(244): a, c, t, g, unknown or other
  misc_feature (244)..(244): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
tcagtagtgtagatcacgaccggtgctcgatttagtctagcgactttgggtttgggggaggcttggtacagcctggggggtccctgagactctcctgtgcagcctctggttcatctttagcaactacgccatgagctgggtccgccaggctccagggaacgggctggagtgggtctcaggttattacgtggtagtggtaactaccgcatactacgcagactccgtgacgggccgttcaccgtcncagagacattccaagatacggtctatcgtaggaaatgaacagcctgacgacgccggaggaccaccggcccctatacttacctgtgcggagagatcaggacggtagtatagcagcagctngactcgngggccacgactgacncgtcnctcncgccnccacgacggcctacgtccgtcctccccgtgccaccctcctacacgtcgcaccgtcggtcggggaccacgacggcccggccggtcgggtcctccgtccgtcggtaccgaacgggtacccttaccgttaccctagttacccgtaacctacccgtaacgtcgggaaccgggtcccgggacggtcgggaacgaccgggtccgacgagtacgg

SEQ ID NO: 78748 - DNA, 793 bp, Homo sapiens
  misc_feature: GYAE6OF01DDBAA.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctgggagtgggtctcgaggtattacgtggtagtaggtaactaccgcatacctacgcagacctccggtgaccgggtccgttcaccgtctccaagagaacacttccaaagtaactacggtctatcgtaggaaatcgaacagtcctaggaacgacgacccgaaggaccaccggtcccctattagttaccgtggtcgacggaagaacgactcggaacggtaacggtataactacgacagcacgtctcgtacgaaccgtacgggtcgggaccctaaccgggaacccttcgggcctaccgtccctaccgtcgaaccgtccctaccgtaacccggaccggtacccctacggttccccggttacccccttccccggtaccggacccctaccccttacccgtaaccgaaccggtacccgaccccgtacccgggttaccgggtaccggggaaccctaaccgggccggtcccgggtacccccgggttcgggtcccggtaccggtccggttaaccggtacggtaaacccggttaacctttacccgtacctaacttacccggtaaaccgttaacccgttaccggtaacgggtaccggtccgggtaaccgtacgggaaccggtagggaccgtagaagtacg

SEQ ID NO: 78749 - DNA, 560 bp, Homo sapiens
  misc_feature: GYAE6OF01DTWD7.37.26.C04.1.454.CMB.1.raw
  modified_base (206)..(206): a, c, t, g, unknown or other
  misc_feature (206)..(206): n is a, c, g, or t
  modified_base (356)..(356): a, c, t, g, unknown or other
  misc_feature (356)..(356): n is a, c, g, or t
  modified_base (434)..(434): a, c, t, g, unknown or other
  misc_feature (434)..(434): n is a, c, g, or t
  modified_base (447)..(447): a, c, t, g, unknown or other
  misc_feature (447)..(447): n is a, c, g, or t
  modified_base (465)..(465): a, c, t, g, unknown or other
  misc_feature (465)..(465): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaagggctggagtgggtctcaggtattactggtagtggtaataccgnatactacgcagactccgtgacgggtccggttcaccgtctccagagacaattccaagaaccacctgtctctgcaaaatgaaacaacctgagagccgagacacggccctatattactgtgcgagagatcgagacggagtatagcagcagctntgactacgtggggaccacggacctggccacccgtctcctcacgcctccaccgaacggccagtccggtcctccctgccnccctccacagacnctaccgtcggtcgggacncgacgccggtacccgtgggctcgcctggtacacgtactacctctactcgtacctactacgtcgacggtccggcgtacggacacggcgcgagtacg

SEQ ID NO: 78750 - DNA, 843 bp, Homo sapiens
  misc_feature: GYAE6OF01DZ386.37.26.C04.1.454.CMB.1.raw
  modified_base (297)..(297): a, c, t, g, unknown or other
  misc_feature (297)..(297): n is a, c, g, or t
tcagtagtgtagatcacgaccggtgctcgatttagtctagcgactttgggtttgggggaggcttggtacagcctggggggtccctgagactctcctgtgcagcctctggtttcattctttagcaactacgccatgagcgtgggtccgccaggctccgaggggaaggggctggagtgggtctcaggtatttactggtagtggtaataccgcatactacgcagactccggtgacgggtccgttcaccgtctccgagacgacaattccaagacttacggtctatcgtaggaaatcgaacncgcctaggacggacgccggaaggaccctacccggccccttacgttaatttaccgtggttacggaccggaaggtacgactacgaacgggtaacggagttaacgtacggacaacggcgaaccgtcgttaccgtacggtaacccggttaccgggtcggggggaacccccgtaaccgggttaaaccccgttgggtcccctacccggttcccttcccggtccgaaccgtacccccttacccggaacccgaaccggggtacccccgttacggttcccccggttaccccgtttccccccgtacgggccccttaaccccccttacccgtaacccgaaccggtcccgacccgtacccgttcgggtacccggggtaccaccggaaccgggcccgggtacccggtccggggtcgttcccggacccggtttcgggaacccgtaacggtaccctttaccgttacccgtaacttacccgtaaacccttcgttaaccggtcgggacccggggtaccggttccgggtaccggacccgggtaacggtaccggtacgtaggacg

SEQ ID NO: 78751 - DNA, 935 bp, Homo sapiens
  misc_feature: GYAE6OF01B73ZC.37.26.C04.1.454.CMB.1.raw
  modified_base (306)..(306): a, c, t, g, unknown or other
  misc_feature (306)..(306): n is a, c, g, or t
tcagtagtgtagatcacgaccggtgctcgatttagtctagcgacttttggggtttgggggaggcttggtacagccgtggggggtccctgagactctcctgtgcagcctcttggtttcatctttagcaactacgccatgagcgtcgggtccgccaggcctccgaggggaagggcgtgggaggtgggtctcgtaggttattacgtggtagtagtaactaccgcaatactacgcacgtaccgtccggtggaccgggtccgttccaccgtctacgaagaacgaactaactaccgaaagtaacgtacggtnttaactacggtaaggtaaaatacgaaacctacggtaccgtaggaacggaccgaccggaacggaccgacccggtcccttaatttaacgttacgcggtaggaaccggtaagaacgtactaccggaaaggtacgggtaattaagaccgacgtaacggcctaacgtccgttacgtaacggtaaccgttaccgggaccgggggtaacccctaaacccgggttacccgtacgggttaccctaacccccgttcttaacccccggtactaacccccgtaccccgttaaccccgggaaaacccgttaccccggggtaccccgtaacccggtttacccccggggtttccccccttaccccccgggtaccgggttaaccccctaccccccgtttaaccgaaaccccggtaaacggacccgtaaccccggttaacccggtccggggggtaaccgggaacccaaccgggtacccggccccgggttaaccccgggtggtaccccggtaaccggtcccggttaaacgggtaccgtaaaccgggttccctaaccgtttaccgtaaaccgtacccgttaaacgttaccgtaacgggtcggtaacgggtcggtaccccgaggaacgggtaccgactaaggtcgacgg

SEQ ID NO: 78752 - DNA, 693 bp, Homo sapiens
  misc_feature: GYAE6OF01CRWGJ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggattcaactttggtagctattggatggactgggtccgccagtctccgagggaaggggcgtggagtgggtggccaacatacgaggggaggtgggtggtaacgaaaaactatgtaggactctggtggccgggggccgattccaccatctccagagaacaacgaccaaaaactcactgtatctagacaaagtgggacggccgtagacgactccggaggacacggcctggttgtactttagttgtgacgagagtatttaagaactaagtaaaggtttcgagtgacttggtatggaatgtattagtgactaccggtcggggaccaaagggtaccagtcggtcctaccgtctcgttccacgtccctacccgacccgaacgggtaccctacgtcccggttcccgtccccgtacggcccgcccttccgccgtaccgagggccgccaccgtccgaacggtacgaccgaccgaccggccggaccccggtcgggtcccgtcggtcccgtacgggttaccgaaaccggttaccttacccgttacctaccgttaccctaacccgttaactaccggtacgggcgggtcccgggtacggg

SEQ ID NO: 78753 - DNA, 889 bp, Homo sapiens
  misc_feature: GYAE6OF01DXAW1.37.26.C04.1.454.CMB.1.raw
  modified_base (292)..(292): a, c, t, g, unknown or other
  misc_feature (292)..(292): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtcgggtccgccaggctccgaaggggaaggggctgggagtgggtctcgaggtattacgtgggtagtaggtaactccgcaatacgtacgcagtacctccggtggaccggggtccgttcaccgtctcgagagactaattccgaaagtaacgtacgtntagcgtaggaaaatcgaacagcctaggacgacgcccggaaggaccgaccggtccccttacgtaagtttaccgtggtcgacggaagacggaataccgaaggtacgggtaagtaacgtagaccgaaggtcacgtaccgttcgtaacgtaaccgttaacgggtcggggaccccgtaaaaccggggtaaccccgttgggtaacccccttccggtaaccctttcccgaccgaaccgtcccccgttacccgaaaccccggtaacccggggtaccctaacccggtttccccgggtttcccctttccccccgggtaccggtaccccttaaccccccgttaccccgtaaacccgtaaaccggaccgtaccccggtaccggttaccgggtacgggggtaccctaaccgggaacccggggttcccgggtcccgggttcgggtacccggttccggtacccgggttacggtaacccggtaaccgggttaacctttacccgttaaccgtaaccttacccgttaaaccgttacccggttaaccggtcgggacccggggtacccgggtccgggtaaccgggacccggtaaacggtcccgggtataccggtagg

SEQ ID NO: 78754 - DNA, 870 bp, Homo sapiens
  misc_feature: GYAE6OF01BVJZZ.37.26.C04.1.454.CMB.1.raw
  modified_base (144)..(144): a, c, t, g, unknown or other
  misc_feature (144)..(144): n is a, c, g, or t
  modified_base (207)..(207): a, c, t, g, unknown or other
  misc_feature (207)..(207): n is a, c, g, or t
  modified_base (382)..(382): a, c, t, g, unknown or other
  misc_feature (382)..(382): n is a, c, g, or t
tcagtagtgtagatcacgaccggtgctcgatttagtctagcgactttgggtttgggggaggcttggtacagccgtggggggtccctgagactctcctgtgcagcctctggttcatcttagcaactacgcatgagcgtgggtccnccaggctccgaggggaagggctggagtgggtctcgaggtattacgtggtagtggtaactacgngatacgtacgtacgacgacgtccggtacggacgggtaccggtcctaccgtaccgtccacgagtacgaactactaacgaagtacggtactactacgtaggtaaagtagaacgaacgcgtacgaggaacgaccggtacggaacgaccccggtcccgtcttaacgtttacggttacgnggtaccggaaggtaacggtaagtacggaaacggtacgggtaaacggtaagttacgacgacgtaccgaacgtacgtcgttacggtaaccgtaacggtccggggtaccccgaaaccgggtaacccgttccggtaccgtaccccgtccgttacccctcggtaccgacccgtacccgtaacccgaacccggggttacctaccccgttccgggtttacccccgttcccctcccgggtacccgtacccccttacccgggtaaccctaaacggtaaccccggtccaccccggttacgggttacggggcccggttaaccgccccggggtccggtttccccgggaccgttaccggtcccggttcgttaaccgggtacggtaaaccggtccttacccttaccgacgttaccccgttaaacgacccggttacgttacgggacgggtccccgggtagttacccggggaaccgttaacggggccgtaacgttcggaaacgg

SEQ ID NO: 78755 - DNA, 739 bp, Homo sapiens
  misc_feature: GYAE6OF01D3UDA.37.26.C04.1.454.CMB.1.raw
  modified_base (213)..(213): a, c, t, g, unknown or other
  misc_feature (213)..(213): n is a, c, g, or t
  modified_base (393)..(393): a, c, t, g, unknown or other
  misc_feature (393)..(393): n is a, c, g, or t
  modified_base (696)..(696): a, c, t, g, unknown or other
  misc_feature (696)..(696): n is a, c, g, or t
tcagtagtgtagatcacgaccggtgctcgatttagtctagcgactttgggttgggggaggcttggtacagcctggggggtccctgagactctcctgtgcagcctctggtttcattctttagcaactacgccatgagcgtgggtccgccaggctaccgaggggaacgggctggagtgggtctcgaggtattacgtggtagtaggtaactaccgnatactacgcagactccggtaggaccggggtccgtttaccaccggttctaccgaaggacgaactaactttaccgaaaaggtaacttaccgggtcttaagttaccgtaaggtaaaactcggaaactacgccgttaggaaggacgaccggaaggaccacccggcccctttagtaattttacgngggtcgacggagaggactacgaaggaacggtaagttagacgactagcaacgtcttacgagtacgtaccggtcggggaacctaccggtaaccgttggtaccctacgttccgtccctacgaccgtcccaccgaaccggaccggtacctacgttccggtccccttcccgtacgccctaccccgttcaccgaagtccgacctccggtggtacgggacctacggaccggcccggtccgacgggtcgtccgtaccgtaggtaccgaccggttacccttactacccgtattaccgtaccgtaacgttcgngggacccggtcggtaccgtacgggataacccggcgacgtagag

SEQ ID NO: 78756 - DNA, 726 bp, Homo sapiens
  misc_feature: GYAE6OF01BFGWO.37.26.C04.1.454.CMB.1.raw
  modified_base (262)..(262): a, c, t, g, unknown or other
  misc_feature (262)..(262): n is a, c, g, or t
  modified_base (719)..(719): a, c, t, g, unknown or other
  misc_feature (719)..(719): n is a, c, g, or t
tcagtagtgtagatcacgaccggtgctcgatttagtctagcgactttggggtttgggggaggcttggtacagcctgggggggtccctgagactctcctgtgcagcctctggtttcatctttagcaactacgccatgagcgtgggtccgccaggctccgaggggaaggggctgggagtgggtctcgaggtattacgtggtagtggtaaataccgcaatactacgcagactccggtggaccgggccgttcaccgtctaccaganacaattaccaagtaatacggtctaagtcgtaaggaaatacgaaacagccgtagaacggacggccggaaggaccgaccggtccctattaacttccgtggtcgacgaagagactacgaaggacgggtaagtaataggccaagcaacgtctacgtacgaccgtacggtcggggaaccccaacggtaccctggaccctaccgtcctaccgtacaccgtaccctaccgaacccggaaccggccctaccgtcccgggttccccttccccggtcgtaccctacccgtccctaaccgaagacccgtcctacccggtcggggtacgggaccaaccggtcggtacccgggtcccggtcgggtcctccggtccgttaaccggacgtaaaccgtcctttacccgtacctaccgtacgtaacctaccgtacgtacgggccgggtccggtcggaacggtacggaggaccgngagtacg

SEQ ID NO: 78757 - DNA, 926 bp, Homo sapiens
  misc_feature: GYAE6OF01BMCM3.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggcctaccgaggggaaggggctggaggtgggtctcgaggtattacgtgggtagtggtaaactaccgctatacgtacgcaagacctccggtggaccgggtccgttcaccatccgtaccaaggagaacctaaattacccaaagaaccctaccctgtaccttctagaccaaaagttacgaaaaccgaaccgtaggaacgaacggacccggaacgggtaacccgaacccggtacccctttaattaacgtttaaccgttacggttaaaaccggaaaaaggttcgggtaaccccgttaacgggtaattaacgttacgtaaacccgtttaacgttaggtttacggggtaaccgtttacggggtttaaccgtttacggtaactttcccgttccgggttacggggggtcccggttaccgggaccccgttaacccccggttacgggttacccgttaaccgtttccggttaccccttcccgttaaccgtaccccgtaccccgttacccccgtaaacccgggaaacccggggtaccccctttaacggttacccggtttccccccgtttaccccccggtcccggtaccccggtcccccgttacgtacccgttacccggaacggtacccgacccgtaaccccgtaccggacgaacgtacccgacggtaccgggccggtcccggtacgggttccgacggtcccgtacggttacgaaccggttacccttaccgttaccctacgttaccacccgttactaccggtcggacgggccggcgtacggaccgtacggg

SEQ ID NO: 78758 - DNA, 718 bp, Homo sapiens
  misc_feature: GYAE6OF01A2VZC.37.26.C04.1.454.CMB.1.raw
  modified_base (218)..(218): a, c, t, g, unknown or other
  misc_feature (218)..(218): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctggagtgggtctcaggtattacgtggtagtggtaataccgctatactacgnagactccgtgacgggtccgttcaccgtctccagagactaattccaagtaatacggtctatctgggaaaatcggaaacctaggcccttaggaagacggacccggtaaggaccaccgggtcccctacttaatttaccgtgtacggacgaagtagatccgaaggacggagtactacgcagcagtcctacgtcgaacttacggtgggggaccccgtaaccggtaaccccgttgggtacccacccggttctacccgtacaaccgcccgtaccgacccgtaaccgggtacccgtacgttcccggttccccgttcccccgtcggtaccctacccccgtacccgtaccgaacgtaccgtaccacccgttcggtacggggaccacgtacggacccggtcccgtacggggtcctaccggtccgtacggtacgtaacggtacccgttaccttaccgtactaccgtacgtacctacgtcggacggcggtacggtcgacgacgcgcgtagtag

SEQ ID NO: 78759 - DNA, 920 bp, Homo sapiens
  misc_feature: GYAE6OF01CEM1W.37.26.C04.1.454.CMB.1.raw
  modified_base (208)..(208): a, c, t, g, unknown or other
  misc_feature (208)..(208): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctcgaggggaagggctggagtgggtctcgaggtattacgtggtagtggtaataccgnatactacgcagactccggtaggaccgggtccgttacaccgtctaccgagacgaacctaattccgaaaagtaacgtacggtctaagttacgtaggaaaatcggaaacgacgtcccgtaggaggaaccggtccggaacggaaccgacccggtccccttattaacgtttactcggttacggccgtaaggtaacgtacgtacggaacgggtaacgggtaacgttataacggacgaaggtcctaagtcccgtagttacgtaaacccgttcggggtacgggggaacccctaacccggggtaaaccctcggggtaaacccctccccggttacttccccgtaccggaccgtaccccgtaacccgtaacccgggtaacccgggtcccctaaccggttccccggttacccccgtttacccccgccgggtaccccctttaacccccgtaccccgttaaacccgtaaaccggtaccggtaacccccgtcccgggttacggggtaacccggggtaccgaacccggggttccccgggcccggggttcccggtaccggggttcccgtacccggttaccgggttacccgggtaaccgtaacccgttacccgtttaaaccgttccccgttaacgttaacccggtaacctacccggttaacggccggggtaaccgggtcccgggtaccggttaacggggacccggtaccgggccgttaaacgtggtaacg

SEQ ID NO: 78760 - DNA, 563 bp, Homo sapiens
  misc_feature: GYAE6OF01EW16F.37.26.C04.1.454.CMB.1.raw
  modified_base (310)..(310): a, c, t, g, unknown or other
  misc_feature (310)..(310): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctcagagacaattccaagaatacggtctatctaggaaatgaacagcctgagagccgaggacacggccctntatactgtgcgagagatcagacgatatagcagcagctntgactacgnggggaccacggaacctggtaccaccgtctcctcacgccctccaccgaacggcctagtccggtccttcccctcggcctaccctcctaccaagacgccaccgtcgtcgggacacgacgccggcccgtgggctcgtccgtaggtacgaacggtactactaccactactacatacgtgacggcggcgtacggacgaaggcgactagtacg

SEQ ID NO: 78761 - DNA, 776 bp, Homo sapiens
  misc_feature: GYAE6OF01AQXDC.37.26.C04.1.454.CMB.1.raw
  modified_base (107)..(107): a, c, t, g, unknown or other
  misc_feature (107)..(107): n is a, c, g, or t
  modified_base (288)..(288): a, c, t, g, unknown or other
  misc_feature (288)..(288): n is a, c, g, or t
  modified_base (399)..(399): a, c, t, g, unknown or other
  misc_feature (399)..(399): n is a, c, g, or t
  modified_base (415)..(415): a, c, t, g, unknown or other
  misc_feature (415)..(415): n is a, c, g, or t
tcagtagtgtagatcacgaccggtgctcgatttagtctagcgactttgggtttggggggaggcttggtacagcctggggggtccctgagactctcctgtgcagcctntggtttcattctttagcaactacgccatgacgcgtgggtccgccaggctccgaggggaagggctggagtgggtctcgaggtattacgtggtagtggtaataccgcataacgtacgcacgacctccggtgaccgggccgttacaccgtctccgaagagactaacttccaaagtaatacggtntagtcgtaggaaaatcgaaacagccgtagaaggacgccggaaggaccgtacccggtccccttagttaactttaccgtggtacgtcggaagagactcgaaggacggtagtanacgcagcacgctacgngtacgtacgcggggtacccaacggtacccgtggtacccgaccgttcctccgacaccggtaccctaccgaaccggaacgggtcccctaaggttcccggttacccctttccccgggacggtacccctaaccccgttccgtaacctaacggaccgtacccgtaccggtccgggtacgggacctacggccgggtcccggtccggtacgggtacctcgggtacccgttagggtaacccgtaaacgttaccgttacccgttaccggtaaccttaaccgggttaacctaccggtttaacggcggggtaccgggtacccggggttccggttacgggaacccgggaaaggtcccgtaacgtaaagggtcg

SEQ ID NO: 78762 - DNA, 729 bp, Homo sapiens
  misc_feature: GYAE6OF01BGUFF.37.26.C04.1.454.CMB.1.raw
  modified_base (207)..(207): a, c, t, g, unknown or other
  misc_feature (207)..(207): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattacgtggtagtggtaataccgnatacacgcagactccggtggaccgggtccgttcaccgtctccagagacaattccaaanagtacggtntatcgtaggaaatgaacgagtcctgagagccgaggacaccggccccttatattacgtgtcgcgaagagatacgaggacggtaagttacgagaccgagactacgtcttcgtacgtaaccgtaccggtcgggggacccctaaacgggtaacccccggtgggtacccctaccgttcccgtacctccggaccgccccgttaccccgaacccggaaaccgggacccctacggttacccggttcccccgtttcccccgacccgggtaccctaccccccgttacccgtacccgaaacggaccgtacccgtacccggttccgggtaccggggccaaccggcggcccggtcccggtcgggtcctacggtcccgtaggtaccgaacggtaccttaccgttaccgtacctacgtacctactcggtcggacgggcggtaccggcggtacgaccggcgtacggagtcg

SEQ ID NO: 78763 - DNA, 834 bp, Homo sapiens
  misc_feature: GYAE6OF01BNH02.37.26.C04.1.454.CMB.1.raw
  modified_base (207)..(207): a, c, t, g, unknown or other
  misc_feature (207)..(207): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaagggctggagtgggtctcgaggtattactggtagtggtaataccgnatactacgcagactccggtgacgggccgttcaccgtctccagagacaattccaagaatacggtctatctaggaaatgaacagccgtagaagagccggaaggaccaccggtccccttactatttaccgtggtaggaccgaggacgacgtccgaaggacgggtaagtaacgtacggcaggaccgtacgtctacgtagtaccgtaccggtacgggggaccccaacccgggtaaccccgtcgggtaccccgtaacccgttccctacccgtcccgaacggtacccccgttaccccgaacccggtaacccgggtacccccgtaccggttccccggtttacccccgtttacccccccgttccggtacccctaccccccgttaccccgtacccgaaaccggcccgtacccgtaccccgttaccgggtaccgggggtaccaccggtaaccggccccgggtaccccggtccgggtacccggttccggtccccgggttacggtaacccggtaaaccggttaaccgttacccgttacccgttaacccgttaccgtaacccgttaaacccgttaaccggtcggggaaccgggtcccggggaccggtaccgggaccggaaccgggtccgtacgtagtacgg

SEQ ID NO: 78764 - DNA, 778 bp, Homo sapiens
  misc_feature: GYAE6OF01CIIEV.37.26.C04.1.454.CMB.1.raw
  modified_base (328)..(328): a, c, t, g, unknown or other
  misc_feature (328)..(328): n is a, c, g, or t
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
tcagtagtgtagatcacgaccggtgctcgatttagtctagcgactttgggtttgggggaggcttggtacagccgtgggggggtccctgagactctcctgtgcagcctctggtttcattctttagcaactacgccatgagcgtgggtccgccgaggcctcggaagggggaaggggtctagggaggttgggtctacgaggttattacgtgggtagtagggtaaactccgactaatacgtacgcagactccggtggaccggggtccgttcaccgttcacgagaagtaacaacttccaaagtaactacggtctatcgtaggaaactgaaccncggtctacggagacggccggaaggaccncccggtcctacttatacgnggacggagagagtactggaagggacggtatacgtacgacgacgtcgactcgtacgtagtaaccgacggtcgggaaccgacccgtacgtcgtacctccgtacctcctacgtaaccgcccgtacccgaaccggtaaccggcccgtaccggttcccgtttccccgttccccggttccgaaccctcccccttacccgaccgaacgtaccgtacccgtacccgggtaccgggtcggggaacccgtccggtaccgggccccgggtccccggttccggggtacccgccgggtaccgttacgggtaaccgtacccggtaccttacccgttaccgtacttaacccgtacgtacggttaccgtagggtaccgggtacgggtccgggtacgggtaccggacggtcgagtcgacg

SEQ ID NO: 78765 - DNA, 712 bp, Homo sapiens
  misc_feature: GYAE6OF01DH7WG.37.26.C04.1.454.CMB.1.raw
  modified_base (86)..(86): a, c, t, g, unknown or other
  misc_feature (86)..(86): n is a, c, g, or t
  modified_base (324)..(324): a, c, t, g, unknown or other
  misc_feature (324)..(324): n is a, c, g, or t
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
  modified_base (502)..(502): a, c, t, g, unknown or other
  misc_feature (502)..(502): n is a, c, g, or t
tcagtagtgtagatcacgaccggtgctcgatttagtctagcgactttggggtttgggggaggcttggtacagcctggggggtcccngagactctcctgtgcagcctcgtcggtttcatctttagcaactaccgccatgagcgtcgggtccgccaggcctccgaggggaaggggtctggagtgggtctcgaggttattacgtggtagtggtaactaccgctatacgtacgcaggacctccggtggaccgggtccggttccacccgtctccagacgaaccaacgttaccaaaggtaactaccggtctaatcgtaggaaatcgaacngtccgtagagacgacgaggacaccggtccctatagttacgngtgcgaagagntacgagaacggtatcagcagcagctgtacgacgtcggcgggacccaaccggtaccgtcggcctacccgtctcctcaccgtccctaccgaaccgaccggccctacggttccccgtcccttaccccgngtacccctacccgtcccgtacgaaccggtaccgaccctaccggttacgggtcgggaccaaccggtccggtcccgggtcccgtagggtaccgttccggcccgttaacgggtaccgtaacggttacccttacccgtaccgtacgtaaccgttaaccgtaacgttacggacggacgggtccgggtacgtcgggaacgtacgacgtacgtagtc

SEQ ID NO: 78766 - DNA, 700 bp, Homo sapiens
  misc_feature: GYAE6OF01DGR13.37.26.C04.1.454.CMB.1.raw
  modified_base (106)..(106): a, c, t, g, unknown or other
  misc_feature (106)..(106): n is a, c, g, or t
  modified_base (359)..(359): a, c, t, g, unknown or other
  misc_feature (359)..(359): n is a, c, g, or t
  modified_base (451)..(451): a, c, t, g, unknown or other
  misc_feature (451)..(451): n is a, c, g, or t
  modified_base (694)..(694): a, c, t, g, unknown or other
  misc_feature (694)..(694): n is a, c, g, or t
tcagtagtgtagatcacgaccggtgctcgatttagtctagcgactttgggtttgggggaggcttggtacagcctggggggtccctgagactctcctgtgcagcctntggtttcatctttagcaactacgccatgagcgtgggtccgccaggcctccgaggggaacgggctggagtgggtctcgaggttattacgtggtagtggtaaatccgcatacctacgcaggacctccggtgaccggggtccgttcaccgtctaccgagagtaccaattcccaaagaattacggtctatcgtaggaaatcggaacagccgtaggacgcggacccgaaggtaccgaccggtcctacttaagttaccnggtcgacaggatatccgaaggtacggtatagtcacgacgcacgtccttcgagtaccgacggtcggggaaccccaacggaccgttggtacccnccggttcacccttaccgacgtaccctaaccgaacccggtaacggcccctaacggttcccggttaccccctttccccggacggtacccctacccgtcctaaccgaacggaccacccgtaaccgtcggtacgggaccacggccggccggtccgtcgggtctcgtacgtcggacacggtacctcctaccgtactaccgtacgtacctacgtcggaggtccggaccgttacggacggtaccgcggtnaagtcg

SEQ ID NO: 78767 - DNA, 748 bp, Homo sapiens
  misc_feature: GYAE6OF01CO1LP.37.26.C04.1.454.CMB.1.raw
  modified_base (242)..(242): a, c, t, g, unknown or other
  misc_feature (242)..(242): n is a, c, g, or t
  modified_base (381)..(381): a, c, t, g, unknown or other
  misc_feature (381)..(381): n is a, c, g, or t
  modified_base (745)..(745): a, c, t, g, unknown or other
  misc_feature (745)..(745): n is a, c, g, or t
tcagtagtgtagatcacgaccggtgctcgatttagtctagcgactttgggtttgggggaggcttggtacagccgtggggggtccctgagactctcctgtgcagcctctggtttcatctttagcaactacgccatgagcgtgggtccgccgaggctccgaggggaagggctgggagtgggtctacgaggttattacgtggtagtaggtaaactccgactatacgtacgcacgtaccgtccggnggaccggggtccgttacaccgttcaccgaagacgaactaacttccgaaaagtacgtacggtatatcgtaaggaaatgaaccgaggccgtaggaacggaccggtcggaaggacccgccggtccctttattaacgtttcgnggtacgacggtaagagactagagggtaacggtaatacagacgacgagttaccgcttacggacgttaacgccgggtaccgggacccaaaccggttcccgtggttacccccaacggtttccctcgtacaacccgtcccgaccgtaaccggaccgtacccgtacgttccccgttccctacccgcgacccctaccgtaccctacgacgtcccgtaccgtacggttaccgggacggacctaacgggcccggtacccgggtccgtccgggtcgaccggttcggtaacgtaccgtaacggttccctaacgtccgtatacccgtaacgcgttacggacgggcggtccggtaggaccgacggacgcgtaagtncgg

SEQ ID NO: 78768 - DNA, 859 bp, Homo sapiens
  misc_feature: GYAE6OF01EQRUD.37.26.C04.1.454.CMB.1.raw
  modified_base (231)..(231): a, c, t, g, unknown or other
  misc_feature (231)..(231): n is a, c, g, or t
  modified_base (378)..(378): a, c, t, g, unknown or other
  misc_feature (378)..(378): n is a, c, g, or t
tcagtagtgtagatcacgaccggtgctcgatttagtctagcgacttttggggtttgggggaggcttggtacagccgtggggggtccctgagactctcctgtgcagcctctggtttcattctttagacaactacgccatgagcgtcgggtccgcaggcgtccgaggggaagggctggaggtcggtctcgaggttattacgtggttagtaggtaactacgatactaacgacgnacgacctccggtcggtacgggtccggttacctaccgtctccagacgaactaacttaccgaaagtactacggtctatactaaggaatacgaacgcgtccgtagacggacgacggaacggacctaccccggtaccttagttacttacgngtaccgagaaggtacgaacgtcgtaaaggtaccggtaatagtacggtacaacggtacgtatacccgtaacggtacgtaccgggttaaacccggggtacgggaaaccccgtaccgggttaaaccccgtggtaaccccggttacctcccggtaacctaccgacccgtttaaccccgtaccgaaacccggtaacccgggtacccctacgggttaccccgttaccccgttacccgtacccggtaccctacccccgttaccgacctaaacgggtccctaccggtaccgtccggggaacgggtccgaaccgtaccgggacccggttccggtacgggtacccggttaccggtacgggttaccgtaaaccgggttaacccgtaacgttaacccttaaaccgtaccgttaacgttacccgttaaaccggtcggaaacggtacggttacccgggtacgtaacgggacggtaaggtcccgaagttaacgagg

SEQ ID NO: 78769 - DNA, 619 bp, Homo sapiens
  misc_feature: GYAE6OF01BSU7F.37.26.C04.1.454.CMB.1.raw
  modified_base (418)..(418): a, c, t, g, unknown or other
  misc_feature (418)..(418): n is a, c, g, or t
  modified_base (486)..(486): a, c, t, g, unknown or other
  misc_feature (486)..(486): n is a, c, g, or t
  modified_base (611)..(611): a, c, t, g, unknown or other
  misc_feature (611)..(611): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtggacgggtccgttcaccgtctccagagacaattccaagaagtacggtctatcgtaggaaatgaaacagcctagagacgccggaaggaccaccggcccctcttaactttacgtgtgacgagagatcgaggacggtagtatagcagtcagtctctagacgtacgtcgggaccacggtacctggtccaccgtctccncgacgccctaccgaccgacggcctacgttccgttcccttccccgtcgccctacccctcctacacgacncctaccgtcggcgggacacgcgccggccgtggccgtcgtccgtacggtacgaacggtacctaccttaccacttaccgtacctaccgttacgcggaaccggtcggtacgtacggacggaacggcgngtacgtcg

SEQ ID NO: 78770 - DNA, 736 bp, Homo sapiens
  misc_feature: GYAE6OF01E5SV0.37.26.C04.1.454.CMB.1.raw
tcagtagtgtagatcacgaccggtgctcgatttagtctagcgactttgggtttgggggaggcttggtacagcctgggggggtccctgagactctcctgtgcagcctctggattaatgtttagcaactctggcatgaactgggtccgccaggctccgggcagtggggctgcagtgggtctcaagtactagtgctcctggtaatagagcagactacgcagactccggtgaacggggccgttcaccatctccagagacaattccaagaatacggtctatcgtaggaaatgaacaggcctggacgacgccggaaggaccaccggtccctactagttactggtgacgtagagactacgaggaacggtagtaatacgcgacgcaacggtctcgtacgactacggtcggggacccaacggtaacccctgggtacctacccgttcctcccgtcgaccgacccctacccgaacccgaaccgggcccctaacgttccccgggttccccgtttacccccggtacccggtacccctaacccccgttaccccgtaacccgtaaaccggaccgacccgtaccccggttaccgggtccggggggaacccaaccggtaccgggaccccggtcccgggtcgggtcccgtccgtccggttacggtaaccggaaccggttaccttacccgttaccctacgttacctaaacccgtaccgttaccggtacgtaccgggtccgggtcgcgggtaacgg

SEQ ID NO: 78771 - DNA, 606 bp, Homo sapiens
  misc_feature: GYAE6OF01ECR3A.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgacgagagatcgagacggagtatagcagcagctcgtgactacgtggggccaacggaaccctggtaccaccggttctcctcagccctaccgaccgaacgggcccacgttccggtccttcccccgtcggccaccccgttccctaccgaacgacgtaccacccgtacgtcggggccacgacggccggcccgtcgggaccgtcggccgtacggtcaacgggtaccttacttacccgtacttccgtactactacgtcgacggcgggcgtcgggacgaacggtcgcgagtag

SEQ ID NO: 78772 - DNA, 764 bp, Homo sapiens
  misc_feature: GYAE6OF01BOURO.37.26.C04.1.454.CMB.1.raw
  modified_base (213)..(213): a, c, t, g, unknown or other
  misc_feature (213)..(213): n is a, c, g, or t
  modified_base (294)..(294): a, c, t, g, unknown or other
  misc_feature (294)..(294): n is a, c, g, or t
  modified_base (598)..(598): a, c, t, g, unknown or other
  misc_feature (598)..(598): n is a, c, g, or t
tcagtagtgtagatcacgaccggtgctcgatttagtctagcgactttgggtttgggggaggcttggtacagccgtggggggtccctgagactctcctgtgcagcctctggtttcatcttagcaactacgccatgagcgtgggtccgccaggcctccgaggggaagggctggagtgggtctcgaaggtattacgtgggtagtggtaactaccgnaatactacggcaaggacctccggtaggaccgggtccgttcaaccagttcctacgagacgacctaaattcccgaagaaaccncccttagtcctctacgacaaaagtcgaaacctaaccgtagaagaccggaccggacggtaaccgaccggtacccttaataactttagtacgttaaacgaaaagtccggtaccgtaacggattaatacgtaaccgtattagttcggtaacgttcggttaacgttacgtacttcgtcggtccggggcggttacgggccctaccgtggtacctatacgtcctcctacgaccgtcctacccgaccgaacgggtccctacggtccgtcccgttccccgtggccccgtccctaggtcccacggaccggacncccgtaccgccggtaacgacgaccgaacggccggacccgggtcccgtgggccgtacccggtacgtaccgggtacctaaacgggtcccttaaccctaccgtaaccgttcccgtaaccgtaaacccgttcgttaacggcgggttaccgggcgaacggacggtaaccgg

SEQ ID NO: 78773 - DNA, 655 bp, Homo sapiens
  misc_feature: GYAE6OF01BU64X.37.26.C04.1.454.CMB.1.raw
  modified_base (281)..(281): a, c, t, g, unknown or other
  misc_feature (281)..(281): n is a, c, g, or t
  modified_base (531)..(531): a, c, t, g, unknown or other
  misc_feature (531)..(531): n is a, c, g, or t
tcagtagtgtagatcacgaccggtgctcgatttagtctagcgactttgggtttgggggaggcttggtacagcctggggggtccctgagactctcctgtgcagcctctggttcatcttagcaactacgccatgagcgtgggtccgccgaggctccgagggaagggctggagtgggtctcgaggtattacgtggtagtggtaactccgcatactacgcagacctcggtgacggtccgtcaccgtctcagagactactcaagatcgctagctaggaaatgaacngtcctaggagacgccggaaggaccgaccggtcccttattaacgttcgtgtaggaccgagagactcggagacggtatagtgcgagcagctgagtacgtaggcgggccaaccggtaccgttcggtacccaccgtccctacgtccgacgtaccctaccgaccgaaccggacctaccgtccgttccccgttaccccgtcggtaccctaccccgtccctaccgacgtaaccgccgtaccgtacggtcggggaccncggaccggtcccggtaccgtcggtccgtccgtcgtcggtaccgtacgtaccgttaccgtacctaccttccgactaacctcggtacggccggtgggaccggtggaaccggaggcgtagagtacgg

SEQ ID NO: 78774 - DNA, 706 bp, Homo sapiens
  misc_feature: GYAE6OF01DDJM3.37.26.C04.1.454.CMB.1.raw
  modified_base (207)..(207): a, c, t, g, unknown or other
  misc_feature (207)..(207): n is a, c, g, or t
tcagtagtgtagatcacgaccggtgctcgatttagtctagcgactttgggtttgggggaggcttggtacagcctgggggtccctgagactctcctgtgcagcctctggtttcatctttagcaactacgccatgagctgggtccgccaggcctcgagggaagggctggagtgggtctacaggttattacgtggtagtggtaataccgnatactacgcagactccgtgacgggccgttcaccgtctcagagacagttccaagacacactcgtatctgacaatgaacagcctgaagacctggagacgacggcgtgtgtatcacgtgtacggacgaacgtaaggggtttgacgtatgcgagtcgtgggtaggtagtagttaggtttgtaagtttggcgggtaccgtaaagggactaaacgtcggtacacccgttcgtccttacacgtaccctaccaccgtaacgggtccctacgtccggttcccttcccccgtacgtcccgtacccctcccgtaaccgtaacggaccgtaccgtaccgttccggacggggtccaaccgttcgggacccggcccggttcgggtaccgttccggtacccggttacggtaccgtaaaccggttacccgttaaccgttaccgtaccgtttacccgaaccctaaccgttaccgttacgggacgggtacccgggtccgttacggccggtaaccggg

SEQ ID NO: 78775 - DNA, 720 bp, Homo sapiens
  misc_feature: GYAE6OF01DKGU2.37.26.C04.1.454.CMB.1.raw
  modified_base (212)..(212): a, c, t, g, unknown or other
  misc_feature (212)..(212): n is a, c, g, or t
  modified_base (254)..(254): a, c, t, g, unknown or other
  misc_feature (254)..(254): n is a, c, g, or t
  modified_base (351)..(351): a, c, t, g, unknown or other
  misc_feature (351)..(351): n is a, c, g, or t
  modified_base (443)..(443): a, c, t, g, unknown or other
  misc_feature (443)..(443): n is a, c, g, or t
  modified_base (712)..(712): a, c, t, g, unknown or other
  misc_feature (712)..(712): n is a, c, g, or t
tcagtagtgtagatcacgaccggtgctcgatttagtctagcgactttgggtttgggggaggcttggtacagccgtggggggtccctgagactctcctgtgcagcctctggtttcattctttagcaactacgccatgagctgggtccgccagactccgaaggggaaggggctggagtgggtctgaaggttattacgtggtagtgtaactccgnatactacgcagacctcggtgaccgggtccgttcacccgttcnccgaagacgactaacttaccaagtacgtacgtatatcgtaggaaagtcgaacgtagccgtaggacgacgccgagaccaccggtccttatatttacgnggtcgacgagagtacgacagggtaacgagttagagacgagcgtacgtctcgagtaccgtaggtacgggacctaaccggacccgtggtacccncggttcctaccgtaccgcgtacccctaccgaaccgaccgggtacccctacggttcccgttaccccgttccccgtacggtacccctacccgtaccctaacccgaacgtaccgacccgtccgtacgggtcgggaccgtacgaccgggttcccggaccggtcggtaccgtcccggtaccggttacgggtaacccgaacgttacccgttaccctaccgtaccgacttaccgacgttaacggcggtacggccgggtacgtcggtacggacgcgngtacgtcg

SEQ ID NO: 78776 - DNA, 961 bp, Homo sapiens
  misc_feature: GYAE6OF01DUEWJ.37.26.C04.1.454.CMB.1.raw
  modified_base (147)..(147): a, c, t, g, unknown or other
  misc_feature (147)..(147): n is a, c, g, or t
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
  modified_base (954)..(954): a, c, t, g, unknown or other
  misc_feature (954)..(954): n is a, c, g, or t
tcagtagtgtagatcacgaccggtgctcgatttagtctagcgactttgggtttgggggaggcttggtacagccgtggggggtccctgagactctcctgtgcagcctctggtttcattctttagcaactacgcatgagcgtgggtccncgaggctcgaaggggaggggctggagtggtctacgaggttattacgtggtagtaggtaaactaccgntattaccacgnaacgtaccgtccggtggaccgggtccgttacaccgtctaccgaaggacaacctaaagttaccgaaagtaacttccgggtctaacgttacgtaaagggtaaaacttacggaaaaccgacggtaccgttaaggaacggaccggtacccggtaaaggggacccgtaaccccgggtaccccctttagtttaaaggtttaccgtggttacggaccggaaaaggtaccggtaactaaccggaagggaaaccgggtaaagtttaacgaacggacgtaacggctaacggtccttagttaccgtaaaccgggttacggggtacccgggggaaacccctaaacccggggttaacccgttcggggttaaccccctttaaccccgggttccttaaacccctttcggaaaccccgttccccgttaaccccgaaaccccggggtaaccgggtacccccgtttaaccgggttcccccggttttaacccccccgtttacccccggacccggttaacccccttaccccctacccgtaaccggtaaacgtacccggtaaccccgtacccgggttccggggaacgggacccggaaaccgttcccgggggaccccgtcccggtacggggttccgttaacggtcccggttaacggtaccgttaaaccggtacctttacccgtaccgtaagttacccctaaacgtaccggtaactcgggaaccggtcggtaaccgtcgaacggtaccggcngtgtacg

SEQ ID NO: 78777 - DNA, 801 bp, Homo sapiens
  misc_feature: GYAE6OF01DW54A.37.26.C04.1.454.CMB.1.raw
  modified_base (210)..(210): a, c, t, g, unknown or other
  misc_feature (210)..(210): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgcatgagctgggtccgccaggctccgaagggaaggggctggagtgggtctcaggttattacgtggtagtggtaaactaccgntaatacctacgctagactccggtgaccgggtccgttacaccggtctccaagagaacctaattccgaaaaggtaataccggttctaagtcgtaggaaattggaaaccagcctagacgacggaccgagacgaccggccctttatacgttactggtcgcgacgagatacgagacggtagtatagacagcaggtctacgcgactacggcggggaccaaccggaccctgggtaccaccggtctaccctacgacgtcccgtaccaaccggaacggtacccgtacgttccccggttacccgttcccccggttaccggaccccgtaccccgttaccccgttaacccggaaacggaccggtacccgtaacccgttcgggttaccggggggaccctaaccgggtaaccgggtccccgggttaccccggttccgggtacccggttaccggtacccggttaaccgggtaaccgttaacgggtaacccgttaacccgtttcccggtaaacctttaccggtaaaccctaaacgttaccggtacgggtacgggtccggggtacccggttaacgggaccgtaaccgggaccgtaacgtacggtaacg

SEQ ID NO: 78778 - DNA, 782 bp, Homo sapiens
  misc_feature: GYAE6OF01A8X3M.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccggtgaccgggtccgttcaccgtctccagagacaattccaaagaagtacggtctatctaggaaatcgaacacgtcctagaagacgccggaaggaccaccggccctatattactgtgcgagagatacgagacggtatagtagcaaggcagtctcgtacgtaaccgtacggtcgggggaccctaaacccgggtaacccgtcgggtacccctacccggttccttaccccgtacgtaccgtccccttaacccgaacccggaaacccggggtcccctaacggttccccgggttaccccctttcccccggtacggtaccccctaacccccgttcccgtaacccgtaaacggccgtaccccgtacccggttcggggtaccgggggtacccaaccggtaccggggtccccgggtcccggtacggggtcccgttaccgggttccccggttacgggtaaccggtaaaccgggttacccgtttaacccgttaccaacgttaccccgtaacgttacccgtacggtcgggacgggtcccgggtcgtacgggacggaacgggtccgacgtagtcg

SEQ ID NO: 78779 - DNA, 720 bp, Homo sapiens
  misc_feature: GYAE6OF01BCNWZ.37.26.C04.1.454.CMB.1.raw
tcagtagtgtagatcacgaccggtgctcgatttagtctagcgactttgggtttgggggaggcttgggtacagccgtggggggtccctggagactctccgtgtgcagcctctggtttcatcttagctaactcgccatgagcgtcggtccgccaggcgtccgaggggaacgggctggagtcgggtctcaggtattacgtggtacgtgtaactcccgctacgtaccgtacgacgacggtacctccggacgaccgggtcccgtttaccacccgttcaccgagacgaaacctaacttaccgaaagtaacgttccggtactaatacgtaaggaaatacgaacctcgaccgtaggaacgacgtaccggaaggacccgacccggtaccctacgtattacgtggtacgacgtaggaagtctacggaacggtacggtaagttacgtacggacgtacgactacgtctacgtacggtaaccgtacggtccggaacccgtaacgtacccgtgacccctaccgtctacccgtcaccgtcccaccgaccgacgtcctaccgtccgttcccgtacccgtcgactcccgaccttaccgaactacgctaccgtccgtcggaccgcaacggtcggtacccgtcggtacccgctacgggccgtacggacgtaaccgtcgttacctagtaccgtccgtacactacggcgtcggtaaccggcaccggagaccgcgtatacgg

SEQ ID NO: 78780 - DNA, 807 bp, Homo sapiens
  misc_feature: GYAE6OF01AJ81C.37.26.C04.1.454.CMB.1.raw
  modified_base (145)..(145): a, c, t, g, unknown or other
  misc_feature (145)..(145): n is a, c, g, or t
  modified_base (189)..(189): a, c, t, g, unknown or other
  misc_feature (189)..(189): n is a, c, g, or t
  modified_base (797)..(797): a, c, t, g, unknown or other
  misc_feature (797)..(797): n is a, c, g, or t
tcagtagtgtagatcacgaccggtgctcgatttagtctagcgactttgggtttgggggaggcttggtacagccgtggggggtccctgagactctcctgtgcagcctctggttcatctttagcaactacgccatgagctgggtccncaggctccgaggggaagggctggagtgggtctcaggtattacgnggtagtggtaatccgcatactacgcaagcctccggtgaccgggtccgttccaaccgtcctccagacgactaacttaccgaagtaacgttacggtctaattcgtaagggaaattacgaactactccgtaggagacgtaccgaaggacggaccggtaaccccggtccccttacgttaacgtttccgtggtacggtaaccggtagacgtaacgtaccggtaaacggaccggttaacggtacgtacgactacggacgtacgcctagttacgtacgttaccgggtccggggaccaacccgggtacccgttacggtcccgtaaccccggtccttacccgccgtaaccggtcccctaccccggtaaaccgggaccgtaccccgggttcccgttaccccgggtttcccccgttccccgtaccgggacccccttaaccccgtaccccggtaacccgtaacggaccgtcccggtccccggttaaccgggtccgggaccgtacggaacccgggtcgggtacccggtcgggactcgggtacctacggtacgaccggtaccttcctaccggtactaccgtaccgtactacggtccgggaacggtcgtacggtccgaacggngaccctggtc

SEQ ID NO: 78781 - DNA, 705 bp, Homo sapiens
  misc_feature: GYAE6OF01EE2XT.37.26.C04.1.454.CMB.1.raw
  modified_base (325)..(325): a, c, t, g, unknown or other
  misc_feature (325)..(325): n is a, c, g, or t
  modified_base (348)..(348): a, c, t, g, unknown or other
  misc_feature (348)..(348): n is a, c, g, or t
  modified_base (699)..(699): a, c, t, g, unknown or other
  misc_feature (699)..(699): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgcaggctccagggaaggggctggagtgggtctcaggtattactggtagtggtaactaccgcatactacgcagactccgtgacgggccgttcaccgtcacagagactaattccaagaatacggtctatctaggaaatgaacagcctgaagacgcgaaggaccgaccggtccttatattacgngtgcgagagatcgagacgagtanagcagcagctcgtagacctacggtggggacccaaccgggtaacccctgggtacccaccgttccttacccacgacgtaccctacccgaaccgaaccgggccctacggttacccggtcccctttccccgcggacccaccccgtccctaccgaacgacgaccacccgttacggtccgggggacctaccgaccgggcccgggtacccgttccggggccgttccggtcccggttacggttacccgtaaacgggtaaccctttaacccgtttaccctaccgttacccgtaaaccttaccgttaccgtacgggaacgggtcccggggtaccttcggggaaccctaacgggccgtacgngtaacg

SEQ ID NO: 78782 - DNA, 675 bp, Homo sapiens
  misc_feature: GYAE6OF01AQXP2.37.26.C04.1.454.CMB.1.raw
  modified_base (279)..(279): a, c, t, g, unknown or other
  misc_feature (279)..(279): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (368)..(368): a, c, t, g, unknown or other
  misc_feature (368)..(368): n is a, c, g, or t
  modified_base (429)..(429): a, c, t, g, unknown or other
  misc_feature (429)..(429): n is a, c, g, or t
  modified_base (646)..(646): a, c, t, g, unknown or other
  misc_feature (646)..(646): n is a, c, g, or t
  modified_base (669)..(669): a, c, t, g, unknown or other
  misc_feature (669)..(669): n is a, c, g, or t
tcagtagtgtagatcacgaccggtgctcgatttagtctagcgactttgggtttgggggaggcttggtacagccgtggggggtccctgagactctcctgtgcagcctctggtttcatctttagcaactacgccatgagcgtgggtccgccgaggctccgaggggaggggctggaggtgggtctcgaggtattacgtggtagtggtaataccgcatactacgcagactccgtggaccgggccgttcaccgtctaccagagactaataccaagtaatcggtntatacgtagaatagaacagccgtgagacgacggagaccgacgtccctatacgttancgtagngagagatcgagaacgngtanaganagncgtctgacgtacctccggtaggggaccctaacggaaccctcgtccgtaccgtcctacccgngaaccgtccctacccgaacccgaaaccggtccccgtacgtcccggttccccttccccgtccggcccctacccccgtcccgtacccaacgaccgcccgaccgttccgggacggcgaaccggcgccccgggtcgtaccggtcgtaccggttccgtacggtacgaaccggtaccttaccggtactaccgtaccgtacctacgtaccggtcggtaccgggnggtccggtacggcgaaccggcgngtcgag

SEQ ID NO: 78783 - DNA, 955 bp, Homo sapiens
  misc_feature: GYAE6OF01AXW0S.37.26.C04.1.454.CMB.1.raw
tcagtagtgtagatcacgaccggtgctcgatttagtctagcgactttgggtttggggaggcttggtacagcctgggggtccctgagactctcctgtgcagcctcttggttcatctttagcaactacgccatgagcgtcgggtccgaccaggcctccgaaggggaaggggcctggacggtgggtactcgaggtatttacgtgggttagtcggtaaatcccgctagttactacgcaagtacctccggtggaccggggtccgtttaccgaccgttctacgaacgagaacctaacttaccaaaaggtaacgtttacggtcctaagttacgtaagggtaaaactacgaaacctacgaccgttaaggaaccggtaacggaccccggaaagggtaaccccgtaaccgggtaccccttaaattaacgtttaccgttaaggtaaaaccgtaaaaaggtccgggtaaccccttaaggtaacgttaacgtacggtaaaccctttaacgttaaggtttacggggaacgttacggtttaaccggttctaacgttaccgtttcgggtcgggggtaccgtttaccgggacccgttaacccggttggggtaacccttccggtttaacgttcccgtttaccccttaaccgaccggtacccccgtaacccgaacccggtaaccgggtacccccgttaacggtttccccgtttccccggtttaccccgggtccgtccccggtaccccgttcgtacccggtaccgtaccggacgtacccgacccgttacccggaaggtacccgaccgtaaccggaccggtacccggtaccccggtgggtacccgtccgtaccgggttacgtaacccggaacgttaaacccgtttccccgtacgttaaccgttccccgttaaaaccctaccggtttacgacccgggaccggtaccgggttaccggtcgaaccggttacggaaccgg

SEQ ID NO: 78784 - DNA, 792 bp, Homo sapiens
  misc_feature: GYAE6OF01CMHKT.37.26.C04.1.454.CMB.1.raw
  modified_base (339)..(339): a, c, t, g, unknown or other
  misc_feature (339)..(339): n is a, c, g, or t
  modified_base (390)..(390): a, c, t, g, unknown or other
  misc_feature (390)..(390): n is a, c, g, or t
  modified_base (783)..(783): a, c, t, g, unknown or other
  misc_feature (783)..(783): n is a, c, g, or t
  modified_base (791)..(791): a, c, t, g, unknown or other
  misc_feature (791)..(791): n is a, c, g, or t
tcagtagtgtagatcacgaccggtgctcgatttagtctagcgactttggggtttggggggaggcttgggtacagcctgggggggtccctgagactctcctgtgcagcctctggtttcatctttagcaactacgccatgacgcgtcgggccgccaggcctaccggaggggaaggggtctagggaggtggggtcctacgtaggttattacgtgggtaggtaggtaaactaccggctactacgtacgcgaggacctccggtgggaccgggtcccggttacaccggttctaccgaagacaactacttaccaaagactacggtctatcgtaaggaaatcgaacnggccgtaggaacggcgcccggaaggacccgtccggacctttacgtattcgngggtcgacgaagagaaccgtacggaacgagggttaacgtagtacgcgaacgcctaagtcttacggtacgtacgttaccggggccggaaccccgaaaccggttaccggtaggcccctaccggtccctacccgtcgaccgtaccctaccgacggaccgtccgtacgttcccgtaccctcccgtcgacccctccgtcctaccggaactcgtacccgaccggtcgggacgacccgacggtcccggacccgggtccgtacgggtccgcgggttaccgtacgggaaccgttaccggtaaccctttacccggtaccttaaccgtacccgttaacggacccggtttacggaaccggggttacgggcgggtcgggttaaccgggaccgttaaccggacccgngggtaacng

SEQ ID NO: 78785 - DNA, 878 bp, Homo sapiens
  misc_feature: GYAE6OF01B3W6L.37.26.C04.1.454.CMB.1.raw
  modified_base (177)..(177): a, c, t, g, unknown or other
  misc_feature (177)..(177): n is a, c, g, or t
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (369)..(369): a, c, t, g, unknown or other
  misc_feature (369)..(369): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctgggagtgggtcncgaggtattaaatgggaatggtgataccanatactacgcagactccgtgaacgggccgttcacatcnccgaggacaattccaagacacactgtactcgtgactaaaagtcgaaacagcctgagacgtcggaggacaccggtccttaattagttactgtggtacgaacgggtacctcgttaacgcccctttanacgcgtacggccggtacgtcggttccgttagggtacctttggacccgacgggttcggggacccgtaaacggggaaccctcggtacccgtacccggttaccttccccgttacgaaccggtccccctacccgtaaacccggaacgggtccccctaacggttcccggttaccccctttcccccgggtcgggtccccgtaaccccggttcgtaccccgttacccggaaggggtaccctaaccccggacccgtttaaccgggaccggtaaaccggccccggtaaccggtaacccggggtccccgggtcccccggtaacgggggtcccgtttcccgggtacccgggtttaacccgggtaacccgggttaaaccgggttaacccttttaaccccccggtttaacccgtaaacgtttttaacccccccgaaacggttttaaaccccgttaaacccggggttcccggggaaaccgggttcccccggggttaccggtaacggggttaaaacccccgggg

SEQ ID NO: 78786 - DNA, 631 bp, Homo sapiens
  misc_feature: GYAE6OF01B4L6B.37.26.C04.1.454.CMB.1.raw
  modified_base (220)..(220): a, c, t, g, unknown or other
  misc_feature (220)..(220): n is a, c, g, or t
  modified_base (259)..(259): a, c, t, g, unknown or other
  misc_feature (259)..(259): n is a, c, g, or t
  modified_base (340)..(340): a, c, t, g, unknown or other
  misc_feature (340)..(340): n is a, c, g, or t
  modified_base (529)..(529): a, c, t, g, unknown or other
  misc_feature (529)..(529): n is a, c, g, or t
  modified_base (623)..(623): a, c, t, g, unknown or other
  misc_feature (623)..(623): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatggagcgtgggtccgccgaggctccgaggggaaggggctgggagtgggtctcgaggttatttacgtgggttagtaggtaactaccgnatactacgcagactccggtgacgggtccgttcaccgtcncagagacaatcaagagtacgtctatcgtaaggaaatgaacagcctaggagcgaccgaggaccaccggccctagtattacgngtcggacgagacgactacgaggacggtagtagagctaagcagtctcgagaccgtaggtcgggacccaaggtaccctgacctccggtctccgacacgccctaccgacccgaacggtcccgtacgttcccgttccccgtccccgtcggcccctaccctccctacgaacgcgtccaccggtcggcggtaccncgtaccggccggcccgtgggtactccgtcgtacggtacaacgttactccgtacctacacgttacatcggcgagtcccgggagtcgacgacggcncgagtacg

SEQ ID NO: 78787 - DNA, 863 bp, Homo sapiens
  misc_feature: GYAE6OF01A6Y7Q.37.26.C04.1.454.CMB.1.raw
  modified_base (210)..(210): a, c, t, g, unknown or other
  misc_feature (210)..(210): n is a, c, g, or t
  modified_base (227)..(227): a, c, t, g, unknown or other
  misc_feature (227)..(227): n is a, c, g, or t
  modified_base (340)..(340): a, c, t, g, unknown or other
  misc_feature (340)..(340): n is a, c, g, or t
tcagtagtgtagatcacgaccggtgctcgatttagtctagcgactttgggtttgggggaggcttgggtacagcctgggggggtccctgagactctcctgtgcagcctctggtttcatctttagcaactacgccatgagcgtgggtccgccaggctccgaggggaagggctgggagtgggtctcaggtattactggtagtggtaataccgnatactacgcagactcgngacggccgttcacgtctcagagacaattccaagaacgtacggtctatactggaaatacgaacagcctgacgagccgaaggaccacggcccctactaactcgtgtcgcgagganatcgaaggaacggataagtacgagtacgacaggtcctacgcgtaacgttaccggtggggacccctaaccgggtaacccgttcggtaccctacccggttctcccgttacgaccgtaccccgttacccgaacccggtaaccgggacccccttaacggttaccccgggtttaccccccgtttacccccggtacccgggtaaccccctaacccccctttaccccgggtaacccctaaaacccgggaccgtaacccccggttaaccccggttacccggggttacccggggggaacccaaccgggtaacccgggtaacccccgggggttccccgggttacccgggggtaccttaccccggggttaacccgttacgggttaacccggtaaaaaccgggtaaccccgtttaaccccgtttaaacccgaacttttaaccccgtaaccttaaccggtacccggttaagggaccccggggttaccgggacccggtacggtaacccggaacggggtcctaaacggtacgtaacgg

SEQ ID NO: 78788 - DNA, 948 bp, Homo sapiens
  misc_feature: GYAE6OF01CP2A0.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagcgtcgggtccgccaggctccgaggggaaggggctgggagtgggtctacgaggttattacgtggtagtcggtaaactaccgcaatactacgcacggactccggtgaccgggtccggttacaccgtctaccaagagaactaacttaccgaagtaagtacggtctaatcgtaggaaaatcgaacgagcccgtaggaacgacggccggaaggaacccgaccggtcccctacgtaacgttacgtcggtcgaacggaggtacgagttcgaaacggtacgggtaaagttaacgtacggacccggaagtaccgtacggtccctttaaccggtacgaaaccgtttacccgggccgggggaacccctaaacccgggtaaccccgtttacggggaccccttaaaccccggtcccgttacccggtacccgtaaccgtcccccgttaaccccgaaacccgggtaaacccgggccccgttaacggttccccggtttcccccgtttaccccccggtacccggaccccgttaacccccgttacccccgtaacccgtaaaccgggtaccccgtaaccccggtaaccccggttacgggtacccggggggaacccgaaaccgggtcccgggtaccccgggtaccccgggtacgggggttccccgtaaccggttccccgggttaacccggtaaccggtaaaccggttaaccccttaaccgttaaaccccgtaccgttaaccgttaacccgtaccgttaaaccggttcggaacccgggttacgggtacccgggtaacgggtaccggaaaccgggccgacggttaagaacccgg

SEQ ID NO: 78789 - DNA, 636 bp, Homo sapiens
  misc_feature: GYAE6OF01A5SHR.37.26.C04.1.454.CMB.1.raw
  modified_base (287)..(287): a, c, t, g, unknown or other
  misc_feature (287)..(287): n is a, c, g, or t
  modified_base (323)..(323): a, c, t, g, unknown or other
  misc_feature (323)..(323): n is a, c, g, or t
  modified_base (375)..(375): a, c, t, g, unknown or other
  misc_feature (375)..(375): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactactccatgagctgggtccgccaggctccgaggggaaggggctgggagtgggtctcgaggttattacgtgggtagttggtaaactaccgctactactacgctacgactccgtggacgggtccgttcaccgtctccgagagacaattccgaaagtaatcggtntatctggaaatagaacacgcctgagacgacgagacncggcctctattacgtgcgcgagagacgtcgaaggacggatagtagcgagacncgactcgtagaccttaaccggtcggggacccgtaccgaccgttcggtaccaccgttccgccctcacgccctaccgaaccgaccggccgacgtccgtcccttccccgtcgccacccctccgtaccacgtacgacctacccgcgtcgggccacgaccgccggccggtcggtcgtcgtccgtacggtacaccggtactaccttccacgtacctaccgtactaaccgtcggacggccggtcgtacggacgaaggccgactagacg

SEQ ID NO: 78790 - DNA, 769 bp, Homo sapiens
  misc_feature: GYAE6OF01ENSYM.37.26.C04.1.454.CMB.1.raw
  modified_base (210)..(210): a, c, t, g, unknown or other
  misc_feature (210)..(210): n is a, c, g, or t
  modified_base (280)..(280): a, c, t, g, unknown or other
  misc_feature (280)..(280): n is a, c, g, or t
  modified_base (349)..(349): a, c, t, g, unknown or other
  misc_feature (349)..(349): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgaggggaagggctgggagtgggtctacaggtattacgtggtagtggtaaatccgnatactacgcagactccggtgacgggccgttcaccgtctccagagacaattccaaagtaactacggtctancgtaggaaatcggaaacagcctaggaagacgaccggaagaccgaccggtacccctattaactttaccgnggtacgcgaaggacgaactcgaaggaacgtaagtaatacggacctaagccgtaacgtccgttacgacggtaacccgttacggtcgggggtaaccccaaacgggttaaccctcggggttaaccaacccgggttctacccgttaacaccgggtacccctaaccgtaacccgaaccgggtacctaaccgttccgggttaccccttacccccgaggtacccctaaccccgtacctaacccggaagtaaccgaccttaccgtcgggttacggggaccaacggtaccggtacccgggtcccgtacggggtcctttaaccggccgtttacgggaacctaacgggtacccttacgttacccgaacgttacgtactaacgttacgtcggaccgggtcggtacgtcggaacgaacggtcgaagtcgtaag

SEQ ID NO: 78791 - DNA, 705 bp, Homo sapiens
  misc_feature: GYAE6OF01B8JJ6.37.26.C04.1.454.CMB.1.raw
  modified_base (146)..(146): a, c, t, g, unknown or other
  misc_feature (146)..(146): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
  modified_base (341)..(341): a, c, t, g, unknown or other
  misc_feature (341)..(341): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
tcagtagtgtagatcacgaccggtgctcgatttagtctagcgactttgggtttgggggaggcttggtacagcctggggggtccctgagactctcctgtgcagccttctggtttcatctttagcaactcgccatgagcgtgggtccnccaggctaccgaggggacgggctggagtggtctcgaggttattacgtggtagtggtaatccgcatacgtacgcaacgactccgtggaccgggtccgttacaccggtctcgagacgaactaattccaaagtatacggtctancgtaggaatagacngcctaggagacgcgaacgtccgacgtccctagtattacgnggtgacgaagganactcggagaacggagttanacggcaagcgtaacgtctcgttagaccgttaacgggcggggaaaccctaacggtaccgtgtccccgtaacgtttccaccgttcggacccttccctaccgaccgaaccggtcccgtacgtccgttaccccttaccccgtacggcccctacccgtaccgtaccgacgaccgtaccctaccgtttacgggacgggaccgaacgtccggtacccggtcccgtcgggtccgtaccgtcgtaccggtacgtaaccgtaccgttacgtacctaacgtacccgtctaccggtacgtgggttaacccggcggaccggtcggacgtaggccgtaggacgtgg

SEQ ID NO: 78792 - DNA, 756 bp, Homo sapiens
  misc_feature: GYAE6OF01BKNMT.37.26.C04.1.454.CMB.1.raw
  modified_base (149)..(149): a, c, t, g, unknown or other
  misc_feature (149)..(149): n is a, c, g, or t
  modified_base (330)..(330): a, c, t, g, unknown or other
  misc_feature (330)..(330): n is a, c, g, or t
  modified_base (480)..(480): a, c, t, g, unknown or other
  misc_feature (480)..(480): n is a, c, g, or t
tcagtagtgtagatcacgaccggtgctcgatttagtctagcgactttgggtttgggggaggcttggtacagccgtggggggtccctgagactctcctgtgcagcctcttggttcattctttagcaactacgccatcgagctcgggtccnccaggcctccgaagggagggctggagtgggtctcgaggttattacgtgggtagtacggtaaactccgctaattacacgcagtacctccggttggaccgggtccgttcaacccggttctaccaagacgactaaacgttccgaaagtacttacggtcctaatccgtagggaaacttggaaacncgaccgtagacgacggacggaagtccaccggtcctacgttaatacgtgtcggacgagaatacgtcgaaggaggtacttaagacgacagtacgagcgtacttacgacggttccggaggggaccccgtaaccggtaaccgtcgggttacccnccggttttcccactaccacccgggtaccctacccgaaccggaacccgccgtaacgttccggttccccctccccggacgtaccccgtacccttccgaccgaacctccgaccgtaccgtcggtaggaccctacggccgtccgggtccggtgacccggttcggaaccggttcggaacctacgggttaaaccctaccgttccgtaaacgtaccgtaccgtaaccgttactacggggaaccgttccggaccggtcggaaaccgcggtaccgagttaacggc

SEQ ID NO: 78793 - DNA, 688 bp, Homo sapiens
  misc_feature: GYAE6OF01D73Q4.37.26.C04.1.454.CMB.1.raw
  modified_base (220)..(220): a, c, t, g, unknown or other
  misc_feature (220)..(220): n is a, c, g, or t
  modified_base (381)..(381): a, c, t, g, unknown or other
  misc_feature (381)..(381): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (476)..(476): a, c, t, g, unknown or other
  misc_feature (476)..(476): n is a, c, g, or t
  modified_base (681)..(681): a, c, t, g, unknown or other
  misc_feature (681)..(681): n is a, c, g, or t
  modified_base (687)..(687): a, c, t, g, unknown or other
  misc_feature (687)..(687): n is a, c, g, or t
tcagtagtgtagatcacgaccggtgctcgatttagtctagcgacttttggggtttgggggaggcttggtacagccgtgggggggtccctgagactctcctgtgcagcctcttggtttcattctttagcaactaccgccatgagcgtcgggtccgccaggctccgaggggagggctgggaggtgggtctcgaggttattacgtggtagtaggtaataccgnaattacgacgcagaccgtccggtggacgggtcccgttacaccgtctacgagaacgaactacgttaccaaaggaacgttacggttactatacgtaggtaaatacgaacacgccgtaaggacgacggccggacgaccgaccggtccccttattacgtttacgnggtcggacggaacggagtacgtacggaagaacgggtatagtacgngngcagtctctagaccgtcggcgggacccaccggtacgtcgccgtacccncttccaccgctcccgtaccgaacccggaccgtcccgtacgttccccggttccccgtcccgacgtccccgtacccctcctaacgacgaccgcctaccggtcgggtacggacacggcggccggtacggtcgtacgtcggcgtacgacgtaccgactactaccgactaccgtcctagtcgtacggcggtcgacggtacggacagggcngttagng

SEQ ID NO: 78794 - DNA, 623 bp, Homo sapiens
  misc_feature: GYAE6OF01AV7RR.37.26.C04.1.454.CMB.1.raw
  modified_base (244)..(244): a, c, t, g, unknown or other
  misc_feature (244)..(244): n is a, c, g, or t
  modified_base (307)..(307): a, c, t, g, unknown or other
  misc_feature (307)..(307): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgaccgggccgttcaccgtcnccagagacaattccaagatcggtctatcaggaaatgaaacagtcctagagacgccgaggaccncggcccctgtatttactgtcgcgacgagatcgagacggagtatagcaagtcacgtcgtctgaacgtacgtcggggcctaaccgggaccgttcggtccaccgttcctcctacacggtccctaccgaccgaaccgggccctacgtccggtccccttccccgtcggccctaccccgtccctaccgtaacggactaccgaccgtcggtcggggcccacgacgccggcccgtcgggctccggccgtcggacgtacggaccttaccgtcctacgtcctactacctacgtggaccggcggcgtcggcgtaaggcctgaagtcg

SEQ ID NO: 78795 - DNA, 916 bp, Homo sapiens
  misc_feature: GYAE6OF01AWI59.37.26.C04.1.454.CMB.1.raw
  modified_base (221)..(221): a, c, t, g, unknown or other
  misc_feature (221)..(221): n is a, c, g, or t
tcagtagtgtagatcacgaccggtgctcgatttagtctagcgactttgggtttgggggaggcttggtacagccgtgggggtccctgagactctcctgtgcagcctctggtttcatctttagcaactcgcatgagcgtcggccgccgaggccgtacgaaggggagggcgtggaggttgggtctacgtaggttattacgtaggtagtacggtaaactacccgntaacgtaccgtacgacaacgtaccgtccgggtacggacccggggttcccgttaccacccgtcgtaccgaagtaacgaactaaccgttaccgaaagtaacgttaccggtactacgtacgtaagaaacgtacgaaacgcgtaccgtaggacgcgacggaacgaccgtaccgtcccttaagttacgtacgtcggtagacgagacgtacgacggaaggtacgtatacgcgacgacgtacgcgtacgtacgtaaccgtaccggtaccgggtccggaaccccgaaaccggttcccgtaccggttccccgtaacctttccccgtcccgtaaacccgtccccgtaacccccgtaacccgtaacccggtaacccggtacccgttacccggttaccccggttacccccgttaccccggtaccccgtaccccgtaccccgtaccccgtaacccgaacccgtacccgtacccgtacccggtaccgggtacccgggacccggtacccggtaccccgggtacccgggtcccggtaccgggtacccggttacccggttaccggttaacccggtaaccggttaacccggttacccgttacccgttacccgttaaccgttaacccgtaacccgttaccgtaacggtaccgggtaccggtaccgggaccggttttttttttacggaaccggtaccggtacgtacgtacgtacg

SEQ ID NO: 78796 - DNA, 897 bp, Homo sapiens
  misc_feature: GYAE6OF01CTQXU.37.26.C04.1.454.CMB.1.raw
  modified_base (144)..(144): a, c, t, g, unknown or other
  misc_feature (144)..(144): n is a, c, g, or t
  modified_base (211)..(211): a, c, t, g, unknown or other
  misc_feature (211)..(211): n is a, c, g, or t
  modified_base (876)..(876): a, c, t, g, unknown or other
  misc_feature (876)..(876): n is a, c, g, or t
tcagtagtgtagatcacgaccggtgctcgatttagtctagcgactttgggtttgggggaggcttggtacagccgtggggggtccctgagactctcctgtgcagcctctggtttcatctttagcaactacgcatgagcgtggccncaggctaccgagggaagggctaggagtgggtctacgtaggtattacgtggtagtaggtaatacccgnaatacgtacgcagtacgtccggtggaccggggtccgttacgaacccgtctaccgaagagaacctaaactttaccgaaagtaacgttaccggtcttaatcgttaagggtaaaatcgaaacgtacgtaccgtagaacggacgacccggaacggaccgtacccggtaccccttattaacgtttaaccgtgggtacgacggaagtaacgtacgtacgaaacgggtaacgggtattaagacgacgtacgacgtacgtcgttacgtaagtaccgtaaccgggtcgggtaaccccggtaaccggtacccggtttaccggtcccgtaaacccgttttccgtcccgttaaccgacccgtaccgtaaccccggtaaaccggtaacccgggtaccccttaacgggtttccccgtacccccgtttaccccccggtagtaaccccctaacccctttccccgaaaccgttacggtaaccccgacggttaacccccggtgggaaccggggtaccaaccgggcccggaccgggtttcccgacgggtaccctacgggttaccggttaaccggaaccggttaaccggttaaccctaccggtttaaacccgtaacgttaccgtaacccgttaaggtacccggttaacgggaacccggtcggggttaccctaaacgggaaaccgngggaaaccgtacgtaacgagg

SEQ ID NO: 78797 - DNA, 727 bp, Homo sapiens
  misc_feature: GYAE6OF01AUZKM.37.26.C04.1.454.CMB.1.raw
  modified_base (107)..(107): a, c, t, g, unknown or other
  misc_feature (107)..(107): n is a, c, g, or t
  modified_base (217)..(217): a, c, t, g, unknown or other
  misc_feature (217)..(217): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (720)..(720): a, c, t, g, unknown or other
  misc_feature (720)..(720): n is a, c, g, or t
tcagtagtgtagatcacgaccggtgctcgatttagtctagcgactttgggtttgggggaggcttggtacagccgtggggggtccctgagactctcctgtgcagcctnttggtttcattctttagacaactacgccatggagcgtgggtcccgccaggcctcgaggggaagggctgggagtgggtctcgaggttattcgtgggtagtaggtaatccgntatacctacgctagcctccggtggaccgggtccgttaccaccgtctcagacgactaacttccgaaagactacggtctatcgtacgaaatnaacncgcctgagacgacggaggtaccgaccggtccctacttaacgttacgtggtacgacggtaagacgtacgtacggaacggtaaacggtagtaacgagccgaacgctacggtcctacgtacgtacgtacggtacggacccgacggttacccgtggtaccctcgtacccctctccgtccgtaccctcccgacgaccggtacctaccgtccccgttccccttccccggccgtacccctccctaccgtacgaacgccgacccgtaccgtcgggtccgggacctaccgggtccgacccgggtcccggacggttccgtccgtcccggtaggttaccgtaacggttactaccttaccgtaccgttacgtaccgtacgtacggtcggccggtaccggtcgtacgggaacgacggtaccngtagacg

SEQ ID NO: 78798 - DNA, 763 bp, Homo sapiens
  misc_feature: GYAE6OF01ALKG9.37.26.C04.1.454.CMB.1.raw
  modified_base (296)..(296): a, c, t, g, unknown or other
  misc_feature (296)..(296): n is a, c, g, or t
  modified_base (550)..(550): a, c, t, g, unknown or other
  misc_feature (550)..(550): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctcgggtccgccaggctccgaggggaaggggctggaggtgggtctcgagggttattagtggtaggtggtaactaccgcatactacgcagacctcggagacgggccgtcacctatcctaccgaggaacaacttaccaagaccacactgtctctgacaacanaacacgtgagaggccgacgaccgaccgtccctaattattacgtacggtaaacgtaaaagtcggtaccgtacgaattacacggtactaacgttaggttcgggtacgttcggttaacttccgtacttccggtgggtccggggtaccggtcggcccgtaccgttagtaccgtcgttaccgtacctcgaccgtccccgtaacgaccggaaccgggcccttacgttccccgggttccccttaccccggccgggtacccncccgttcgaccgttccccggaggggtaacccctccgtaacccggtccggaacggaccgacccgtaaccgggtcccgggcccgggttccccgggtggtaccggtcccggtccggttccgtaaaccggttaccgtacccttacccgtaccgttacctaaccgtacccaccggttcgaacgggtccggggtacgcggttacggcccgaaaggtccg

SEQ ID NO: 78799 - DNA, 591 bp, Homo sapiens
  misc_feature: GYAE6OF01DG5X6.37.26.C04.1.454.CMB.1.raw
  modified_base (224)..(224): a, c, t, g, unknown or other
  misc_feature (224)..(224): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (394)..(394): a, c, t, g, unknown or other
  misc_feature (394)..(394): n is a, c, g, or t
  modified_base (439)..(439): a, c, t, g, unknown or other
  misc_feature (439)..(439): n is a, c, g, or t
  modified_base (459)..(459): a, c, t, g, unknown or other
  misc_feature (459)..(459): n is a, c, g, or t
  modified_base (555)..(555): a, c, t, g, unknown or other
  misc_feature (555)..(555): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccaggggagggctggagtgggtctcaggtattacgtggtagtggtaataccgcatactacgcagactccgnggacggccgttcaccgtctccagagacaattccaaagatacggtctatctaggaaatgaacagcctagagagccgagacacggccctntattacngtgcgagantcagaacggatanacgnagcagctntgaacgtcgtcgggaccaccggacctggcctaccgcttccnacgcctaccgaccgaacggccacgtccgttcccttccccgcgccncccctcctaccgaacgtacnccgtaccgtcggtggggacctacgacgcccggcccgtgggccttcggcgtcggtacgaacggtaccttacctcctactaccgttacacgttaccgnggtacgcgggtctagggacccgagggtcncnggtag

SEQ ID NO: 78800 - DNA, 881 bp, Homo sapiens
  misc_feature: GYAE6OF01CKZVI.37.26.C04.1.454.CMB.1.raw
  modified_base (173)..(173): a, c, t, g, unknown or other
  misc_feature (173)..(173): n is a, c, g, or t
  modified_base (206)..(206): a, c, t, g, unknown or other
  misc_feature (206)..(206): n is a, c, g, or t
  modified_base (319)..(319): a, c, t, g, unknown or other
  misc_feature (319)..(319): n is a, c, g, or t
  modified_base (701)..(701): a, c, t, g, unknown or other
  misc_feature (701)..(701): n is a, c, g, or t
tcagtagtgtagatcacgaccggtgctcgatttagtctagcgactttgggtttgggggaggcttggtacagccgtggggggtccctgagactctcctgtgcagcctctggtttcatcttagcaactacgccatgagcgtggccgcgagctcgagggagggctgggagtggtcngtaggttatacgtaggtagtaggtaactaccgntagtactacgcgagaccgtccggaggaccgggtccgtacaccgtctaccgagaagaacctaacgttaccaaagtaacgtacggttctacgttagaacggtaaatacgaacccnggtacgtaggaacggaccgggaccggaaggtacccgtccggtaccccttaatttaacggtaccgtggacgaaccggtaagagactcgggaacggtagggtaattacgacgtagactaccggtacgtcctttacgaaacccggggttcgtaaccggggaccgggaaaccccggtaacccggtacccgtttaggttaccccgaacccgttttccgacctaaccgggtacccgacccccgtaacccggaacccggtaccgggtccccgtaaccggtttcccccgttacccccgttaccccggttaccgacccccgttacccgtaacccccgtaaccgtaaacggtacccgacccgtaccgggttacccgggttcggggaaccccncggggtaacccggtaccccgggtccgggtcccgggttacgtcccgggttaccggttacggacccggtaaccgtacccggtttaacctcccgttaacttaaacccgtccgttaacctaacgggtccgaccgggggttccgtaccgggtaccgggacggaaacggtcgtaccggtagtacgg

SEQ ID NO: 78801 - DNA, 706 bp, Homo sapiens
  misc_feature: GYAE6OF01DB2RH.37.26.C04.1.454.CMB.1.raw
  modified_base (218)..(218): a, c, t, g, unknown or other
  misc_feature (218)..(218): n is a, c, g, or t
  modified_base (263)..(263): a, c, t, g, unknown or other
  misc_feature (263)..(263): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (686)..(686): a, c, t, g, unknown or other
  misc_feature (686)..(686): n is a, c, g, or t
  modified_base (692)..(692): a, c, t, g, unknown or other
  misc_feature (692)..(692): n is a, c, g, or t
  modified_base (698)..(706): a, c, t, g, unknown or other
  misc_feature (698)..(706): n is a, c, g, or t
tcagtagtgtagatcacgaccggtgctcgatttagtctagcgactttgggtttgggggaggcttggtacagcctgggggggtccctgagactctcctgtgcagcctcttggtttcattctttagcaactacgccagtgagcgtgggtccgccgaggcctccgaaggggaaggggctggaggtgggtctcgaggtattacgtggtagtggtaataccgnagtactacgcagactccggtggaccgggccggttccaccgttccnccgagacgaacaacttacaaagaacacgctctatctgacaaagcgaacacgctagagacgaccgaagacgacgtacgtattatacgtggngtagaaggtggngggtaggtcgggggacgtacgtcggggaccgaacggtaccgtcggttaccgaccgttcgtcccgtacgaccgtcccgtaacccgtaaccggacccgggtacccgtaacggttcccggtttaccccttcccccgtacggacccctacccctcccgtaaccgaacggaccgacccgtacccggtcgggttaccggggacccgtaacgccgggccggtacccggtcggccgtacgtccggtacggtaccggaaacgttaccttacccgttaccgtactacgttaacgtacctaggtcggacggtcgggcgtaggacggaacggngaacgngtacgnnnnnnnnn

SEQ ID NO: 78802 - DNA, 178 bp, Homo sapiens
  misc_feature: GYAE6OF01C9R6Q.37.26.C04.1.454.CMB.1.raw
  modified_base (174)..(178): a, c, t, g, unknown or other
  misc_feature (174)..(178): n is a, c, g, or t
tcagtagtgtagatcacgaccggtgctcgatttagtctagcgactttgggtttggggggaagaggaagactgacggtcccccaggagttcaggtgctgggcacagcggccctgggctgcctggtcaaggactacttccatctacactactgagcgggctggcaaggcgcatagnnnnn

SEQ ID NO: 78803 - DNA, 864 bp, Homo sapiens
  misc_feature: GYAE6OF01B88WM.37.26.C04.1.454.CMB.1.raw
  modified_base (109)..(109): a, c, t, g, unknown or other
  misc_feature (109)..(109): n is a, c, g, or t
  modified_base (227)..(227): a, c, t, g, unknown or other
  misc_feature (227)..(227): n is a, c, g, or t
tcagtagtgtagatcacgaccggtgctcgatttagtctagcgactttggggtttgggggaggcttggtacagccgtgggggggtccctgagactctcctgtgcagcctntggtttcatctttagcaactacgccatgagcgtgggtccaccgaggtctcgaagggggaaggggctaggaggtcgggtctacgtaggttacttacgtgggtagtaggtaaactaccgntataccgtacgcaacggtaccgttccggtaggaccgggtccgttacaacccgttctaccgaagtagtaacctaacgtttaccgaaaagtaacgttacggtacttaagtcgttaaggaaactcggaaacacggtccgtaggaacgaacggaccggaaacggccgtaacccggtcccctttaattaacgttaacgtgggtacgaacggtaaggtaacggaacttacgaaacggaaccggtaaggttaactacggacctaaggctaacgtcgtacgtaggtaaccttacgggacggggtaacccaaaccgggtaaccttcgggtccaacccgttctacccagaccgtaccctaccgaaccgacggtacctacggtccgttacccctcccgtacgaccctacctacctaccgaacgtcgtaccgtaccgtcgggtacgggaccacggtaaccgggtcccggtacccggttagggtccttacgggtaccggttaaccgggtaaccggtaaaccggttaacccgttaaccgttacccgttaaactaacccggttaaaccaaccggttaaccggtacgggaccggggttacccggtaacgggtaccgggtaaccgaaccgggtaccgttaacgtaaggtaccgg

SEQ ID NO: 78804 - DNA, 949 bp, Homo sapiens
  misc_feature: GYAE6OF01BEVJZ.37.26.C04.1.454.CMB.1.raw
  modified_base (147)..(147): a, c, t, g, unknown or other
  misc_feature (147)..(147): n is a, c, g, or t
tcagtagtgtagatcacgaccggtgctcgatttagtctagcgactttgggtttgggggaggcttggtacagcctggggggtccctgagactctcctgtgcagcctcttggtttcatctttagcaactacgccatgagcgtgggtccnccgaggcctccgaaggggaagggctgggtaggtgggtctcgaggttattacgtgggttagtaggtaactaccgcattaccgacggcacggtacctccggtggaccgggccgtttaccaccggtctaccagacgtactaacttccaaagtaacgttcggttactacgttacggtaagggaaaacttaggaaaaccgtggaccgttacggaaacggacgggacccggttaaacgggaaccccgtaccccgggttacccctttactttaaacgtttacggtttcggacggggtacccgaggttaagacccgttaggaaaccgggaacgggttaattaacggttaaccgaccggacgtaccgtaaccgggttccgttaccggttaacgggtaacccgggtttaaacccgggcccggggggtaaacccccttaaaaccccgggggtacccggtttacggggtacccccttaaccccggttccgtttaccccgaaccggtaaccgtcccccccgttaacccgaacccggggtaacccggtacccctttacccgggtacccgtttccccccgtttaccccgcggtacccccgtaccccgttccgaaaccgtaccgaccgtaccggtacccggtcggggtacccggggaacctccgggaaccggcccggggtacccgtttgggggacccctcgttacccggttaggtaaccccggtaacgttaccttacccgtacctaccttaaccgtaccgtaaccgtcccgtggggaccccggtgggttaccgcgggtaacccaagggccaagtgacg

SEQ ID NO: 78805 - DNA, 840 bp, Homo sapiens
  misc_feature: GYAE6OF01DPM4O.37.26.C04.1.454.CMB.1.raw
  modified_base (148)..(148): a, c, t, g, unknown or other
  misc_feature (148)..(148): n is a, c, g, or t
  modified_base (177)..(177): a, c, t, g, unknown or other
  misc_feature (177)..(177): n is a, c, g, or t
  modified_base (190)..(190): a, c, t, g, unknown or other
  misc_feature (190)..(190): n is a, c, g, or t
  modified_base (326)..(326): a, c, t, g, unknown or other
  misc_feature (326)..(326): n is a, c, g, or t
tcagtagtgtagatcacgaccggtgctcgatttagtctagcgactttgggtttgggggaggcttggtacagccgtggggggtccctgagactctccgtgtgcagcctcgttggtttcatctttagacaactacgcatgagcgtggccncaggctcgagggagggctggagtggtctnagtactaattagngggaatggtagactacactactactacgcgagtacctcggaggtaacgggtccgttacaacctctccgtaccgaaggaactaaccgttaccgaaagacctactaccttcggtctacgcgtaactaaagtacgaacngtaccgtagaaggtacgtacggaacggtaaccgtcggtaccttttaagtactttaacggttggtacgtaacggtaaccggtaccttacggtaccgttaaccttagacggtacgacgggtccgttacgtcggttaccggttaggttaccgttacggaaccggtacggtaccggggacggtaaccggtaccggtttcgaccgtacccgttccgaccgtaccgccgtacccctaaccggaaccgtaaccgggtacctaccggttccgtcccggtttcccgacgggttccccgtacccgttcgacccgttaccgacggaccgtcccgtaaccggtacctacggacgacccggtaacggccggtacccggtaccgggtccggttaccggtaccggtaccgggttaacggaaccccggttaacggttacccctttaaccggttaccttaaccgttaacccggtaacccgttaacggttacccgggaaccgggtccgggccggggttaccgtaaccggggg

SEQ ID NO: 78806 - DNA, 690 bp, Homo sapiens
  misc_feature: GYAE6OF01A8A5E.37.26.C04.1.454.CMB.1.raw
  modified_base (564)..(564): a, c, t, g, unknown or other
  misc_feature (564)..(564): n is a, c, g, or t
  modified_base (630)..(630): a, c, t, g, unknown or other
  misc_feature (630)..(630): n is a, c, g, or t
tcagtagtgtagatcacgaccggtgctcgatttagtctagcgactttgggtttgggggaggcttggtacagcctgggggggtccctgagactctcctgtgcagcctcttggtttcattctttagcaactacgccatgagctgggtccgccaggctccgaggggaggggctggaggtgggtctcaggttattacgtggtagtggtaataccgcatactacgcagacttccggtgacggggtccggttcaccgtctaccagagacctaacttaccaagaacgtacggtactatacgtaggaaatagaacgacgccgtaggaggacgaccggaaggtaccgaccggcccttcttattacgtgtcggacgagacgtatcgaaggtacggtagtagtagcgagtcgagtctacgtcgtacgtaccggtcgggacccgtaaccgggacctcggtacccaccgttcctccgccacgtccctacccacccgaccggccctacggttcccggttccccttccccgtcggacccctaccctccctaccgacgacgccctacgtcggcgggaccncgaccggccggtccgtcgggtcgtcgtacccggtacgtaccggtaacgtccgttccttacccgttntaacccgtaccgtctacggcggcgggtaccggcggtacggccgaacgtcgaccgttggcg

SEQ ID NO: 78807 - DNA, 561 bp, Homo sapiens
  misc_feature: GYAE6OF01C3EEA.37.26.C04.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (449)..(449): a, c, t, g, unknown or other
  misc_feature (449)..(449): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (548)..(548): a, c, t, g, unknown or other
  misc_feature (548)..(548): n is a, c, g, or t
  modified_base (557)..(557): a, c, t, g, unknown or other
  misc_feature (557)..(557): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgnatactacgnagactccgtgacgggccgttcaccgtctcagagacaattccaaagaatacggtctatctaggaaatgaaacagcctgagagccgaggacacggcccctgtaatttaccgtgtgtgaacggggacctcgtacgtccccttaatagcagcggctggtcctggtactttgacgacgtgggcaagggaaccctggcacgtctcctcagcctcaccaacggcccatcggtccttccccgngccgccctgcctaccgagcgcacctcgangcacngcgtcctggcgtcgcgtggacaacggtactacgtccagtctactacgtactgaacggcggtacgnggacaggtnaacg

SEQ ID NO: 78808 - DNA, 725 bp, Homo sapiens
  misc_feature: GYAE6OF01A793Z.37.26.C04.1.454.CMB.1.raw
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
tcagtagtgtagatcacgaccggtgctcgatttagtctagcgactttgggtttggggggaggcttggtacagcctgggggggtccctgagactctcctgtgcagcctctggtttcatctttagcaactacgccatgagctgggtccgccaggctccgaggggaaggggctgggagtgggtctcgaggtattacgtggtagtaggtaactaccgctatacctacgcagactccggtggaccgggtccgttcaccgtctcaganacattccaagaatacggtntatctaggaaatgaacacgcctggacgacggccggaaggaccgaccggtcccctacttaatttaccgtggtacggcgaagtagactacgaggaacgggatagtagacgagcagtcctacgtgacgtacggcggggaccaccggaccctcgggccctaccggtcctcctacgacaccctacccgaaccgaccgggcctacgtcccggttcccctaccccgtccgacccctacccctccctaacccgaacggtacccgcccgtaaccgtccggggtacgggacccgtacggtacccgggccccgggtaccggtcgggttcccggtccggtaccggtacggttaacgaacccgggttaaccttacccttccgaacttaccgaaccgttacccgtacggtacgggccgggtacccgggcgtacgggaccgaccgggctggtaactagg

SEQ ID NO: 78809 - DNA, 920 bp, Homo sapiens
  misc_feature: GYAE6OF01BFH0S.37.26.C04.1.454.CMB.1.raw
  modified_base (292)..(292): a, c, t, g, unknown or other
  misc_feature (292)..(292): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctggaggtgggtctcgaggttattacgtggtagtggtaataccgcatactacgcagactcgtgacgggccgttcaccgtctccgagagactaattccaaagtatacggtctatctaggaatgaacngcctggagacgccggaaggacaccggtccccttattacgttacgtggtaggccggaagagatccgaaggaccggtaatagtacgcaggtcacgtctacgttagaaccgttcggaccggggacccaaacccgggacccgtttacgggcccctaacccggttccttaccccgtaacctacccgggtacccccttaccccggaaaccccggtaaccggggacccccttaaccggtttcccccgggtttaccccccgtttaccccccccggtcccggggtaccccccttaacccccccgttacccccgttaacccggtaaacccgggtacccgtaacccccggttaaccccggtttaccgggggtacccggggggaaccccgaaccgggtaacccgggggcccgggtaacccccgggttcgggggtaccccgttccggttcccggggttacggggttaaaccccggtaaaccgggttaacccgtttaaccccgtttacccgtaacccggtttaacccgtttaaaacccgtaccccgttaaaccgggtaccggggtaaacccgggttcccggggtaacccggttacgggtaaccccgggtaaacgggccccggttaaacgtacggtaaccggg

SEQ ID NO: 78810 - DNA, 768 bp, Homo sapiens
  misc_feature: GYAE6OF01BTQGX.37.26.C04.1.454.CMB.1.raw
  modified_base (315)..(315): a, c, t, g, unknown or other
  misc_feature (315)..(315): n is a, c, g, or t
  modified_base (348)..(348): a, c, t, g, unknown or other
  misc_feature (348)..(348): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaagggctggagtgggtctcgaggttattacgtggtagtggtaactaccgctatactacgcagacctccgtaggaccgggtccgttcaccgtctccgagacgactaacttaccaaagtaacgttcggtacttagtacgtaggtaaaatggaaaacngtccgtaggaacgacggacccgaaggtaacccnccggtccccttagttaagtttacgtggtcggacggaagtacgtactacgaaggacggtaataactacggactagaccaagtcttactacggtaacgttccggacggtaccccgaacggtacccgtggtccctacccgtccttacctaccgaccgtccccgtaacccgaacccggaaccggtccccgtaaccgtttccccggttcccccgttacccccggccggtccccctaacccccgttaccctaccgtaaacggccgtaccccgtacccggtacgggtaccggggaccctacgaccggcccgggtccggtccgggtccgtccggtcgtaccggtacgaaaccggtccttacctccctacgtaccgtaactacctacggtcggaccgggcggacgtagggaccgaaggcgactaggtcg

SEQ ID NO: 78811 - DNA, 667 bp, Homo sapiens
  misc_feature: GYAE6OF01DNQ72.37.26.C04.1.454.CMB.1.raw
  modified_base (206)..(206): a, c, t, g, unknown or other
  misc_feature (206)..(206): n is a, c, g, or t
  modified_base (313)..(313): a, c, t, g, unknown or other
  misc_feature (313)..(313): n is a, c, g, or t
  modified_base (331)..(331): a, c, t, g, unknown or other
  misc_feature (331)..(331): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaagggctggagtgggtctcaggtattacgtggtagtggtaataccgnatactacgcagactccgtgacgggccgttcaccgtctccagagacaattccaaagaatacggtctatcgtaggaatgaacagcctagagacgcgagacacggccctntattactgtcgcgagagntcgaggacggagtatagacgagcagtctcgtagtaaccgtacggtcggggacccaacccgggtacccgtcggtacccacccggttcctacccgtcgaaccgtcccctacccgaacccgaaccgggtcccctagtccccggttccccttcccccgtcggtaccctacccccgtcccgtaccgaacgacgtacctacccggtcggccggggaccaccggacggcccgggtaccgtcggggcctcggtccttcggtaccgaacggtaccttacctacccgtactacccgtactaccgtaccgtggtaccgggccgacgtcgggacagggcagtagtacg

SEQ ID NO: 78812 - DNA, 740 bp, Homo sapiens
  misc_feature: GYAE6OF01B861O.37.26.C04.1.454.CMB.1.raw
  modified_base (152)..(152): a, c, t, g, unknown or other
  misc_feature (152)..(152): n is a, c, g, or t
  modified_base (322)..(322): a, c, t, g, unknown or other
  misc_feature (322)..(322): n is a, c, g, or t
  modified_base (469)..(469): a, c, t, g, unknown or other
  misc_feature (469)..(469): n is a, c, g, or t
  modified_base (695)..(695): a, c, t, g, unknown or other
  misc_feature (695)..(695): n is a, c, g, or t
tcagtagtgtagatcacgaccggtgctcgatttagtctagcgacttttggggtttggggggaggcttggtacagcctgggggggtccctgagactctcctgtgcagcctctggtttcattctttagcaactacgccatgagcgtcgggtccnccgaggcctccgaggggaaggggctgggaggtgggtctcgaggttattacgtgggtagtaggtaaactaccgcatactacgcaggacctccggtggaccggggtccggttccaccgtctccaggacgaacctaattccgaaagattacggtctaatcgtagaaatgaacncgcctaggaggacgccggaggaccaccggtccctattagttactggtgcgaagagatacgaggaacgtaagtagtacgacagacacgtctcgtagaccgtacggcggggaccacccggtaaccgtcggtccaccgttctccacgccnccctaccgaaccgacggccctagtccccggttcccctacccggtcggtccccctacccgtacccgtaaccgaaccggccgtaccccgtaccgggttacgggaccggggaccgtaaccgccggggtaccccgggtccggtccggggtccgtccgggtacccgttacgggtaaccgtaacggtacccgtttaccgtaccgtaccttaccgtaaccgtacgttaccggngggtaccggccggtacggaccgggaacgacggcctagggaagtcg

SEQ ID NO: 78813 - DNA, 659 bp, Homo sapiens
  misc_feature: GYAE6OF01BR0KV.37.26.C04.1.454.CMB.1.raw
  modified_base (371)..(371): a, c, t, g, unknown or other
  misc_feature (371)..(371): n is a, c, g, or t
  modified_base (390)..(390): a, c, t, g, unknown or other
  misc_feature (390)..(390): n is a, c, g, or t
  modified_base (436)..(436): a, c, t, g, unknown or other
  misc_feature (436)..(436): n is a, c, g, or t
  modified_base (459)..(459): a, c, t, g, unknown or other
  misc_feature (459)..(459): n is a, c, g, or t
  modified_base (529)..(529): a, c, t, g, unknown or other
  misc_feature (529)..(529): n is a, c, g, or t
tcagtagtgtagatcacgaccggtgctcgatttagtctagcgactttgggtttgggggaggcttggtacagcctgggggtccctgagactctcctgtgcagcctctggtttcatctttagcaactacgccatggagcgtcgggtccgaccaggcctccgaaggggaagggctggagtgggtctcaggttattacgtggtagtggtaaactaccgcataccgtacgcagtacctcggtggaccggggtccgttaccaccgttcctacagacgtactaactcaaagaatcggtctagtcgtaggaaatcgaacacggctgagacggtccggagtaccgtaccggccttactacgtttagcgtcgacgagagtntacgaaggacggtaagtanacgcagcgatccttagtcgaactcggtggccccgaacggttacccnggttacccacccgttctaccccnaccggtcccctaccgacgtaaccggcctacgtcccgttcccctaccgtcgcctccgcgctccgagtaccnccaccgtcgacgacgccacggccggcgttccggcgggtctccgccgtaagggactaaacgtcccttacctaccgtaatccctacgaacctttacgggcgacggccgtcggacgaccggttaacgcgtaag

SEQ ID NO: 78814 - DNA, 846 bp, Homo sapiens
  misc_feature: GYAE6OF01EBHAP.37.26.C04.1.454.CMB.1.raw
  modified_base (146)..(146): a, c, t, g, unknown or other
  misc_feature (146)..(146): n is a, c, g, or t
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccnccgaggcctccgaggggaaggggctggaggtgggtctcgaggtattacgtggtagtggtaataccgcatactacgcagacctccgtggacgggtccgttccaccgtctaccagagactaatccaaagtaatacggtactatcgtaggaatagaacagcctgagacgcgagacacggcctntatctgcgcgagagatcgaggacggagtagtagacgacganacggtccttacgtacggtacccgttaaccgggtaccgggggaaccccgtaaaccccggggtaaccccgttccggggttacccccgtacccggttccccgttaccccttaccggacccgttacccccgtacccccgaaaccccggaaaccccggggtaccccgtaaccggttccccgggtttcccccgtttccccccgtacccggtacccctacccccccgtttacccctaacccgtaaaccgtaacccgtaccccgtacccgttccgggtaccggggacccgaccggtaaccgggccccgggtccccggttccggggtcccttccggggttacccggttacgggtacccgtaaccggtaaacccgttacccgtttacccgtaacccgtttcctaaaccgttacccgttaccggtacgggacccggggtaacccggttcgggaacggtacgggaaccggggtaccggtccgtaagtacgg

SEQ ID NO: 78815 - DNA, 879 bp, Homo sapiens
  misc_feature: GYAE6OF01BH30X.37.26.C04.1.454.CMB.1.raw
  modified_base (150)..(150): a, c, t, g, unknown or other
  misc_feature (150)..(150): n is a, c, g, or t
  modified_base (346)..(346): a, c, t, g, unknown or other
  misc_feature (346)..(346): n is a, c, g, or t
tcagtagtgtagatcacgaccggtgctcgatttagtctagcgactttgggtttgggggaggcttggtacagccgtggggggtccctgagactctcctgtgcagcctcgtggttcattcttagcaactacgccagtgagtcgtcgggtccnccgaggtctaccgaaggggaagggtctgggaggtgggtctacgaggtattacgtggtagtggtaactaccgctaactacgtaacgcgaagtaccgtccggtaggaccggggtccgttactaccgtacgtaccgagaagaacctaaacttacgaaagtaagttaccggttctaatacggtaaagaaactagaaaccncgtacgtaggaacggaccggtaaccggacggtaacccggaccggtaccccttagttaacgttccgttggaccggaggaagaacgtacgtaccggaaaggtaaacgggtaattacggacacgaacgtcacgtacgtacgtaaacggtcccggttaaccggggaccggggtaacccccaaaccgggttaaccccggttcggttaaccccgtaccccgggttactccccgtacgacccgttacccgaaccccgaaccgggtacccggaccccttaacggttcccccgtttccccgtccccgtacggtaccccacccttaaccgtaccgtaacggtaccgtaccgtacccggtccgggcggtaaccgacggccgggtacccgggccggtaccgggtacccgtaccggttacccggtagggtaacccggtaccgtaacctttacccgaaccgttaccttacccggtaactaccggttacggaaccggggtcggtacccgggtacggtaccggggaaccacgggtaacgcgtaagtacg

SEQ ID NO: 78816 - DNA, 736 bp, Homo sapiens
  misc_feature: GYAE6OF01A13UU.37.26.C04.1.454.CMB.1.raw
  modified_base (143)..(143): a, c, t, g, unknown or other
  misc_feature (143)..(143): n is a, c, g, or t
  modified_base (185)..(185): a, c, t, g, unknown or other
  misc_feature (185)..(185): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (271)..(271): a, c, t, g, unknown or other
  misc_feature (271)..(271): n is a, c, g, or t
  modified_base (326)..(326): a, c, t, g, unknown or other
  misc_feature (326)..(326): n is a, c, g, or t
tcagtagtgtagatcacgaccggtgctcgatttagtctagcgactttgggtttggggagcttagggtacagcctggggggtccctgagactctcctgtgcagcctctggttcatctttagcaactacgccatgagctggtccncaggctcaggggaagggctggagtgggtctcaggtattaccnggtagtggtaatccggcaattactacgcagacctccgtgaccgggccgttcaccgtcnccgaganactaattccaaagattcggtntatcgtggaaatggaacagccgtagacggacgtccgaaggaaccacggtcccctntaatttaccgtgttcgaccgaagcgactcgaggaccggtagtatacggcagtcagctctcgacttacgcgggtcccaaccggtaaccgtcggtacctaccgttcctcctacgacgtacccgtaccgaaccgaacggtccctacggtccggtcccttaccccgtcggtaccctaccccgttaccctaccgaacggtaccgacccgtaccgtccggtcggggtacccgaaccggtccggaccgggtccccggtcggggtcccgttaccggtaccggttacgggtaccgtaacggtacccgttaccgttacccgtaaccgttacccgtaaaccgtaccgtaaccggttacgggaccggtacccgggtaccgttaccgggaccgtaaaccgggtcccgtacgtaacgttaccgg

SEQ ID NO: 78817 - DNA, 1044 bp, Homo sapiens
  misc_feature: GYAE6OF01CI2HZ.37.26.C04.1.454.CMB.1.raw
tcagtagtgtagatcacgaccggtgctcgatttagtctagcgactttgggtttgggggaggcttggtacagccgtggggggtccctgagactctcctgtgcagcctctggtttcattctttagcaactacgcagtgagcgtgggtccgccaggctccgaaggggaagggctgggaggtgggtctacgaggttacttacgtagggtagtaggtaactaccgctaataccgtacgcgaacgcctccggtaggaccgggtcccgttcaacccgttcgtaaccgaaggactaaactaaacgtttaccgaaaagtaaacgttaccgggttcttaaagttaccggttaaggaaaaacttcgtaaaaaccgcgggtaacccgtagggaaaccgggaacggcccggtaaacggggtaaccgtaccccgggttccttaaactttaacgtttacgtggggaccgaacggtaaaggaagtaacgttacggaaaggtaaacgggttaataacgtaccggaaacgaacggtcgtaacggtcccgttacgttaaacggacccgggtttaaccggggacccgggggaaacccccaaacccggggttaaccccgtttacgggggtaacccttttaacccccggttaccgttaccccgaaacggtaccccgtaaccccccgtaaccccggaaaacccgggtaaccccgggtaaacccccgttcccgggtttacccccggtttacccccgtttacccccgggtaacccggtaacccccctttacccccggttaaccccgaacccggttaaacgaacccggttacccgtaaccccgggttacggggtaccgggggtaaccctaacccggggcccgggttacccggggtacccggtcccggggtaacgttccccgggtaacgttacgggtaaacccgtaccggttaacccggtttaacctaccggtttaactacccgtttaaaccgtaccgttaccgggttaggaccgggggttacccgagggtaacccggtaaggaacccgggtttacaaacggtgtaaccgg

SEQ ID NO: 78818 - DNA, 1056 bp, Homo sapiens
  misc_feature: GYAE6OF01EEFFK.37.26.C04.1.454.CMB.1.raw
  modified_base (157)..(157): a, c, t, g, unknown or other
  misc_feature (157)..(157): n is a, c, g, or t
  modified_base (1045)..(1045): a, c, t, g, unknown or other
  misc_feature (1045)..(1045): n is a, c, g, or t
tcagtagtgtagatcacgaccggtgctcgatttagtctagcgactttggggtttgggggaggcttggtacagccgtgggggggtccctgagactctcctgtgcagcctctggattctaacgtttggtagtcttagttggatggacgtcggggtcccncctagtcctccggagggggaacggggcgtgggtagggttgggggtacggaccaaacgagtacggagggggtagggtgggtaggtaaacgaaaaactgtggtgtacttcgtggtgggccggggtaccgtacttaccacctacttccctaccgagacgaaaccgaaccgaaaccctaaaaactcaacgttcgtactcgtacgaacgtaaaggtcgggaccggtccggtaggaacggtacgtaccgggaacgggaccggtaccgggttacgtttagggtttagttttaagttttacggtttgggtaccggtaggggtaaggttaacgttttaaattttaacgggtaaaacccgtttaaaagggtttaaacggtttcggttaaaggggttacgttaacgggttaggggttaacttaggtaagttcggtttactttaacggtcggtaaaccgggttaccggggtaccggggggtaacccggaacggggttaacccgtagggtttaccgggtacccccgttacccgttttaccgtttcccgtacccgggtaaccccgttacccccgtaaacccccgggtaaccccgggaaccccggggtttcccctaaccggggtttccccccgggtttccccccgtttcccccgggtacccgggtccccccgttaccccgtaccggttacccggaaccccgggtacggtaacccccggacccgtaacccgggacgaacccggggaccacccggtaccgggccgggggtcccccggttcccgggtcgggtaccgtttccccggggtacggtttacccggtaaaccgttaaccggcccccttttaacctacccgttaaccgttaacccgttaccggttaaccgttccggggaggggttccccggnggggttaccgg

SEQ ID NO: 78819 - DNA, 677 bp, Homo sapiens
  misc_feature: GYAE6OF01EBEP9.37.26.C04.1.454.CMB.1.raw
  modified_base (147)..(147): a, c, t, g, unknown or other
  misc_feature (147)..(147): n is a, c, g, or t
  modified_base (181)..(181): a, c, t, g, unknown or other
  misc_feature (181)..(181): n is a, c, g, or t
  modified_base (212)..(212): a, c, t, g, unknown or other
  misc_feature (212)..(212): n is a, c, g, or t
  modified_base (254)..(254): a, c, t, g, unknown or other
  misc_feature (254)..(254): n is a, c, g, or t
  modified_base (297)..(297): a, c, t, g, unknown or other
  misc_feature (297)..(297): n is a, c, g, or t
  modified_base (374)..(374): a, c, t, g, unknown or other
  misc_feature (374)..(374): n is a, c, g, or t
  modified_base (564)..(564): a, c, t, g, unknown or other
  misc_feature (564)..(564): n is a, c, g, or t
  modified_base (600)..(600): a, c, t, g, unknown or other
  misc_feature (600)..(600): n is a, c, g, or t
  modified_base (660)..(660): a, c, t, g, unknown or other
  misc_feature (660)..(660): n is a, c, g, or t
tcagtagtgtagatcacgaccggtgctcgatttagtctagcgactttgggtttgggggaggcttggtacagccgtggggggtccctgagactctcctgtgcagcctctggttcatctttagcaactacgccatgagcgtcgggtccnccaggctccgaggggaagggctgggagtgggtcncgaggttattacgtggtagtggtaataccgnatactcgcaggcctcggtggaccgggtccggttacaccggtntacccaggaacgtaactaacttccgaaaaggtaagttccggtntactagtacggaaatacggacaggtcctggagcggacgacggactaccgcccgttcttaatttcgagtggacgaagngaataccgaggtaacggggatacgtaagcgaggcgttacgcctacgtgtaacgttaccgggcgggaaccgtaaccggtaccgtccgggtacctcccggtctcccgtgaccccttacgacccgtacggaacccgtccgtacgtcccgttccccgtccctcggccctccctaccaccacgaccgtcgcccgngtaccgggccacggtaccgccggtacccggcggtcncggcgtaacgtccgacgtaccgtactccacgttccagtaccgtgtcggagcgggttccgngacggatcggaccagtc

SEQ ID NO: 78820 - DNA, 774 bp, Homo sapiens
  misc_feature: GYAE6OF01AQ4VY.37.26.C04.1.454.CMB.1.raw
  modified_base (172)..(172): a, c, t, g, unknown or other
  misc_feature (172)..(172): n is a, c, g, or t
  modified_base (281)..(281): a, c, t, g, unknown or other
  misc_feature (281)..(281): n is a, c, g, or t
tcagtagtgtagatcacgaccggtgctcgatttagtctagcgacttttggggtttgggggaggcttggtacagcctgggggggtccctgagactctcctgtgcagcctctggtttcatctttagcaactacgccatgagctgggtccgccaggctccgagggaagggctggngtgggtctcaggtattacgtggtagtggtaaactaccgcatactacgcacgactccggtgaccgggccgttcaccgtctccgagacgacaattaccaagaactacggtntatacgtaggaaatgaacacgcctagagacggacccgaggaccgaccggtcccttacttacttaccgttggtcgaccggaaggtagtacgggacgggtcggtggtcgtgggtcgacgtcggtcgtacctacgttaacgacttacgtactcgtacttcgagttcggacgttacggagggtaaccggaaacgggacccgtacggtccgacccgttcctcccgtacccgacccttacccgaaccgaccgggtaccctacggttcccgttccccgtttccccgtccggtccccctaccccttacccgtaaccacggtaaccgccccgtaaccggtccgggttaccggggaccacggtcccgggtcccgggtacccgggtcgggtacccttcgggtcccggttacggtaaccgggtaaaccggttaccttaacccttcccgtacgtttaccctaacgtaacccggttcggaacggacgggtcccgggtcggtaacggg

SEQ ID NO: 78821 - DNA, 809 bp, Homo sapiens
  misc_feature: GYAE6OF01CXPVL.37.26.C04.1.454.CMB.1.raw
  modified_base (151)..(151): a, c, t, g, unknown or other
  misc_feature (151)..(151): n is a, c, g, or t
  modified_base (438)..(438): a, c, t, g, unknown or other
  misc_feature (438)..(438): n is a, c, g, or t
  modified_base (474)..(474): a, c, t, g, unknown or other
  misc_feature (474)..(474): n is a, c, g, or t
  modified_base (804)..(804): a, c, t, g, unknown or other
  misc_feature (804)..(804): n is a, c, g, or t
tcagtagtgtagatcacgaccggtgctcgatttagtctagcgactttgggtttgggggaggcttggtacaggccgggggggtccctgagactctcctgtgcagcctctggtttcacttctttagacaactacgccatgagcgtgggtcccncgaggctccggaagggagggctggaggtggtctcgaggtacttagtggtagtaggtaactaccgctaattacgacgcaacgtaccgttccggtagggaaccgggtcccgttaccgaacccggttccaccgaaaggacaaactaaacgtttacccgaaaagtaacgtacggttcctaagtaccgttaagggaaatacgaaaaccgtcgtaccgaaggaacgaacggaccggtaacgaaccgtaccccgtaccctttcgttaaacgttacgtgggtacgtaaccggaanaggtaactacggaaggaaggtaaccgttaagaacgngtaacggtcaacgtcctagtacgaacgtcgggaacggacccgaacgtacgtgtacctcccgtactcgactaccgcccaaccgaccgacgaccgtaccgttccgtcccgttaccgttccgaccgtaccccgtaccctacccgtaaccgtaaccgaccgtaccgtaccggtaccgggtacggaccgaccggaaccggcccggtaccgtaccggggggggtacctaccggtccgttacggtacccgtaaccgtaaccgtacccgttaaccgacgttaacccgtaaccgtaccgtaacgcggaccggtcgggacgtaccggacgacgacgacgngtacg

SEQ ID NO: 78822 - DNA, 756 bp, Homo sapiens
  misc_feature: GYAE6OF01E12BS.37.26.C04.1.454.CMB.1.raw
  modified_base (245)..(245): a, c, t, g, unknown or other
  misc_feature (245)..(245): n is a, c, g, or t
  modified_base (326)..(326): a, c, t, g, unknown or other
  misc_feature (326)..(326): n is a, c, g, or t
tcagtagtgtagatcacgaccggtgctcgatttagtctagcgactttgggtttgggggaggcttggtacagcctgggggggtccctgagactctcctgtgcagcctcttggtttcatctttagcaactacgccatgagcgtgggtccgccaggcctccgaaggggaaggggctgggacgtgggtactcgaggttattaggtggtaagtggtagtgcaacaggtacttacggctagaccttccggnggaacgggccgttccaccattccaccaaggacactaacttccaacacgctacgtctagtatttcgactaacatacgaaacncgtcctggaacggacgaccgggaaggaccgaacggacaattaacttattagttggtacggtacctttaaaccttttctttagtacgtttaggtttaacttaccgttaccccgtagttaccgaccgttacggccggggtaccgtaacccgggaacccttcggtaccccgtacccggttcccttaccctcgaacccgtacctacccgaacccggaaccggccctacgtcccgttaccccttcccgtacgtcccaccccgtacctccgaacgtaccgtaccgtcccggtcggtcgggacccaacggcccgggtcccggtcccggtccgggtcgttacggtacccgttaacggtaccgaacgtacccttcgttacctacctaccgtacctacggacgtcgggacgcgggtcgtacggacgtacggcctgtaacg

SEQ ID NO: 78823 - DNA, 923 bp, Homo sapiens
  misc_feature: GYAE6OF01CDOG2.37.26.C04.1.454.CMB.1.raw
  modified_base (216)..(216): a, c, t, g, unknown or other
  misc_feature (216)..(216): n is a, c, g, or t
tcagtagtgtagatcacgaccggtgctcgatttagtctagcgacttttgggtttgggggaggcttggtacagcctggggggtccctgagactctcctgtgcagcctcttggtttcatctttagcaactacgccatgagctgggtccgcccgaggctccgaggggaaggggctgggagtgggtctcaggttattacgtgggtagtggtaactaccgnactactacgcagacctccggtgaccggggtccggttcacccgttctacccgagagaacctaattaccaaagtaactaccggtctaagtctaggaaactagaaaccacggcctaggaagacggaccggaacggaccgtaccggaccccttacgttaacgttttaccgtggttaggaccgaaggagtaacgtaccgaaggaaaccgggtaagtttaacgaaggccgaacggctaacgtcttacgtcgtaaccgtacggtacggggacccaaccgggtaccccgttggtacccgtacccgtttcctacccgttccgaaccgttccccgtaaccccgtaaccgggaaacccggggtacccccttaaccggtttccccgggttacccccgtttccccccggttaccggtaccccctaacccccggttacccctaacccgggtaaacggtacccggtaccctaaccccgggttccgggtaccggggaacccgaaccccggacggggttcccccgggtccccggttcggggtaccccgttccgggtacccgtttaccgggtaaaccgtaacccgggttaccccgttaacctttaccccgtaaacccgttaccgttaaaccccgtaaccgtttaaacccggttcgggaaacccgggttcccggggtaccggttaacggggacccggtaaacggtaccccggtagtaaccggtacg

SEQ ID NO: 78824 - DNA, 851 bp, Homo sapiens
  misc_feature: GYAE6OF01C9Y9F.37.26.C04.1.454.CMB.1.raw
tcagtagtgtagatcacgaccggtgctcgatttagtctagcgacttttgggtttgggggaggcttggtacagcctggggggtccctgagactctcctgtgcagcctctggtttcatctttagcaactacgccatgagctgggtccgccaggctccgagggaagggctggagtgggtctcaggtattacgtggtagtggtaataccgcatactacgcagacctccgtgaccgggtcccgtttccaccggttcctaccagacgaacaatttcccgaaaaggtaactacggttctatacgtaaggaaataggaaacagacccgtggaagaccggccggaaggacccgacccgggtaccccttagttaactttaaccgttgggtacggaccgggaaagagtacgtacgtaacgggaacgggtagtaacggtaacgacgtaacgccgaggtcctttacgtacgtaaacgttaccggggtccggggaaccccgtaaaacccgggtaccccgtttccggtacccgtaccccggttacccttccccgtacgacccggtacccccgtaccccgaaccccggaaacccgggtcccccttaacggtcccccggttttacccccgtttccccccgggtaccggtcccccctaacccccgttccccgtaacccgaaacccggaccgtaccccgttacccggttccgggtaccgggggaccctaccggaccgggtcccgggtaccccggtgggtccgtccgggtaccgttacggtaccggtaaacggtacccttcctaccttactacgttaaccgacttacggtcgggcgggtccgtacggtcggacgaccggacgcgtagtacg

SEQ ID NO: 78825 - DNA, 736 bp, Homo sapiens
  misc_feature: GYAE6OF01DR8OR.37.26.C04.1.454.CMB.1.raw
  modified_base (217)..(217): a, c, t, g, unknown or other
  misc_feature (217)..(217): n is a, c, g, or t
  modified_base (297)..(297): a, c, t, g, unknown or other
  misc_feature (297)..(297): n is a, c, g, or t
  modified_base (360)..(360): a, c, t, g, unknown or other
  misc_feature (360)..(360): n is a, c, g, or t
  modified_base (729)..(729): a, c, t, g, unknown or other
  misc_feature (729)..(729): n is a, c, g, or t
tcagtagtgtagatcacgaccggtgctcgatttagtctagcgactttgggtttgggggaggcttggtacagcctggggggtccctgagactctcctgtgcagcctctggttcattctttagcaactacgccatgagcgtcgggtccgccgaggcctaccgaggggaagggcgtgggaggtgggtctcgtaggtattacgtggtagtggtaataccgnatactacgcagacctccgtggaccgggtccgttaccgacccgttctaccagagaacaacttaccgaaagtaattacggtntacgagtaggaaattagaaccagcctgagacgacggacgaccgaccgtccttagtaatttcgngtcgacgagagactagaggacggtagaagtacgacgagacacgtctgtacgaacgttacggtccgggaacccgtaaaccgggtaccctcggaccgtacccgtcccgtaccgtcaacccgtccctaacccgtaacggacccgggtaaccttacggttcccgttacccccgttcccgtccggtaacccctccccctaccgtaaccgaaccgtccgacccgtacccggttcggccgggaaccctacgaccggtcccgggtacggtccgggtccgtcccggtacgtacggtaaccgtaacggtaccctttacgtaccgactaccgtaaacctacgttaccggtgggaccgtcgggactaggaacgcgggtacncgtgagg

SEQ ID NO: 78826 - DNA, 848 bp, Homo sapiens
  misc_feature: GYAE6OF01DNQKC.37.26.C04.1.454.CMB.1.raw
  modified_base (568)..(568): a, c, t, g, unknown or other
  misc_feature (568)..(568): n is a, c, g, or t
  modified_base (726)..(726): a, c, t, g, unknown or other
  misc_feature (726)..(726): n is a, c, g, or t
  modified_base (810)..(810): a, c, t, g, unknown or other
  misc_feature (810)..(810): n is a, c, g, or t
  modified_base (818)..(818): a, c, t, g, unknown or other
  misc_feature (818)..(818): n is a, c, g, or t
  modified_base (842)..(842): a, c, t, g, unknown or other
  misc_feature (842)..(842): n is a, c, g, or t
  modified_base (846)..(846): a, c, t, g, unknown or other
  misc_feature (846)..(846): n is a, c, g, or t
  modified_base (848)..(848): a, c, t, g, unknown or other
  misc_feature (848)..(848): n is a, c, g, or t
tcagtagtgtagatcacgaccggtgctcgatttagtctagcgacttttgggtttgggggaggcttggtacagcctggggggtccctgagactctcctgtgacgcgtccttcgtttcgtttactacttttacgtttacaacctaaccgtaccactagtggcgtcgggttccgggccccgacggacgtccgtacgggaagggggacggtcggtagggtgggttcggtctacggtagtttaacgttacggttagggttaggtaagtaacctaccgtataaccgttaaccgacgacgaaccgtacccggttccgggtaccgggtcccgggttacccgttaccgtaccgttaccctaacggaaacgaaccgtaaaccttaaccgttaaacgaaaagttaaacggttacggttacttaccgtaaggttaaaaagtaacgtaaacgaaccgtcgtaccgaagggacggaaccggacgggaaccgaaccccgggttccccgttaccctttaagttaacggtttcgtagggaccggaacgaagtacgtacgaacggaaaagggcgttaaaatcgacncgagtcaccgtctaacggacgtaaccgggtacgggacgtaaaccgtacccgggtaccgtacgtacccctcctctcccgaaccgaccctacccgaccgaaccggacccgtctacccgttccccgtacccttcccggcctaccctacctacacggaaccnccgtcgtaccggcggacgaccgcgaccggccgtcggcgtcgtcgtcggtacgagaccttacctcaaccttcaaccgtaccgttntaccgggngacgggtccgaagccggaacgcgntacngn

SEQ ID NO: 78827 - DNA, 711 bp, Homo sapiens
  misc_feature: GYAE6OF01EAU52.37.26.C04.1.454.CMB.1.raw
  modified_base (278)..(278): a, c, t, g, unknown or other
  misc_feature (278)..(278): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtggtctcaggtattactggtagtggtaataccgcatactacgcagacctccgtgaccgggccggttcaccatcctccagggacaattccaagaacacacctgtctctnacaaatgaacacgcctagagagtcggaggacgacggtaccttagttactttacgtgttggaggaacgggtaccctactacgtaccccttaagtagacgacggccggtcgtcggtccgttggtttaacttcggaaccgtacggtcggggcccgtaacgggaccccgtggtccgtacccgtcctaccctcgaccgtccctaccccaaacccgaaccgggcccctacgttccggttcccccttcccccgtccgacccctcccctacccctaaccgaacgtaccgccctaacccgtccgggtacgggaccacgacggcccggtacccgttcggcctccggccgtcggtaaccgtaaccggtccttaccgttacccgtacttaccctacgtaaacctacgtaggaccgggtcggtacggtacggaccggcgcgtaacg

SEQ ID NO: 78828 - DNA, 826 bp, Homo sapiens
  misc_feature: GYAE6OF01C0FFR.37.26.C04.1.454.CMB.1.raw
  modified_base (135)..(135): a, c, t, g, unknown or other
  misc_feature (135)..(135): n is a, c, g, or t
  modified_base (530)..(530): a, c, t, g, unknown or other
  misc_feature (530)..(530): n is a, c, g, or t
  modified_base (735)..(735): a, c, t, g, unknown or other
  misc_feature (735)..(735): n is a, c, g, or t
  modified_base (814)..(814): a, c, t, g, unknown or other
  misc_feature (814)..(814): n is a, c, g, or t
  modified_base (819)..(819): a, c, t, g, unknown or other
  misc_feature (819)..(819): n is a, c, g, or t
  modified_base (824)..(824): a, c, t, g, unknown or other
  misc_feature (824)..(824): n is a, c, g, or t
tcagtagtgtagatcacgaccggtgctcgatttagtctagcgactttgggtttgggggagcttggtacagccgtgggggtccctgagactctcctgtgcagccttctggttctctcttagttacacctaccgacnctgtagcgtcggtcgcccgcgtacgtccgacgggaggggacggtcggtaggtgggttcgtactaggttagtttacgttaggttaggttagttaacgtaaccgtccgaagttaacctaccgtaccgagtaaccggtccggtccggtaacccgggggtccggttccccgttaacccggttaccttaccccgagaacggtaactaaccttaacgtaaacggaaacgttaaacggtccgttaacgttactaaacgggtaaacgttaggaaaccgtaacggaccccgttaggaccgggtacggaacccggacgggaaaccgtacccggaccccgtttacttagtttacctacggttggaccgtaaggataactacggacggtaacgggacgttacgaacnggacctagcgttacgtcgtacgtacgtccgggtacgaccgggtacccaaccgttccgggacttccgtaccccgtcacccctacggacccgtacccgtaccggacccggtaccccgaccgttccgtttacccccgtcccgttcccgtaccgtcccctaccctaccgaacggtacctcaccgttcgggcggaccgacgccggtaccnccggtcggacgtcgtccgtacggactaacggtacttcgtccagttaccgtacgtactcggtagccggacgtgacggacnggtancgtancg

SEQ ID NO: 78829 - DNA, 797 bp, Homo sapiens
  misc_feature: GYAE6OF01CRR4D.37.26.C04.1.454.CMB.1.raw
  modified_base (513)..(513): a, c, t, g, unknown or other
  misc_feature (513)..(513): n is a, c, g, or t
  modified_base (521)..(521): a, c, t, g, unknown or other
  misc_feature (521)..(521): n is a, c, g, or t
  modified_base (529)..(529): a, c, t, g, unknown or other
  misc_feature (529)..(529): n is a, c, g, or t
  modified_base (669)..(669): a, c, t, g, unknown or other
  misc_feature (669)..(669): n is a, c, g, or t
  modified_base (690)..(690): a, c, t, g, unknown or other
  misc_feature (690)..(690): n is a, c, g, or t
  modified_base (792)..(792): a, c, t, g, unknown or other
  misc_feature (792)..(792): n is a, c, g, or t
tcagtagtgtagatcacgaccggtgctcgatttagtctagcgacttttgggtttgggggaggcttggtacagccgtggggggtccctgagactctcctgtgcacgccttcgtggtttcaattctttaacgcaaacctacgcctagtggagcggttcgggtcccgccgagggtcccgtaccggaagggggtaaggggccgtaggggtaggttcggggttcctacggttaaggtttactttaaccggttggggttaaggtaggttaaactaccggctaacgtaccgtacggacacggtacccgtccggtagggacccgggttccgttaccgaccgttccacggaaagacgtaacctaagtaccaaaggtaacgtacgttctactaggtaaggtaaacgtacgactacggccgtaggaccggacgaccggaaacgggtacccgccccggtacccttagttacgtttcgtacggtcggaacgtaagaacggtacgtacggaacgggtaacgggtaanaccggtanacgaccgngacgtcgtacgacggtacgtacgggaccgggtccgaacccgtcgtacgtccgcttccaccgtcgaccgtccgaaccgtaaccgccggtacctccggtcccgttccccgtaccgccgtacccacccgtcgaccgtagtccncccggtagccgggtcgtaccncgggtccgccggtccggcgtaccgcgtacggtacgtacgtaccgttaacctccgtacttaccgacgtacctgacgtacgcggccggtcgaggtaccgagcgngatcg

SEQ ID NO: 78830 - DNA, 735 bp, Homo sapiens
  misc_feature: GYAE6OF01AF1KB.37.26.C04.1.454.CMB.1.raw
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
  modified_base (377)..(377): a, c, t, g, unknown or other
  misc_feature (377)..(377): n is a, c, g, or t
tcagtagtgtagatcacgaccggtgctcgatttagtctagcgacttttggggtttgggggaggcttggtacagcctggggggtccctgagactctcctgtgcagcctctggtttcattctttagcaactacgccatgagctgggtccgccgaggctccgaggggaagggctggagtgggtctcaggttattacgtggtagtaggtaactaccgcatactacgcagactccggtggaccgggtccgttcaccgtctccgagacgacaacttaccaaagtaagtacggtctagtcgtaggaaatgaacncgtcctaggaacggacggaccggaggaccgtaccggtccccttnttaacttacgtgtagcgaagagtacncgaggaacggtaagtacagtacacgacacgtctacgtagtacgtacggtcgggacccgtaaccggtacccgttcggtacccgtaccgttccgtcctaccgacgtacccctccgaaccggaccggcccgttacgtcccggtttcccctacccggtcgtcccctacccctcctaaccgaacgtcctaccggtaccgttccggggacgggtaccccacggtcccgggaccgggtcccggtcgggtcttccgggtaccggttaccggacgtaaccgtaccgttcccgtactaactaccgtacctacggtacgtcgggacccggtcgggacggttaccgggacggtagccggtaacttggacg

SEQ ID NO: 78831 - DNA, 773 bp, Homo sapiens
  misc_feature: GYAE6OF01CZ84W.37.26.C04.1.454.CMB.1.raw
  modified_base (307)..(307): a, c, t, g, unknown or other
  misc_feature (307)..(307): n is a, c, g, or t
  modified_base (731)..(731): a, c, t, g, unknown or other
  misc_feature (731)..(731): n is a, c, g, or t
  modified_base (773)..(773): a, c, t, g, unknown or other
  misc_feature (773)..(773): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggcctccgaggggaaggggctggagtgggtctcgaggttattacgtggtagtggtaataccgcatactacgcagactccgtaggaccgggtccggttcacccgtctccgagacgacaattaccaaagtaatacggtctattcgtaaggaaatagaaccngtacctgagacgccggaaggaccgccgtccccttattagtttaccgtgtggacgaaggagactacggaaggaacggtagtaacgtagcgtacgacgtagtcctcgttcggtaacgttaccgggtaccgggggaccctaaacccgggtaacccgttccggtaacccgtcccggttacctcccgttacgacccgtacccctaaccccgaaccggaacccggtccctacggttaccccggtttcccccttccccggacgtccccttaacccccttcccgtaaccgtaaacggcctacccgtccggttacgggccggggacctaacggccgggtcccgtcccgggtacgttcgtccgggtcccgttagggtaacccaaacgggtttccccttaccggttacctagtaccccgttaacgacggttacgngggtacccgggtacggtcggtacggaccggtagcgcgtaggn

SEQ ID NO: 78832 - DNA, 996 bp, Homo sapiens
  misc_feature: GYAE6OF01EZRLZ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggttcatctttagcaactacgccatgagctgggtccgccaggctccgaggggaagggctggagtgggtctcgaggttacttacgtggtaagtggtaactaccggcatacctacggcaacgacctccggtggaccggggtccggtttcacccgttcctccgaagacgaacctaattccgaaaagtacttaccggtcttaagtcgtaggtaaaatcggaaacacgcctaggaacggacggacccggaaggaaccgaaccccgggtccccctactttaagtttaaccgttggtacgggaccggaaggacgtaactcgaaacgggtacggtaagtaagtacgacctaaggccgtaacgtccgtaccgtacggtaaccgtacccgggtacgggggaccccctaaccgggtaaaccccgttcggggttaaccccaccccggtttccgtaccccctacgacccggtacccttaccccgaaaccccgggtaacccgggtcccccgtaacggtttccccccgggtttccccgttttccccccccggtagggttacccccccgtaacccccccggttccccgttaaaccccggaaacgtacccccggtaaccccgttaccccggtttaccgggggttaccccggggggaccctaaccgggtaccccggggtaacccccggggtacccccgggttcggggggtaaccctttcccggggtaacccccggtttacggggaaaccccccgttaaacgggggttaaccccgtttaaccccttttacccccgtaaaccgtttaccccgtttaaaccctaaccccggtttaacgttaaccggggaccgggtttacccgggggacttacccgggggaaacccgaccggggtaccgaacgttaacgag

SEQ ID NO: 78833 - DNA, 759 bp, Homo sapiens
  misc_feature: GYAE6OF01C11MP.37.26.C04.1.454.CMB.1.raw
  modified_base (145)..(145): a, c, t, g, unknown or other
  misc_feature (145)..(145): n is a, c, g, or t
  modified_base (288)..(288): a, c, t, g, unknown or other
  misc_feature (288)..(288): n is a, c, g, or t
  modified_base (678)..(678): a, c, t, g, unknown or other
  misc_feature (678)..(678): n is a, c, g, or t
  modified_base (748)..(748): a, c, t, g, unknown or other
  misc_feature (748)..(748): n is a, c, g, or t
  modified_base (753)..(753): a, c, t, g, unknown or other
  misc_feature (753)..(753): n is a, c, g, or t
  modified_base (756)..(756): a, c, t, g, unknown or other
  misc_feature (756)..(756): n is a, c, g, or t
  modified_base (758)..(759): a, c, t, g, unknown or other
  misc_feature (758)..(759): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccnccaggctccgagggaagggtctggagtgggtctcgaggttattacgtggtagtaggtaaatacccgcattacacgcagacctccggtgaccgggccgttcaccgttcaccgagacgaactattaccaaagtaaccagtccttntaacttctagaaccaaagtacgaacacgtcctagacgacgaccgaagaccgtacggtaccgtataagtttacgtggtagttaaggaacggtcggtaggggaggttacgggggactacgggtacggggaccgtaacgggtaacccgttgggtacccaccggtttactccgtacgaccggtaccctaccgaaaccggaccggggttaccctaacggttcccggttccctttcccccggtaaggccccctacccccgttaaccgttacccaagggtacccacccgtacccgtacgggtccgggaccgttaccgaaccgggttccccggcccggtcgggtcccgtcggtacccggttgggtaacccaacggttaccttaacccttccgttaacncccgttaaccttacgtacggtacgccgggttcgcggttaacggcgaaaccgggtttcacgttaagcgcgnttcangcngnn

SEQ ID NO: 78834 - DNA, 826 bp, Homo sapiens
  misc_feature: GYAE6OF01D5RM2.37.26.C04.1.454.CMB.1.raw
tcagtagtgtagatcacgaccggtgctcgatttagtctagcgactttgggtttgggggaggcttggtacagcctggggggtccctggagactctcctgtgcagcctctggtttcatctttagcaactacgcatgagcgtgggtccgccaggctccgaggggaagggctggaggtgggtactcaggtattacgtggtagtaggtaactaccgcatactacgcacgacgtccgtggacgggtccgttcaccgtctccagacgacaacttaccgaagagtacggtctatcgtaggaatacgaacagcctagaggacgaccggacggaccaccggtcccttcttaagtttaccgttggtcggacggaaggaagactacggaacggtaaaccgggtattaacgtaacggcgtaaggtccgaacgtcctcgtaacgtaaccgttaacgggtccgggggaccccgtaaacccgggtaacccgttccgggtacccgtaacccgttcccgttaccgtaccgtaccgtacccgttacccgaacccggaaaccccggggtaccctacggttccccgggtttaccccgttccccgtaccggtacccctaacccccgtcctaacccggtaacgccggtaccgtaacccgtcgggtaccggggtaccaaccggtaccgggtcccgggtccgtccgggtcgtaccggttccgtagggtacccgtaaacgtacccttacccgttaccgacgttacgtaaaccgtaccgttaccgggttacgggacccggggacccggggttaccggtccgggaacggtacccgggcgtaaccgttaaggcgg

SEQ ID NO: 78835 - DNA, 889 bp, Homo sapiens
  misc_feature: GYAE6OF01CIHGA.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcattctttagcaactacgccatgagctgggtccgccaggctccgagggagggctggagtgggtctcaggtattacgtggtagtggtaactaccgctatactacgcagactccggtgaccgggccgttcaccgtctccagagacaattccaaagtatacggtctatcgtaggaaatgaacagcctaggaagacgccggaaggaccaccggtccccttattattacgtggtcgacggtaggagtactacgaacggtaacgggaagttaactacggccaacggtcgaacggtctttaccgttacgggaaacccgttaacggtccggggggaaccccctaaaccggggtaaacccccgtttcgggtaccccgtaacccgtttcccgttacccgtaccgtaaccggtacccccgttaacccgtaaaccccggtaaacccggggtacccccttaacccggtttcccccggggtttacccccgttttaccccccggtcccgggtaacccccttaacccccccggttaccccgttaaaccccgtaaaccggtaaacccgtaccccgttaacccccggtttccggggtacccggggggaccctaaccgggtaccgggtccccgggttaccccggtcggggtaccgttccgggtacccgttacgggtacccgtaaacgggtaccccttaccgttacccgttaacgttcccgtaaaccggtaccttaaccggtcggggtaccgggtccgggtaccgtcgggtaaccgaccgggtccacgtaagtacgg

SEQ ID NO: 78836 - DNA, 814 bp, Homo sapiens
  misc_feature: GYAE6OF01BB7DR.37.26.C04.1.454.CMB.1.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
  modified_base (342)..(342): a, c, t, g, unknown or other
  misc_feature (342)..(342): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctggagtgggtctcgaggtattacgtggtagtggtaataccgcattactacgcagactccgtgacgggcgttcaccgtncaganactataccaagtaactcggtctatcnggtaaatgaacngcngagacncgagacncggcctntagttacgngtcgcgagagtatacgtaacggnggaacttagtagcgacggaccgtaagccgttactagtaccgtacgggtcgggggtaccccgtaaaccggggtaaccccgtgggtttaaccccgtaaccccgttctaccccggtttaccgacccggtacccctttacccgaaaccccggtaaaccccgggggtacccgtaacccggtttccccggggtttcccccccggtttacccccgttccccggggtaaccccggtccccgtccgtacccgttacccggtaaccgggtaccgtaccgacccgttaccggaaccggacgacccgtaccggaacggtcccgggtaccccgggttcgggacccgttggtacccccggttaacgggtaccggtaaaccgggttaaccccttaccttaccccgtacgttacccgttaacccttaccgtacgttaccggggtacgggtacccggttacgggacgggtaaccggcggacgggtaccg

SEQ ID NO: 78837 - DNA, 806 bp, Homo sapiens
  misc_feature: GYAE6OF01BLASF.37.26.C04.1.454.CMB.1.raw
  modified_base (801)..(801): a, c, t, g, unknown or other
  misc_feature (801)..(801): n is a, c, g, or t
tcagtagtgtagatcacgaccggtgctcgatttagtctagcgactttggggtttgggggaggcttggtacagccgtgggggggtccctgagactctcctgtgcagcctctggtttcatctttagcaactacgccatgagcgtgggtccgccaggcctccgaggggaaggggctggagtgggtctcgaggtattacgtggtagtgtaataccgcatactacgcagacgttccggtcggaccgggtccgttacacccggttctaccgaagacgaacctaacttaccgaaagtaactacggttctagtacgtaaggtaaatacgaaacacgtccgtaggaacggacgccggaaggaccgaccggtcccttacgttaatttaacggtggtcggacggacggagtactacgaacgggaacggtaattagacgcgaagcgtacgtactcgtacgtaacgtccgggtccgggaacccgaacccgggttaccctcggggtaaccctacccggtcctacccgtaccgaccctcccgtaccccgaacccggtaacccgggtacccctacggttccccggttcccccgttcccccggtaccgtaccccgtacccccgtaccctaacccgaacggtcccgacccgtacccggtccgggtaccgggaccgacccggtaccggccggtccccgggtacgggtcccgtaccgtcccggtacggtacccggtaacgtcccttaccgttacctacgttacccgtaccgtagttaccggtcggaccgggtccgggacgttcggaacggacggccgaagngtacg

SEQ ID NO: 78838 - DNA, 699 bp, Homo sapiens
  misc_feature: GYAE6OF01E035E.37.26.C04.1.454.CMB.1.raw
  modified_base (204)..(204): a, c, t, g, unknown or other
  misc_feature (204)..(204): n is a, c, g, or t
  modified_base (287)..(287): a, c, t, g, unknown or other
  misc_feature (287)..(287): n is a, c, g, or t
  modified_base (348)..(348): a, c, t, g, unknown or other
  misc_feature (348)..(348): n is a, c, g, or t
tcagtagtgtagatcacgaccggtgctcgatttagtctagcgactttgggtttgggggaggcttggtacagcctggggggtccctgagactctcctgtgcagcctctggtttcatttttagcaactacgccatgagctgggtccgcaggctaccagggaagggctggagtgggtctcaggtattactggtagtggtaataccgnatacacgcagactcgtgacggccgtcacgatctcagagacaacttccgaagaacaccacgtctactccgagacaactgaaacncgcctagataccgtagacggacgacgctgtatactcacgtaggtgacgaacgtaggggttnagctgacgagcgtaggtagtgtagttggttactaagttacgagggtacgaagggtactaggtcgtaccgacgttcctacgtactaccggacctacccggtaccgtaacccggttacccgtcgtacccgtttaccccttccccggtacgtacccgtaccctacccgtaccctaacggacctaccgtaacccgtcgggttaccggggaacctaccgggaccggtacccggtccggttacggtaccgtaccggtccgtaccggtacgtaacccggtacttacccgttacgtacgttaaccgtaacccgtacgtaccgtcgaccgggtaccgggtacgtccgaacggtaacccgg

SEQ ID NO: 78839 - DNA, 739 bp, Homo sapiens
  misc_feature: GYAE6OF01B7CMB.37.26.C04.1.454.CMB.1.raw
  modified_base (734)..(734): a, c, t, g, unknown or other
  misc_feature (734)..(734): n is a, c, g, or t
tcagtagtgtagatcacgaccggtgctcgatttagtctagcgactttgggtttgggggaggcttggtacagcctgggggggtccctgagactctcctgtgcagcctctgtttcatctttagcaactacgccatgagctgggtccgccaggctccgagggaaggggctggaggtgggtctcgaggttattactggtagtgtaaactaccgacatactacgcaagcctccggtggacgggtccggttcaccgtcaccgaagacgaactaacttcaaagtaacgtacggtctatcgtaggaaatacgaacacgcctagaacggacgaccggagaccgaccggtcccttacttacttacgtggtacgacgaagaagatacggaacggacggtaagtaacgtagaccgaacgtacgacgtcttcggtaccgtaacgtacccgggttcgggacccgtaactaacggtaaccccgttcgtaccgtacccggtcctcccgtacgaccgtacccctacccgaaccggaccggaccctacgtccccggttccccctacccggttccgacccctacccctaccgtaccgaaccgtaccaccggtacccgtaggggtcccggaccgttacggaccggtcccggtaccgggtcgtcgtacccggtacgtacgtaaccgtaaccggttacctacccgtacgtacctaccgtaactacggttcgacgacggcggtacgacggacgtcgncgtag

SEQ ID NO: 78840 - DNA, 892 bp, Homo sapiens
  misc_feature: GYAE6OF01DDT87.37.26.C04.1.454.CMB.1.raw
  modified_base (149)..(149): a, c, t, g, unknown or other
  misc_feature (149)..(149): n is a, c, g, or t
  modified_base (170)..(170): a, c, t, g, unknown or other
  misc_feature (170)..(170): n is a, c, g, or t
  modified_base (235)..(235): a, c, t, g, unknown or other
  misc_feature (235)..(235): n is a, c, g, or t
  modified_base (891)..(891): a, c, t, g, unknown or other
  misc_feature (891)..(891): n is a, c, g, or t
tcagtagtgtagatcacgaccggtgctcgatttagtctagcgacttttggggtttgggggaggcttggtacagccgtgggggggtccctgagactctcctgtgcagcctctggtttcatctttagcaactacgcatgagcgtgggtccncagctccgagggagggctggngtggtctacgagtatttacgaggtagtaggtaactaccgctataccgtacgacagaccttccggnggaccggggtcccgttcacccggttctaccgaaggacgaactaaacttaccgaaaagtaacgttacgggttacttaagttttaaggtaaaaattcggaaactacggtccttaaggaaacggtacggaacccggaacgggaaccgaacccggtcccccttactttaacgtttacgtggtacggacgtaaggtaacgaacgtaccgaaggggtaaccggtaagttaactaacgccgaaagccgacgttaccgttgtaccggtaaccgttaaccggggtcccggggaaccccgtaaacccgggtaccccgttcggtacccccttacccgttcctaccccgtcgaacccgtaccccctaacccgaaccccgggtaacccgggtcccccgttaaccggttcccccggtttcccccgttacccccgtcccgtaacccccgttaacccccttccccgtaaccgaacggtaccctacccgtacccggtccgggtaaaccgggccacggtacccggtacccggtccgggtaccgggtcccgtacgtccggttaaccggtaccggtaaccgttacccgtttaacccgtaccgttacctaaccgtaaccgtacgttaacgggtccggacggggaccgtcgggtacggaccggaacgtacgactgcgng

SEQ ID NO: 78841 - DNA, 666 bp, Homo sapiens
  misc_feature: GYAE6OF01AGTXL.37.26.C04.1.454.CMB.1.raw
  modified_base (196)..(196): a, c, t, g, unknown or other
  misc_feature (196)..(196): n is a, c, g, or t
  modified_base (256)..(256): a, c, t, g, unknown or other
  misc_feature (256)..(256): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctgggagtgggtggccaacagtaaaggggnggtggtggtaacgaaaaactatggtggactctgtggcggggccgattcacatctccaganacaacgaccaaaactcactgtatctgacaaagtcggaccggcctagagacgtccggaggacacggctggtgttattagtgtcgacgagagtatttagactacgtaaagtttcgagtgacgtggtatgtatgtacttagtcgtactaccggtgggggaccctaacgggaccagttcggtcctaccgttctctcaccgtcctacccgacgacggccctacgttcccggtcccttccccgtcggccctacccctccctacgtaacgccgtacctaccggtcccggcggggtaccaccgaccggtcccggtcccggtcgggtaccttcggaccgttacggaccgtaaccggtccttaccgtacctacttacccgtaactaccgtacggcggtagggaccggtgtcgggaaccgg

SEQ ID NO: 78842 - DNA, 1198 bp, Homo sapiens
  misc_feature: GYAE6OF01B4VW1.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggattcaactttggtagctattggatggactgggtccgccagtctccgagggaagggctggaggtgggtggccaacagtacgagggaggtgggtaggtaacgaaaaactgtggtaggacttcgtggtggccgggggccgtattaccgaccgattcctaccgaaggacgaaccaaaccgaaccctaaaaactcctacgttagtactccgtagaacgtaaggtcgggaccggtacgtaggacgaccgtaccggaacggaccgtacggtcgttggttagtttagttttaggttaggtacggacggtaaggtaacgttaactttaacggtaaaccgttaaacgttaacggtttacgtaaggttacggtacgttagggtacgttagtacgtttacggttacgtttacgtacggtaaccggttacccggggttaaccggggtaaacccggtaaaccggggtacccgtaacgggtttacccgggttacccgtttacccggtttacccgtttacccggtttaacccgtaaccccggttaaccccccggttaacccccgggtaaaacccccggggttaaccccggggttacccccccgtttaaccccgggggttttacccccccccggtttccccccccgggtttttacccccccccgggttaccccggggttaccccccccgtttacccccgggttaccccgggttaaccccccggggttaaccccccggggtaaaccccggggtttaaaccccccgggtaaccccccccgggtttaaaaacccccccccccgggggtttaaccccccccggggggtaaaaaacccccggggggttaaacccccccccggggtaaaacccccccccggggggtttaaaacccccccgggggggtttaaaaccccccccccgggggggggtttaacccccccccccggggggtttttcccccccccgggggggggttttaaccccccggggggtttaacccccccgggggggtttttaaaccccccccggggggttttttaaaacccccccggggggggttttttaaaaaccccccgggggggttttaaaaaacccccccggggggtttt

SEQ ID NO: 78843 - DNA, 1199 bp, Homo sapiens
  misc_feature: GYAE6OF01B3K7B.37.26.C04.1.454.CMB.1.raw
tcagtagtgtagatcacgaccggtgctcgattttagtctagcgacttttggggtttgggggaggcttggtacgagccgtgggggtccctgagaccgtctcctgtcgcacgtcctccttggtttctatttactttacgaccaaactaccgcctatggacgtccggtcggggttcccggacgaacggccgtaccggaaggggggaaacgggccgttcgggaggtttcggggttacctacgtacgtaccttaagtttaaggttaagtaccgggtttagggtaacggaaacggacccgtaacgttaacccggtaaccggtaccgttacggttaccccgttacccgggtaacgggtaaccgggggttcccccggtttaccccggtccccccttaccggttaacccgaacggtaaaaccgaacccgtttaaaaaccgaaccccgtaaaaaccaaaccccggtacgttaccggttcgtttaccccggtttaacggacccgttaaaacccgttaaaaaccgttaaaacccgaccggttaacccggttaagaaacggggtaaacggggtaaaccgggaaaccgggttaacccggtaaccgggttaaccgggtttaaacgtttaacgtttaccgggttaacgggttaaccggggaagggtaaaaccgggggtaacggttaccggtaacggttaccggtaaccggtaccggtacgggttacccgtaaccccttaacccccgtaagttaaaaccttaggttaaacgggtacccgggttacggggtttaaccccgggaaacgggggtaaacggtaaaacccgggtaacgggttccccgggttacggttaccccgttaaacccgtttaccccggtcccgttaacccggtacccgttaacccccgttaaccgaaccccggtaccccggaccccgtttaccccggtttacccgggttccccgttaccccggtaacccgttacccccgtacccccgttacggtaaccccgaacggttaccccgacccggttacccgggttacccgggaaccgggtaacccgacccgtacggggtacccgggttacccgggtccggttcccggtaccgggttaccgttaacggtaaccggttaacggtaacccgtttacccgtttacgttaacccgtttaaccggtacctttaaccgggacccggtttaacgggtccggggtaaccc

SEQ ID NO: 78844 - DNA, 755 bp, Homo sapiens
  misc_feature: GYAE6OF01B2AG7.37.26.C04.1.454.CMB.1.raw
  modified_base (432)..(432): a, c, t, g, unknown or other
  misc_feature (432)..(432): n is a, c, g, or t
tcagtagtgtagatcacgaccggtgctcgatttagtctagcgactttgggtttgggggaggcttggtacagcctggggggtccctgagactctcctgtgcagcctctggtttcatctttagacaactacgccatgagcgtcgggtccgccaggctccgaaggggaaggggctgggagtgggtctacgaggttattacgtggtagtaggtaatacccggcataacctacggcagacctccggtggaccggggtccgttcaccgtctaccagacgacaacgaccaaaatcactgatcgtagacaaatcggacgcctaggaagacgtaccggaggactcggtacttaggtacgttatttagtccgtagacgaagtacgtattacgaacgtaacgtagtttacgagttagtacgtgtatcgtatcgtacttaagtnaacgtaccggtagggaaccgtaacggacctaggtccgtaccgaccgttacctacgttacctacgtacccgtacccgaacccgtaaccgggtaccgtaaccgttcccggttaccccgttcccccggtaaccggtccccgtaccccgtacgtacccgttacggaagggaccccccccccccgtagaccccgtaccggaccggtaccgaccgacgtaccggccggtccggtccggtaccgtaccggttacccgtacggtaccgtacgtaccgtaccgttaccctacgtaccgtacctaccgtacgtacggtccggacgggtaccgg

SEQ ID NO: 78845 - DNA, 829 bp, Homo sapiens
  misc_feature: GYAE6OF01EWOX9.37.26.C04.1.454.CMB.1.raw
  modified_base (213)..(213): a, c, t, g, unknown or other
  misc_feature (213)..(213): n is a, c, g, or t
  modified_base (806)..(806): a, c, t, g, unknown or other
  misc_feature (806)..(806): n is a, c, g, or t
tcagtagtgtagatcacgaccggtgctcgatttagtctagcgacttttgggtttgggggaggcttggtacagcctgggggggtccctgagactctcctgtgcagcctctggtttcatctttagcaactacgccatgagctgggtccgcaggcctccgaggggaagggggctggaggtgggtctcgaggtattacgtggtagtggtaataccgnatactacgcagtacctccggtggaccggggtccgttcaccgtcctccgagaacgactaattaccaaagaagtcggttactattcgtaggaaatgaacagcctggacgagaccggaggaccgaccggccccttagttacgtttacgtggtacggacggagaacgtacgtacggaaggacggtaagttaatacggacacgctacgccttcggtaacgtacggtaccgggtcggggaacccctaaaccggggacccgttcgggtaccccgttaccgttcccgtacccgttccgacccgtccccaacccggaacccggtaacccgggtcccctaaccggtttcccgggttacccccctttcccccggtaccggtaccccgtacccccgttaccaacccggaacggtacccgtacccggtacccggtccgggggttcccgggaacccgccgggtaaccgggtcccccgggtcccggttaggccccgggtttaggacccgggttcggtaaaccggtaacccggttaccctttacccgttccctacccttaacgtaccttaccgttacgggccggaccgggttcgggtacggtaccgggnggtaaacccggtcaccgtaaggc

SEQ ID NO: 78846 - DNA, 1017 bp, Homo sapiens
  misc_feature: GYAE6OF01D233V.37.26.C04.1.454.CMB.1.raw
tcagtagtgtagatcacgaccggtgctcgatttagtctagcgactttgggtttgggggaggcttggtacagccgtggggggtccctgagactctcctgtgcagcctcttggtttcatctttagcaactacgcatgagcgtcgggtccgcaggctcgaggggagggctggagtggtctcgaggtattacgtggtagtagtaactccgatatactacgcagccgtcggtggaccgggtccgttacaccgtcaccgaagacgaactaacgttaccgaaagtaacgttacggtacttaagtaccgtaaggtaaaactacgaaacgcgtaccggtagaacggaccggacccgggaacgaccgtacccggtcccctttagttacgtttacgtgggtacggacggtaggagtacgtacgaacgggtacgggttaaatacgtacggacctacggtaccgaccgttcgtaacggttacgaacccgggttaccgggacccgggggtaacccctaaacccggggttacccggttacgggtacccccgttaacccgtccccgttaccccgtaacggtaccccgtaacccccgtaaccccggaaccccgggaaacccgggttcccccttaacccggggtttcccccccggttttacccccccgtttaccccccgggtaccccgggttacccccccttaaccccccggtttaccggtaaaccccggtaaaaccggtccccggttacccccggttaacccggggtttcccgggggaaccgggtaccccgtaaacccgggtaccccggggtccccgggttaccccggggttccggggtacccggtttccccgggttaacccgggttaacgggttaacccgttaaacccgggttaccccttttaaccccgtacccggtttaaacccgttaaaccttaccccggttaaaggtttaccccggggtagggacccccgggggtacgggtaacccgggtacggtaaccggggaaacccgggttcgtaaccggtgtacgg

SEQ ID NO: 78847 - DNA, 666 bp, Homo sapiens
  misc_feature: GYAE6OF01ENE1L.37.26.C04.1.454.CMB.1.raw
  modified_base (98)..(98): a, c, t, g, unknown or other
  misc_feature (98)..(98): n is a, c, g, or t
  modified_base (150)..(150): a, c, t, g, unknown or other
  misc_feature (150)..(150): n is a, c, g, or t
  modified_base (221)..(221): a, c, t, g, unknown or other
  misc_feature (221)..(221): n is a, c, g, or t
  modified_base (317)..(318): a, c, t, g, unknown or other
  misc_feature (317)..(318): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
  modified_base (546)..(546): a, c, t, g, unknown or other
  misc_feature (546)..(546): n is a, c, g, or t
  modified_base (630)..(630): a, c, t, g, unknown or other
  misc_feature (630)..(630): n is a, c, g, or t
  modified_base (661)..(661): a, c, t, g, unknown or other
  misc_feature (661)..(661): n is a, c, g, or t
tcagtagtgtagatcacgaccggtgctcgatttagtctagcgactttgggtttgggggaggcttggtacagcctggggggtccctgagactctcctgngcagcctctggtttcattctttagcaacctacgccatgacgctcggggtccnccaggctccgaaggggaaggggtctggaggtgggtctcaggttattacgtgggtagttaggtaaataccgntatactacgcaagactccggtggacgggtccgttcaccgtctaccagacgtacaacttccgaaagtaacttacggtctatcgtaggaaatgaaacnnccgtgagacgcgaggaccnccggccttntaattcgngtgacgaggtanactcgaaggacggaattaancgacgaacgcctagtccttacgtagtacgtacggggcggggaacccctaaacccggtaccgtcggtaccacccgttctaccgtcgaacgtcccctacgacgtaaccgcctacgttccgtcccttccccgcggtacccacccgttcaccgaacgcgtaccnccggtgcgggacaccggcgccggccggtcgcgttccgacgtcggactaaccggtcttacctaccacttacctaccacggttacnggaccggtggacggtcgaacggagtcgaagntaacg

SEQ ID NO: 78848 - DNA, 837 bp, Homo sapiens
  misc_feature: GYAE6OF01AJT2U.37.26.C04.1.454.CMB.1.raw
tcagtagtgtagatcacgaccggtgctcgatttagtctagcgactttgggtttgggggaggcttggtacagcctgggggtccctgagactctcctgtgcagcctctggttcatctttagcaactacgccatgagcgtcgggtcccgccgacggcctccgaagggggaagggtcgtgggtacgtgggtctacgacgcctagttagtagtaggtggtaggaacgcgaacgtactaccgctacgaccgttccggtaggaacggggtcccgttcgcccctctaccaggacgaaccaacctaccaaacgaaccacggtcttacgttctcgtacgaaccttaaacgtaacgacgtccgtaggacgaaggaccggaacggtaccgtaccggtacgttaattaacgttacgtcggtacggaacgggtaaagggtacggttctaacgcgtacgtcgtccgttacggtaccctaccgtaacttacgtacgtacggtccggtacggtacgggtacggaaacgtaacgggtaccgtccggtaccggtaccttaccccggtccgtacccgtaccgtacccgtacccgtaacccggaaccgtaccggtaccccgtaccgttcccggttccccgttaccccggacccgtacccctaccccgtaccgtaccgaaccggtaccgaccgtacccggttacgggaccggaccgtaccgggaccggtcccgggtccggtcgggtccgttccggaccgttacggaccgttaacccggtacccgttaaccgttcctaccttaccgtaccgttaccgtacggagggaccggtacggtacggtaaccggtacggcgtaccg

SEQ ID NO: 78849 - DNA, 166 bp, Homo sapiens
  misc_feature: GYAE6OF02IF3RV.37.26.C04.1.454.CMB.1.raw
  modified_base (101)..(101): a, c, t, g, unknown or other
  misc_feature (101)..(101): n is a, c, g, or t
tcagtagtgtagatcacgaccggtgctcgatttagtctagcgactttggttgggggaagaggaagactgaggtcccccaggagttcaggtgctgggcacanggccctgggctgcctggtcaaggacattccatctacactactgacgggctggcaaaggcgcatag

SEQ ID NO: 78850 - DNA, 582 bp, Homo sapiens
  misc_feature: GYAE6OF02G8IXS.37.26.C04.1.454.CMB.1.raw
tcagtagtgtagatcacgaccggtgctcgatttagtctagcgactttgggtttggggaggcttggtccagcctggggtccctgagactctcctgtgcagcctctggattcaactttggtagctattggatggactgggtccgccagtctccagggaagggctggagtgggtggccaacatacagggaggtggtggtacgaaaactatgtggactctgtgcggggccgattcaccatctccagagacaacgccaaaaactcactgtatctgcaaatggacggcctgagatccgaggacacggctgtgtattattgtgcgagagatttagactacaaagtttcgagtgactggtatgatgcttatgataccgtggggccaagggaccatggtcaccgtctcttcagcctccaccaagggcccatccggtccttcccctggcccgtccctgcctccgaggacgccaccctccgagacgccacgacgccggcccgtggggcctcggcccgttcgggtccaaacgggtaccttaaccgtttcccaattacccgttaaccacctttaaccgtcggacggccgggtccg

SEQ ID NO: 78851 - DNA, 170 bp, Homo sapiens
  misc_feature: GYAE6OF02G0J58.37.26.C04.1.454.CMB.1.raw
  modified_base (170)..(170): a, c, t, g, unknown or other
  misc_feature (170)..(170): n is a, c, g, or t
tcagtagtgtagatcacgaccggtgctcgatttagtctagcgactttgggtttgggaagaggaagactgacggtccccaggagttcaggtgctgggcacagcggccctgggctgcctggtcaaggactacttccatctacactactgagcgggctggcaaggcgcatagn

SEQ ID NO: 78852 - DNA, 171 bp, Homo sapiens; identical to SEQ ID NO: 78279
  misc_feature: GYAE6OF02GWEWJ.37.26.C04.1.454.CMB.1.raw
  modified_base (171)..(171): a, c, t, g, unknown or other
  misc_feature (171)..(171): n is a, c, g, or t

SEQ ID NO: 78853 - DNA, 549 bp, Homo sapiens
  misc_feature: GYAE6OF02JF59X.37.26.C04.1.454.CMB.1.raw
tcagtagtgtagatcacgaccggtgctcgatttagtctagcgactttgggtttggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccaacggaaccctggtcaccgtctcctcagcctccaccaacgggcccactcggtccttcccctcggccacccctcctccaaacgacgccaccctcgtcgggggcacgacgccggcccgtgggcctcgccgtggtcaagggactaccttccatctacactactgagcggctggcgaaggcgcatacg

SEQ ID NO: 78854 - DNA, 532 bp, Homo sapiens
  misc_feature: GYAE6OF02HX9HD.37.26.C04.1.454.CMB.1.raw
tcagtagtgtagatcacgaccggtgctcgatttagtctagcgactttgggtttggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcacgtctcctcagcctccaccaacgggcccatcggtcttcccctcggccaccctcctccaacgacgccacctcgtcgggggcacgacgcggccctgggctgcctggtcaaggactacttccatctacactactgagcggctggcaaggcgcatag

SEQ ID NO: 78855 - DNA, 534 bp, Homo sapiens
  misc_feature: GYAE6OF02F5NPR.37.26.C04.1.454.CMB.1.raw
tcagtagtgtagatcacgaccggtgctcgatttagtctagcgactttgggtttggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaacctggtcaccgtctcctcagcctccaccaacggcccatcggtccttcccctcggccaccctcctccaagacgcacctcgtggggccacgacgccggcccgtgggcctcgcctggtcaaggactacttccatctacactactgacgcgggctggcaggcgcatag

SEQ ID NO: 78856 - DNA, 173 bp, Homo sapiens; identical to SEQ ID NO: 78276
  misc_feature: GYAE6OF02I9LPE.37.26.C04.1.454.CMB.1.raw
  modified_base (173)..(173): a, c, t, g, unknown or other
  misc_feature (173)..(173): n is a, c, g, or t

SEQ ID NO: 78857 - DNA, 211 bp, Homo sapiens
  misc_feature: GYAE6OF02F1HAB.37.26.C04.1.454.CMB.1.raw
  modified_base (173)..(211): a, c, t, g, unknown or other
  misc_feature (173)..(211): n is a, c, g, or t
tcagtagtgtagatcacgaccggtgctcgatttagtctagcgactttgggttgggggaagaggaagactgacggtcccccaggagttcaggtgctgggcacagcggcctgggctgcctggtccaaggactacttccatctacgactactgagcgggctggcaaggcgcatagnnnnnnnnnnnnnnnnnnnnnnnnnnnnnnnnnnnnnnn

SEQ ID NO: 78858 - DNA, 579 bp, Homo sapiens
  misc_feature: GYAE6OF02H37CW.37.26.C04.1.454.CMB.1.raw
  modified_base (310)..(310): a, c, t, g, unknown or other
  misc_feature (310)..(310): n is a, c, g, or t
  modified_base (392)..(392): a, c, t, g, unknown or other
  misc_feature (392)..(392): n is a, c, g, or t
  modified_base (570)..(570): a, c, t, g, unknown or other
  misc_feature (570)..(570): n is a, c, g, or t
tcagtagtgtagatcacgaccggtgctcgatttagtctagcgactttgggtttgggggaggcttggtacagcctggggggtccctgagactctcctgtgcagcctctggttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctaatctggaaatgaacagcctgagagccgaggacacggccctntattactgtgcgagagatcagacggagtatagcagcagctctgactactggggccacggaaccctgggtcaccggtctcctnacgcctccaccaacgggcccatccggtcttcccctggcccacctcctccaagtacgccacctcgtcgggggccacgacggccggcccgtgggcctcggccgtcgggtacaacgggtacctaccttacccgactacctacctaaccttacgtgtacgccgggcctcgggccaacgggcnccgatacgg

SEQ ID NO: 78859 - DNA, 523 bp, Homo sapiens
  misc_feature: GYAE6OF02I02X9.37.26.C04.1.454.CMB.1.raw
  modified_base (519)..(523): a, c, t, g, unknown or other
  misc_feature (519)..(523): n is a, c, g, or t
tcagtagtgtagatcacgaccggtgctcgatttagtctagcgactttgggtttgggggaggcttggtacagcctgggggtccctgagactctcctgtgtagcctctgaattcccctttacggcttattggatgagctgggtccgccaggctccagggaaggggctggagtgggtggccaacataaatcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggactgggcggtttcgactactggggccagggaaccctggtcaccgtctcctcagcctccaccaagggcccatccggtcttcccctggccgccctgctccaggagcacctccgagagcacagcggccctgggctgcctggtcaaggactacttccatctaacactactgagcgggctggcaaggcgcatgnnnnn

SEQ ID NO: 78860 - DNA, 174 bp, Homo sapiens; identical to SEQ ID NO: 78297
  misc_feature: GYAE6OF02FMOB5.37.26.C04.1.454.CMB.1.raw
  modified_base (173)..(174): a, c, t, g, unknown or other
  misc_feature (173)..(174): n is a, c, g, or t

SEQ ID NO: 78861 - DNA, 619 bp, Homo sapiens
  misc_feature: GYAE6OF02GN336.37.26.C04.1.454.CMB.1.raw
  modified_base (225)..(225): a, c, t, g, unknown or other
  misc_feature (225)..(225): n is a, c, g, or t
tcagtagtgtagatcacgaccggtgctcgatttagtctagcgactttgggtttgggggtagggcgttaggtacagcctggggggttccctcgagacgtacctcctgtgccagcctctggttcactctttagcaactacgtccatgagcctgggtcgccagggctacctagggaagggtctggagtgggtctcaggtacttacctggtagttggtaactaccgganatacctaccgctagtactccgtggaccgggccggttcaaccggtctcctaaggaacgacctaagttcccaaggtaactaacggtctaatctgggaaatggaacacgacctcgagagccgaaggacacggccctactattactgtcgcggagaggactcgagacggagtactagcaggtcagctctgactactggggccacggaacctggtcaccgtctacctcacgcctcgaccaagggcccatcggtacttcccctggcctaccctcctccaacgacgactacctactggggccacgacgtcggacccgtcggggcctcggccctagggtcaaaggacctaacgttccatcgtaacactactcgagtcgggcttcggcaaggccgtcgatacg

SEQ ID NO: 78862 - DNA, 195 bp, Homo sapiens
  misc_feature: GYAE6OF02JFZKT.37.26.C04.1.454.CMB.1.raw
  modified_base (174)..(195): a, c, t, g, unknown or other
  misc_feature (174)..(195): n is a, c, g, or t
tcagtagtgtagatcacgaccggtgctcgatttagtctagcgactttgggtttgggggaagaggaagactgacggtccccaggagttcaggtgctgggcacagcggccctgggctgcctggtcaaggactacttccatctacactactgagcgggtctggcaaggcgtcatagnnnnnnnnnnnnnnnnnnnnnn

SEQ ID NO: 78863 - DNA, 528 bp, Homo sapiens
  misc_feature: GYAE6OF02GZU1S.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctatactgtgcgagagatcagacggagtatagcagcagctctgactactggggccacggaaccctggtcaccgtctcctcagcctccaccaagggcccatcggtcttcccctcggccaccctcctccaacgacgccacctctggggcacacgcggccctgggctgcctggtcaaggactactccatctacactactgagcggctggcaaggcgcatag

SEQ ID NO: 78864 - DNA, 528 bp, Homo sapiens
  misc_feature: GYAE6OF02H3M0O.37.26.C04.1.454.CMB.1.raw
tcagtagtgtagatcacgaccggtgctcgatttagtctagcgactttgggtttggggaggcttggtacagcctggggggtccctgagactctcctgtgcagcctctggtttcatctttagcaactacgccatgagctgggtccgccaggctccagggaaggggctggagtggatctcaggtattactggtagtggtaataccgcatactacgcagactccgtgacgggccggttcaccgtctcagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttcccctggccaccctcctccaagacgccacctcgtcgggggcacagccggccctgggctgcctggtcaaggactactccatctaacactactgagcgggctggcaaggcgcag

SEQ ID NO: 78865 - DNA, 206 bp, Homo sapiens
  misc_feature: GYAE6OF02HH0XK.37.26.C04.1.454.CMB.1.raw
  modified_base (174)..(206): a, c, t, g, unknown or other
  misc_feature (174)..(206): n is a, c, g, or t
tcagtagtgtagatcacgaccggtgctcgatttagtctagcgactttgggtttgggggaagaggaagactgacggtcccccaggagttcaggtgctgggcacagcggccctgggctgacctggtcaaggactacttccatctacactactgagcgggctggcaaggcgcatagnnnnnnnnnnnnnnnnnnnnnnnnnnnnnnnnn

SEQ ID NO: 78866 - DNA, 512 bp, Homo sapiens
  misc_feature: GYAE6OF02FFSJT.37.26.C04.1.454.CMB.1.raw
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
tcagtagtgtagatcacgaccggtgctcgatttagtctagcgactttgggtttgggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaataccggtctatctggaaatgaacagcctgagagccgaggacacggccctctattacctgtgcgagagatcagacggagtatagcagcagctctgactactggggccacggaaccctggtcaccgtctcctcagcctccaccaggccatcgtctccctgcaccncctccaanagcacctctgggcacagcggccctggctgcctgtcagactacttcatctaacactactgagcggctcggcaggcgcatag

SEQ ID NO: 78867 - DNA, 173 bp, Homo sapiens; identical to SEQ ID NO: 78276
  misc_feature: GYAE6OF02F9H9E.37.26.C04.1.454.CMB.1.raw
  modified_base (173)..(173): a, c, t, g, unknown or other
  misc_feature (173)..(173): n is a, c, g, or t

SEQ ID NO: 78868 - DNA, 598 bp, Homo sapiens
  misc_feature: GYAE6OF02JAM9Z.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggagtatagcagcagctctgactactgtggccacggaaccctggtccaccgtctcctcacgcctccaccaacgggccccagtccggtccttccccctcggcccacccctccctccaacgacgccacctcgtcgggggcacgacggccggcccgtcggggcctcggtccgtcgggtaccgaacgggtaccttaccgttccacgttccttaaccaccttaacctcggacggccggggcgttcgggaccgaacgggccggactaag

SEQ ID NO: 78869 - DNA, 531 bp, Homo sapiens
  misc_feature: GYAE6OF02IMBTV.37.26.C04.1.454.CMB.1.raw
  modified_base (526)..(526): a, c, t, g, unknown or other
  misc_feature (526)..(526): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttcccctggccacccctcctccaacgacgccacctctggggcacacgcggccctgggcctgcctggtcaaggactacttccatctacactactgagcggctggcaaggcncatag

SEQ ID NO: 78870 - DNA, 617 bp, Homo sapiens
  misc_feature: GYAE6OF02IN48G.37.26.C04.1.454.CMB.1.raw
  modified_base (458)..(458): a, c, t, g, unknown or other
  misc_feature (458)..(458): n is a, c, g, or t
tcagtagtgtagatcacgaccggtgctcgatttagtctagcgactttgggtttggggaggcttggtacagcctggggggtccctgagacctctcctgtgcctagcctctggtttcatctttagcaactacgccatgagctggtccgccaggctccgagggaagggctggagttgggtctcaggtatttactggtagtggtaataccgcaagtactacgcagactccgtgacgggccggttcaccgtctccagaggaccaagttccaagactacggtctatctggaaactgaacagccctgtagagcccgtaggacacggccctacgtagttacctgtgtcgacgagagtcagacggagtatagctagcagctctgactacgtgggaccaacggaaccctggtccaccgtctccgtacgacgtccctccaccaacggtccccactccggtcttccccgnggccacccgtcctccaacgtacgcaccctcgtcggggacctacgacgaccggcccgtgggccgtcggcccgtacggtaccgaacggtaccttacgttccgtagtccgtaccgtaccgtacgtcgacgtccgggacgtcgggacgacggcgacgagtacg

SEQ ID NO: 78871 - DNA, 548 bp, Homo sapiens
  misc_feature: GYAE6OF02GXC54.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaacgggcccatccggtccttcccctcggccaccctccctccaacgacgccacctcgtgggggccacgacggccggcccgtggggcctcgccctgggtcaagggactatttccatctacactactgacgcggctcggcaggcgcatag

SEQ ID NO: 78872 - DNA, 528 bp, Homo sapiens
  misc_feature: GYAE6OF02JE3YH.37.26.C04.1.454.CMB.1.raw
  modified_base (522)..(528): a, c, t, g, unknown or other
  misc_feature (522)..(528): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggctatttattactgcgcgagagaaggactgggcggtttcgactactgggggccagggaaccctggtcaccgtctcctcagcctccaccaagggcccatcggtcttcccctggcgccctgctccaggagcacctccgagagcacagcggccctgggctgcctggtcaaggactacttccatctacactactgagcgggctggcaagggcgcagtacgnnnnnnn

SEQ ID NO: 78873 - DNA, 556 bp, Homo sapiens
  misc_feature: GYAE6OF02H5OSE.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcacgcctccaccaacgggccccaagtcggtcttccccctcggccacccctcctcccaagacgcaccctctgggggccacacggccggccctggggcctcgcccgtggtcaacgggacctacttccatctacacctactcgacgcgggctcggcaacggcgcatacg

SEQ ID NO: 78874 - DNA, 537 bp, Homo sapiens
  misc_feature: GYAE6OF02FQATS.37.26.C04.1.454.CMB.1.raw
tcagtagtgtagatcacgaccggtgctcgatttagtctagcgactttgggtttggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaaggcccatcggtcttcccctggccaccctcctccaacgacgccacctcgtcggggccacgacgccggcccgtgggcctcgcctggtcaaggactacttccactctacactactgagcgggctggcaaggcgcatacg

SEQ ID NO: 78875 - DNA, 577 bp, Homo sapiens
  misc_feature: GYAE6OF02HHSFV.37.26.C04.1.454.CMB.1.raw
  modified_base (208)..(208): a, c, t, g, unknown or other
  misc_feature (208)..(208): n is a, c, g, or t
tcagtagtgtagatcacgaccggtgctcgatttagtctagcgactttgggtttggggtagggcttggtacagcctgggggtcctgagactctcctgtgcagcctctggtttcatctttagcaactacgccatgagctgggtccgccaggcgtccagggaagggctgggtagtgggtctcaggttattactggtagtggtaataccggnatacgtacgcaggacgtccgtgacgggccgttcaccgtcgtccagagacaattccaagatacggtctatctggaaatgaactagcctgagagccgaggacacggccctctattactgtgcgagagatcgagacggagtatagcagcagctctgactactgggccacggaaccctggtccaccgtctcctcacgcctccaccaacggcccacgtcggtccttccccgtcggccaccctcctaccaacgacgccaccgtcgtacggggaccacgacggccggccgtcgggccgtcgccgtcggtccgaaggtactacttccattcgtactactactgtacgcgggcgtcggccgtaaggcggacgagtacg

SEQ ID NO: 78876 - DNA, 582 bp, Homo sapiens
  misc_feature: GYAE6OF02I9QST.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccgaagaatacggtctatcttggaaatgaacagcctgagagccgaggacacggccctctattactgtgcgagagatcagacggagtatagcagcagctctgactactggggccacggaaccctggtcaccgtctcctcacgcctccaccacggccccagtccggtccttcccctcggccaccctccctacccaacgacgccacctccgtcgggggccacgacgaccggcccgtgggccgtcggcccgttgggtaccgaacggacctaccttccacttcctaacaccttacgtcgacggccgggcgtcggaccgagggccgcgatacgg

SEQ ID NO: 78877 - DNA, 567 bp, Homo sapiens
  misc_feature: GYAE6OF02GYL9M.37.26.C04.1.454.CMB.1.raw
tcagtagtgtagatcacgaccggtgctcgatttagtctagcgactttgggtttggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtccttcccctcggccaccctcctccaacgacgccaccctcgtcgggggccacgacggccggcccgtggggcctcggcccgttgggtccaaagggacctaccttcccgaactcctaacacctactcgacgcgggctggaccgaagggcgcgatag

SEQ ID NO: 78878 - DNA, 535 bp, Homo sapiens
  misc_feature: GYAE6OF02JBY5L.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcagccattagtagtagtggtggaagcacgtactacgctgactccgtgaagggccggttcgccctctccagagacaactccaacaacacgctgtctctgcaacttaacagcctgagagacgaggacacggccgtatattactgtgcgaaggaagggtctagcagtgcctggtactcccactactatatggacgtctggggcaaaggaatcgcggtcacgtctcctcagcctcaccaggcccatcggtcttccccctggccaccctcctccaacgacgccacctcgtgggggcacgagccggccctgggcctgcctggtcaggactacgttccatctacactactgagcggctggcagcg

SEQ ID NO: 78879 - DNA, 602 bp, Homo sapiens
  misc_feature: GYAE6OF02I6J8E.37.26.C04.1.454.CMB.1.raw
  modified_base (354)..(354): a, c, t, g, unknown or other
  misc_feature (354)..(354): n is a, c, g, or t
tcagtagtgtagatcacgaccggtgctcgatttagtctagcgactttgggtttgggggaggcgttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctcngactacgtggggccacggaaccctggtcacccgtctcctcacgccctccaaccgaacgggccccaagtccggtccttcccctggcccaccctcctaccaagcgccaccctcgtggggccacgacggccggcccgtgggcctcggccgtcggtaccgaaacgggaccttaccttcccgaagttccgtaaccaccttaccgtcggaacggtccggggtccttcgggaccgaacgggtccgacgagtacgg

SEQ ID NO: 78880 - DNA, 527 bp, Homo sapiens
  misc_feature: GYAE6OF02GW2DX.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggaatgggtctcagccattagtagtagtggtggaagcacgtactacgctgactccgtgaagggccggttcgccctctccagagacaactccaacaacacgctgtctctgcaacttaacagcctgagagacgaggacacggccgtatattactgtgcgaaggaagggtctagcagtgcctggtactcccactactatatggacgtctggggcaaaggatcgctgtcacgtctcctcagcctccaccaagggcccatcggtcttccccctggcaccctcctccaagacgcacctctggggcacagcgccctggctgcctggtcaaggctacttccatctacactactgagcggctggcaacgg

SEQ ID NO: 78881 - DNA, 579 bp, Homo sapiens
  misc_feature: GYAE6OF02IBHXV.37.26.C04.1.454.CMB.1.raw
tcagtagtgtagatcacgaccggtgctcgatttagtctagcgactttgggtttgggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaaatgaacagcctgagagccgaggacacggccctctattactgtgcgagagatcagacggagtatagcagcagctcttactactggggccacggaacctggtcaccgtctcctcagccctccaccaacgggcccatcggtccttcccctcggccaccctccctccaacgacgccacctcgtcgggggcacgacgccggcccgtgggcctcggcccgttgggtccgaaacggaccttaaccttccctacttccttaaccaaccttacctggacggccgggctgggccgaagggccgacagtagc

SEQ ID NO: 78882 - DNA, 527 bp, Homo sapiens
  misc_feature: GYAE6OF02IEY1L.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttcccctggccaccccgtccctccaagacgccacctcgtcggggcacagccggcctgggctgcctggcaagctactcatctacactactgagcggctggcaggcgcagtag

SEQ ID NO: 78883 - DNA, 552 bp, Homo sapiens
  misc_feature: GYAE6OF02F0HUO.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcacgcctccaccaacgggcccactcggtccttccccctcggccacccctccctccaacgacgccaccctcgtcggggccacgacgccggcccgtgggcctcgcctggtccgaacggacctacttccatcctacactactgagcggctcggcaggcgcatacg

SEQ ID NO: 78884 - DNA, 536 bp, Homo sapiens
  misc_feature: GYAE6OF02HF3JQ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttcccctcggccaccctccctccaacgacgccacctcgtcggggaccacacgccggccctgggctcgcctggtcaaggactactccatctacactactgagcggctggcaaggcgcatag

SEQ ID NO: 78885 - DNA, 589 bp, Homo sapiens
  misc_feature: GYAE6OF02H85PY.37.26.C04.1.454.CMB.1.raw
tcagtagtgtagatcacgaccggtgctcgatttagtctagcgactttgggtttgggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcacgcctccaccaacgggcccatccggtccttcccctcggccacccctcctccaagacgcaccctcgtcggggcacgacgccggcccgtcgggccgtcgcccgttggtccgaaacgggtacctaccttcccacttaccgtaacctaaccttaacgtcggaacggtccgggcgtcgggaccgtaacgggccgacgagtacg

SEQ ID NO: 78886 - DNA, 530 bp, Homo sapiens
  misc_feature: GYAE6OF02IU80A.37.26.C04.1.454.CMB.1.raw
  modified_base (422)..(422): a, c, t, g, unknown or other
  misc_feature (422)..(422): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctcaccaacggcccatcggtcttccccnggccaccctcctccaagacgcacctctggggcacgagccggccctgggctgcctggtcaaggctactccatctacactactgagcgggctcggcgaaggcgcgatacg

SEQ ID NO: 78887 - DNA, 563 bp, Homo sapiens
  misc_feature: GYAE6OF02I1MHS.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgcctccaccaacgggcccacgtccggtccttcccctcggccaccctccctccaagacgccaccctcgtcggggccacgacgccggcccgtcggggcctcgcccgtcgggtacaacggactactccactccgtacactactgacgcggcgtcggcgaaggcgcgatacg

SEQ ID NO: 78888 - DNA, 548 bp, Homo sapiens
  misc_feature: GYAE6OF02GYNIU.37.26.C04.1.454.CMB.1.raw
tcagtagtgtagatcacgaccggtgctcgatttagtctagcgactttgggtttgggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctccctcacgcctccaccaacgggcccactcggtcttccccctggccaccctccctcccaacgacgccaccctcgtcgggggccacgacgccggcccgtcgggcctcgccgtggtcgaaggactacttccactctacactactgagcggctggcaggcgcatag

SEQ ID NO: 78889 - DNA, 536 bp, Homo sapiens
  misc_feature: GYAE6OF02GZ5WX.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaaggcccatcggtcttcccctggccaccctccctccaacgacgcacctcgtcggggccacgagccggcccgtgggcctgccgtggtcaaggactacttccactctacactactgagcggctggcaaggcgcatag

SEQ ID NO: 78890 - DNA, 604 bp, Homo sapiens
  misc_feature: GYAE6OF02JCCMQ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaaatgaacagcctgagagccgaggacacggccctctattactgtgcgagagatcagacggagtatagcagcagctctgactacgtggggccaacgggaaccctggtccaccgtctcctcacgcctccaccaacggcccatccggtccttcccctcggccaccctcctccaacgacgccaccgtcgtcggggccacgacggccggcccgtcgggcctcggcccgtcgggtaccaaacggtaccttaccgttcccaacgttaccgtaacctaaccttaacgtcgaacggccgggccgttcgggaccgtaacgggccgacgtagtacgg

SEQ ID NO: 78891 - DNA, 687 bp, Homo sapiens
  misc_feature: GYAE6OF02HTEMP.37.26.C04.1.454.CMB.1.raw
tcagtagtgtagatcacgaccggtgctcgatttagtctagcgactttgggtttgggggaggcttggtacagcctggggggtcccctcgaggacttctcctggtgtcagtccgtctggtttcagtctttagacaaactacgccatgagcgtagggtccggccaggctccgaggggaaggggtctggaggtgggtacttacgaggttattacgtggtagtggtaataccgcatactacgcgagactcgtgacgggccggttcgaccggtctcagacgacaacttccaagaatacggtctatcgtggtaaactgaacagcctgagagccgaggaccgaccggccctactacttacgtgggtgcgaggagagtcacgacgagtatagcagtcagctctagtactacgtcgggaccacggtaccgtggtaccgaccgttcttccgtcgaccgccctaccaaccgaacgggaccctacgtacccggttccctttaccccgtcggtccctaccccgtacctaccgtaaacgaccgcctacccgtcggtacggggaccacgaccggaccggtacccgtcgggtcctcggtccgtcgggtacggtacctttaccgttaccgtacttaccgttaccgtacttaccgttggaccggtcgggtcgtcgggaccgtaacgggccgtacgtacgtacgtcg

SEQ ID NO: 78892 - DNA, 535 bp, Homo sapiens
  misc_feature: GYAE6OF02HCZZQ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggcccacggaaccctggtccaccgtctcctcagcctccaccaagggcccatcggtcttcccctggccaccctcctccaacgacgcacctctgggggccacacgcggcccgtgggctcgcctggtcaaggactacttccatctacactactgacgcgggctggcaggcgcatag

SEQ ID NO: 78893 - DNA, 173 bp, Homo sapiens; identical to SEQ ID NO: 78276
  misc_feature: GYAE6OF02HGV9J.37.26.C04.1.454.CMB.1.raw
  modified_base (173)..(173): a, c, t, g, unknown or other
  misc_feature (173)..(173): n is a, c, g, or t

SEQ ID NO: 78894 - DNA, 540 bp, Homo sapiens
  misc_feature: GYAE6OF02HGZGB.37.26.C04.1.454.CMB.1.raw
  modified_base (536)..(536): a, c, t, g, unknown or other
  misc_feature (536)..(536): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatccggtcttcccctggccaccctcctcccaagacgccacctcgtcgggggccacacggccggccctggggcctggccctggtcaaggactactccatctacactactgacgcggctggcaaggcgnatag

SEQ ID NO: 78895 - DNA, 552 bp, Homo sapiens
  misc_feature: GYAE6OF02F9EZ3.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggatatagcagcagctctgactactggggccacggaaccctggtccaccgtctcctcagccctccaccgaacggccccatccggtccttccccctcggccacccctccctccaacgacgccaccctcgtcgggggccacgacgccggcccgtggggcctcgcccgtggtccaaggactacttccatctacactacgtgacgcggctggcaaggcgcatcg

SEQ ID NO: 78896 - DNA, 176 bp, Homo sapiens; identical to SEQ ID NO: 78305
  misc_feature: GYAE6OF02GF78R.37.26.C04.1.454.CMB.1.raw
  modified_base (173)..(176): a, c, t, g, unknown or other
  misc_feature (173)..(176): n is a, c, g, or t

SEQ ID NO: 78897 - DNA, 681 bp, Homo sapiens
  misc_feature: GYAE6OF02I19PU.37.26.C04.1.454.CMB.1.raw
tcagtagtgtagatcacgaccggtgctcgatttagtctagcgactttgggtttgggggtagggcgttggtacagcctggggggttcccgtcgagacgtacctcctggtagccagcctcctgggtttcctatcttttacgccaactacgcccatgagcctgggtccgccaggctccagggaaggggctggagtgggtctcaggtattactcggtacgtggtaataccgcatacctacggacagacctcccgtgacgggccggttcaccggtctccagagacaattccaagaatacggtctatcctggaaatgaacagacctgacgagccgaggacacggccctctattactgtgcgacgagactcgacgacggagtactagcaggcaggctcgtgacgtacgtggggccctacggaaccctggtccacccgtctcctcgacgcctaccaccaacggcccaagtccggttccttcccctcggtcctaccctccctaccaacgacgccaccgtcgtcggggtaccaccgtacgtcccggcccgttcggggccgtacggacccgttacgggtaccgaaacgggtaccttaccgttaccgaaccgttccgtaaccgtaaccgttacgtaccggaaccggtccgggtacgttcgggtaccgtaaacgggtccgtaccgtacgtaccg

SEQ ID NO: 78898 - DNA, 176 bp, Homo sapiens; identical to SEQ ID NO: 78305
  misc_feature: GYAE6OF02I5OVS.37.26.C04.1.454.CMB.1.raw
  modified_base (173)..(176): a, c, t, g, unknown or other
  misc_feature (173)..(176): n is a, c, g, or t

SEQ ID NO: 78899 - DNA, 541 bp, Homo sapiens
  misc_feature: GYAE6OF02F2KHJ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccacggccatcgtctcccctcgccaccctcctccaacgacgcacctcgtcgggggcacgacgccggcccgtgggcctcgccgtgggtcaaggacctacttccactctacactactgacgcgggctcggccgaggcgcatacg

SEQ ID NO: 78900 - DNA, 560 bp, Homo sapiens
  misc_feature: GYAE6OF02GEH6Z.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagccctccaccaagggcccatccggtccttcccctcggccacccctccctccaacgacgccacctcgtcgggggccacgacggccggcccgtggggcctcgcccgtggtcaacggaccttaccttccactcctaacactactgacgcgggctcggcaaggcgacatacg

SEQ ID NO: 78901 - DNA, 568 bp, Homo sapiens
  misc_feature: GYAE6OF02GIFJT.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtggccaacatacagggaggtggtggtacgaaaaactatgtggactctgtgcggggccgattcaccatctccagagacaacgccaaaaactcactgtatctgcaaatggacggcctgagatccgaggacacggctgtgtattattgtgcgagagatttagactacaaagtttcgagtgactggtatgatgcttatgatacctggggccaagggaccatggtcaccgtctcttcagcctccaccaacgggcccatccggtccttcccctggccgccctgcctccgaggcgccacccgtccgagacgcacgacgccggcccgtgggcctcggccgttgggtaccaacgggtaccttaccgttccacttcctaaccaccttacgtcggacggtccggg

SEQ ID NO: 78902 - DNA, 592 bp, Homo sapiens
  misc_feature: GYAE6OF02I3GLV.37.26.C04.1.454.CMB.1.raw
  modified_base (353)..(353): a, c, t, g, unknown or other
  misc_feature (353)..(353): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctcngactacgtggggccacggaccctggtcaccgtctcctcagcctccaccaacggccactcgtccttcccctcggccacccctcctaccaacgacgccaccgtccgtcggggcacgacggccggcccgtcgggctcgcccgtcgggtaccgaaacggtacctaccttccctactacctaacctaaccttaaccgtcggaacggtccggggcgtcgggaccgaacgggccggacgaagtacg

SEQ ID NO: 78903 - DNA, 590 bp, Homo sapiens
  misc_feature: GYAE6OF02I5JGZ.37.26.C04.1.454.CMB.1.raw
  modified_base (272)..(272): a, c, t, g, unknown or other
  misc_feature (272)..(272): n is a, c, g, or t
  modified_base (318)..(318): a, c, t, g, unknown or other
  misc_feature (318)..(318): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctanctggaaatgaacagcctgagagccgaggacacggccctctattacngtgcgagagatcagacggagtatagcagcagctctgactacgtggggcccaacggaaccctggtcacccgtctcctcacgcctccaccaacggcccatccggtccttccccgtcgccacccctccctaccaacgacgccacccgtccgtcggggaccacgacgccgggcccgtcggggcctcggcccgttcggtaccgaacggtacctaccttccaacgtcctaaccacctacgtcgacggcgggctgggaccgaacggccgacgagtaacg

SEQ ID NO: 78904 - DNA, 598 bp, Homo sapiens
  misc_feature: GYAE6OF02HV1DV.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactaagtggggccacggaacctggtcaccgtctcctcacgcctaccaccgaacgggcccaactccggttcccttcccccgtggcccacccctccctaccaaacgacgaccacccgtcgtcggggccacgacgccggcccgtggggcctcgcccgttcgggtacaaacggtaccttaccttccctaacttccgtaacctaccttactgacggcgggctcgggaccgaacgggcgtaccgatacgg

SEQ ID NO: 78905 - DNA, 559 bp, Homo sapiens
  misc_feature: GYAE6OF02JH05S.37.26.C04.1.454.CMB.1.raw
  modified_base (552)..(552): a, c, t, g, unknown or other
  misc_feature (552)..(552): n is a, c, g, or t
tcagtagtgtagatcacgaccggtgctcgatttagtctagcgactttgggtttgggggagggcttggtacagcctggggggtccctgagactctcctgtgcagcctctggtttcatctttagcaactacgccatgagctgggtccgccaggctccagggaaggggctggagtggggtctcaggtattactggtagtggtaataccgcatactacgcatactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctgggtcaccggtctcctcacgcctccaccaacgggcccactccggtccttccccgtcggccacccctccctccaacgacgccaccctcgtcggggcacgacgccggcccgtcgggctcggcctcggtcaaacggctaccttccatcctacactactgacgcggctcggcaggcncgatacg

SEQ ID NO: 78906 - DNA, 558 bp, Homo sapiens
  misc_feature: GYAE6OF02FTGBB.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcacgcctccaccacggcccactcggtccttcccctcggccaccctcctccaacgacgcaccctcgtcgggggcacgacggccggcccgtcggggcctcggccgtcggtcgaaggacctaccttccatcctaacactactcgacgcgggcgtggccaaggcgcgatacg

SEQ ID NO: 78907 - DNA, 543 bp, Homo sapiens
  misc_feature: GYAE6OF02IKP8X.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacgtagtatagcagcagctctgactactggggccacggaaccctggtcaccgtctcctcacgcctccaccaacgggcccatcggtccttccccgtcggccacccctcctccaacgacgccacctcgtcggggcacgacgcggccctgggctcgcctggtcaacggactacttccatctaacactactgagcggcgtcggcgaggcgcatcg

SEQ ID NO: 78908 - DNA, 580 bp, Homo sapiens
  misc_feature: GYAE6OF02G2MWZ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggatatagcagcagctctgactacgtggggcccacggaaccctggtcaccgtctcctcacgccctccaccacggcccactcggtccttcccctcggccacccctccctaccaacgacgccacccgtcgtcgggggccacgacggccggcccgtcggggcctcgcccgtcgggtaccaacgggaccttaccttcccactcctaacctacctacgtgacggcgggcgtcggacgaacgggcgacatag

SEQ ID NO: 78909 - DNA, 605 bp, Homo sapiens
  misc_feature: GYAE6OF02I8PB5.37.26.C04.1.454.CMB.1.raw
  modified_base (476)..(476): a, c, t, g, unknown or other
  misc_feature (476)..(476): n is a, c, g, or t
  modified_base (516)..(516): a, c, t, g, unknown or other
  misc_feature (516)..(516): n is a, c, g, or t
  modified_base (597)..(599): a, c, t, g, unknown or other
  misc_feature (597)..(599): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
tcagtagtgtagatcacgaccggtgctcgatttagtctagcgactttgggtttggggggaggcttggtaacaggcctgggggggtccctgggagactctacctgtggctagcctctcggtttcgattctttagtcaacttacgtccatgaggctgggtccgccgaggcctccggagggaagggctggagtgggtctccaggttacttactcggtacgtgggtaataccggcatactacggcagacgtccgtgacgggtccgttacaccgtctaccacgagaccaattccaagttaattaccgggtcctaactacttaggaaaattacgtaaacacgtccgtacgagacgaccggaaggacgacggccctcctacttaactcgtgcgtagaggaggtactcggggcgttcgacgtactacggggctaggaacctggcacgtcgtcctcgacgctcaccacggcccactcgtctcccngcgccctgctcgagagcactcgagacgctacacgcggccngggctgctggtactaagtaccttacttccgtagtccgtacgactaacgtgacgcggctaaggctaagggcgacagtacgcnnntntntc

SEQ ID NO: 78910 - DNA, 572 bp, Homo sapiens
  misc_feature: GYAE6OF02GNJB3.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggccactcgaaccctgtcaccgtctcctcacgcctccaccaacgggcccacgtccggtccttcccccgtggcccaccctcctccaacgacgccaccctcgtcggggccacgacgccggcccgtgggcctcggccctggtacgaacgggaccttaccttccgacttcctacctactactcggacgcgggctgggacaacgggccgactaacg

SEQ ID NO: 78911 - DNA, 174 bp, Homo sapiens; identical to SEQ ID NO: 78297
  misc_feature: GYAE6OF02JEKTZ.37.26.C04.1.454.CMB.1.raw
  modified_base (173)..(174): a, c, t, g, unknown or other
  misc_feature (173)..(174): n is a, c, g, or t

SEQ ID NO: 78912 - DNA, 554 bp, Homo sapiens
  misc_feature: GYAE6OF02F92FA.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaacgggcccatcggtcttccccctggccacccctccctccaagacgccaccctcgtcgggggccacgacgccgggcccgtggggcctcgcccgtggtcgaacgggacctacttccatcctacactactgagcgggctcggcaaggcgcatacg

SEQ ID NO: 78913 - DNA, 514 bp, Homo sapiens
  misc_feature: GYAE6OF02F2ZZD.37.26.C04.1.454.CMB.1.raw
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (429)..(429): a, c, t, g, unknown or other
  misc_feature (429)..(429): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcagttattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaggccatcgtctcccngcncctctcagncacctctgggcacacgcggccctgggctcgcctggtcaaggctacttccatcgtacactactgacgcgggctggcaggcgcatag

SEQ ID NO: 78914 - DNA, 544 bp, Homo sapiens
  misc_feature: GYAE6OF02IB68C.37.26.C04.1.454.CMB.1.raw
  modified_base (535)..(544): a, c, t, g, unknown or other
  misc_feature (535)..(544): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaagggggctgggagtgggtctcaggtattactggtagtggtaataccgcatactacgcagactccgtgacgggccggttcaccgtctccagagacaattccaagaatacggtctatctgcaaatgaacagcctgagagccgaagacacggccgtatattactgtgtgaaaggctggggatggggggactacgtggggccaggggaacccctgggtccaccgtctcctcagcctccaccaagggcccatcggtcttccccctggccaccctcctcccaagacgcacctccgtgggggccacagcggccctgggctcgcctggtcaaggacctacttccatctacactactgagcgggctgggcaagggcgcataggnnnnnnnnnn

SEQ ID NO: 78915 - DNA, 584 bp, Homo sapiens
  misc_feature: GYAE6OF02G7N8E.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcacgcctccaccacggccatcggtccttcccctgccaccctcctccaacgacgccacctcgtcggggccacgacgccggcccgtcgggcctcgtccgttcgggtaccaaacgggtaccttaccgttcccacttccgtaaccaccgttaacctggtacggcgggcgtcgggaccgtaacgggccgacgagtacg

SEQ ID NO: 78916 - DNA, 597 bp, Homo sapiens
  misc_feature: GYAE6OF02IEZVL.37.26.C04.1.454.CMB.1.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (328)..(328): a, c, t, g, unknown or other
  misc_feature (328)..(328): n is a, c, g, or t
  modified_base (362)..(362): a, c, t, g, unknown or other
  misc_feature (362)..(362): n is a, c, g, or t
tcagtagtgtagatcacgaccggtgctcgatttagtctagcgactttgggtttggggaggcgttggtacagcctgggggtcccgtgagactctcctgtgcagcctctggtttcatctttagcaactacgccatgagctgggtccgccaggctccagggaaggggctggagtgggtctcaggtattacgtggtagtggtaataccgnatactacgcagactccgtgacgggccgttnaccgtctccaganacaattccaagaatacggtctatctggaaatgaacagcctgagagccgaggacacggcccctctattactgtgcgaganatcagacggagtatagcagcagctctgactacgnggggaccaacggaaccctggtaccaccggtcctccctgacgccctccacaacgggcccaagtccggtccttccccgtggcccacccgtcctacccaacgacgccaccctcgtcggggacctacgacggcgccccgtcgggccgtcgccgtcgggtacaacggtacctaccgttccaacgttcccaactacctacgtcggacgccgggtcgtggcccgaagggccgccgtagtagg

SEQ ID NO: 78917 - DNA, 565 bp, Homo sapiens
  misc_feature: GYAE6OF02H0HC3.37.26.C04.1.454.CMB.1.raw
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
  modified_base (364)..(364): a, c, t, g, unknown or other
  misc_feature (364)..(364): n is a, c, g, or t
  modified_base (561)..(561): a, c, t, g, unknown or other
  misc_feature (561)..(561): n is a, c, g, or t
tcagtagtgtagatcacgaccggtgctcgatttagtctagcgactttgggtttgggggaggcttggtacagcctggggggtcctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaaattccaaagaatacggtctatctaggaaatgaaacagcctgagagccgaggacacggccctntattacngtgcgagagatcagacggagtatagcagcagctctgactacgnggggccacggaaccctggtccaccgtctcctcagccctccaccaacgggcccctagtccggtccttccccgtcggcctacccctcctaccaaacgacgccaccttcgtcggggaccacgacggcggcccgtgggcctcgcctcggtacaaggactacttccactctacacttactgacgcgggctcggacaaggcgnatag

SEQ ID NO: 78918 - DNA, 561 bp, Homo sapiens
  misc_feature: GYAE6OF02HC9FC.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtccaccgtctcctcagcctccaccaacgggcccatcggtccttcccctggccaccctcctccaacgacgccacctcgtcgggggccacgacggccggcccgtcgggcctcgccgtcgggtaccaaacgggactaccttccatcctaacactactgacgcgggctcgggcgaaggcgacatacg

SEQ ID NO: 78919 - DNA, 534 bp, Homo sapiens
  misc_feature: GYAE6OF02F05I8.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaacgggcccatcggtccttccccctggccaccctccctccaagacgcacctctggggccacgacgcggccctgggctgcctggcaaggactacttccatctacactactgagcggctggcaaggcgacatacg

SEQ ID NO: 78920 - DNA, 568 bp, Homo sapiens
  misc_feature: GYAE6OF02IE09U.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaacgggcccatccggtcttccccctggccacccctcctccaacgacgccaccctcgtcggggccacgacggccggcccgtggggcctcgcccgtggtccgaagggtaccttaccttcccattcctacacctactcgaggccgggctcgggaccaagggcgcagtacg

SEQ ID NO: 78921 - DNA, 762 bp, Homo sapiens
  misc_feature: GYAE6OF02FENYC.37.26.C04.1.454.CMB.1.raw
  modified_base (217)..(217): a, c, t, g, unknown or other
  misc_feature (217)..(217): n is a, c, g, or t
  modified_base (290)..(290): a, c, t, g, unknown or other
  misc_feature (290)..(290): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccagtctccgaggggaaggggctggagtgggtggaccaacatacgagggaggtggtaggtaacgaaaaactntggtggactcgtgtggcggggcctattccaccatcctaccagaacgaacaacgaaccaaaactcactgtatcngaacaagtcggacgctaggacgtacgtaccggaggaccgacggtcttagttagttattagttggacgacggtaagtaagttaacttaacgtaacttaaacgttaaacggtttcggaagttacgtaacgttaggtaatacggtaattaacgtttaggacggtaaaccgttaccgggacggggaacccgtaacgggtacctacggttccgtaccctaccgtttctccgtaccgacccgtaccccgtacccgaacccggaaccgtcccctacggttccccgtacccgttcccggcgccccgtccgtacgacctaccggaacgtacctacccgaccggtacgacgtaccggaccgacgggccgtcccggtccgtacgggtccttccgaccgttacggtaaacccgacggttaacccttaccgttacgtaacctacgtaaccgtaaccggttcggacggggaccggtacggtaccgg

SEQ ID NO: 78922 - DNA, 557 bp, Homo sapiens
  misc_feature: GYAE6OF02GQVTO.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtggccaacatacagggaggtggtggtacgaaaaactatgtggactctgtgcggggccgattcaccatctccagagacaacgccaaaaactcactgtatctgcaaatggacggcctgagatccgaggacacggctgtgtattattgtgcgagagatttagactacaaagtttcgagtgactggtatgatgctttatgataccgtgggggaccaaggggaccagtggtcaccgtctcttcagtcctccaccgaacgggcccatccggttccttcccccgtgggccgccctgcctccgaggcgccacccgtccgagacgcaacacgccggccctgggctcgccgtgggtcaaggtcctacttccactctaccactactgagccggg

SEQ ID NO: 78923 - DNA, 605 bp, Homo sapiens
  misc_feature: GYAE6OF02HGOXI.37.26.C04.1.454.CMB.1.raw
tcagtagtgtagatcacgaccggtgctcgatttagtctagcgactttgggtttggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggcccacggaaccctggtcaccgtctcctcacgcctccaccaacgggcccactccggtccttcccctcggccacccctccctccaacgacgccacctcgtcgggggccacgacgccggcccgtcgggccgtcgcccgttgggtccaaacgggaccttaccgttcccaacttccgtaacctaaccttaaccgttacggacggccggggtaccgtcggggaccgaaacgggccggaccgagtacgg

SEQ ID NO: 78924 - DNA, 538 bp, Homo sapiens
  misc_feature: GYAE6OF02GOP6J.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaacgggcccatcggtcttcccctggccaccctccctccaagacgcacctcgtcgggggcacgagccggcccgtggggcctgcctggtcaacggactacttccatctacactactgacgcggctggcaaggcgcatag

SEQ ID NO: 78925 - DNA, 561 bp, Homo sapiens
  misc_feature: GYAE6OF02I3C37.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaaggcccatcggtccttcccctcggccacccctccctccaacgacgccaccctccgtcgggggccaccgagccggcccgtcggggccgtcgccgttcggtccgaaacggacctaccttccactcctaacacctactcgacgcgggctggcaggcgcatag

SEQ ID NO: 78926 - DNA, 553 bp, Homo sapiens
  misc_feature: GYAE6OF02H52BP.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcacgcctccaccaaggcccatcggtcttcccctgccaccctcctccaagacgcacctcgtggggcacgacgccggcccgtgggctgcccgtggtcaacggactaccgttccacttccgtaacacctacgtcgacgccgggctcggaccaacgggcgccagtacg

SEQ ID NO: 78927 - DNA, 625 bp, Homo sapiens
  misc_feature: GYAE6OF02HBDSQ.37.26.C04.1.454.CMB.1.raw
tcagtagtgtagatcacgaccggtgctcgatttagtctagcgacttttgggtttgggggaggcttggtacagcctggggggtccctgagactctcctgtgcagcctctggtttcatctttagcaactacgccatgagctgggtccgccaggctccgagggaaggggctgggagtgggtctcaaggtattactggtagtggtaataccgacatactacgcagactcgtgacgggccgttcaccgtctccagagacaattccaagaatacggtctatctggaaatgaacagcctgagagccgaggacacggccctctattactgtgcgagagatcagacggagtatagcagcagctcgtcgactacgtggggccaccggaaccctggtccaccgtctcctcgacgccctccgacccacgggccccacgtcccggttacccttcccccgtcggacctaccccgtccctacccgaacgacgccacccgtcgtcgggggccaccgacggccggcccgtggggcctcgcccgtcggttaccgaaacggtacctaccgttaccctacttccgtaaccgaaccttaccgtagaacggtccgggacgtcgggaccgaacgggccgactagtacg

SEQ ID NO: 78928 - DNA, 612 bp, Homo sapiens
  misc_feature: GYAE6OF02I5B1G.37.26.C04.1.454.CMB.1.raw
  modified_base (209)..(209): a, c, t, g, unknown or other
  misc_feature (209)..(209): n is a, c, g, or t
  modified_base (240)..(240): a, c, t, g, unknown or other
  misc_feature (240)..(240): n is a, c, g, or t
  modified_base (275)..(275): a, c, t, g, unknown or other
  misc_feature (275)..(275): n is a, c, g, or t
  modified_base (345)..(345): a, c, t, g, unknown or other
  misc_feature (345)..(345): n is a, c, g, or t
  modified_base (357)..(357): a, c, t, g, unknown or other
  misc_feature (357)..(357): n is a, c, g, or t
  modified_base (608)..(608): a, c, t, g, unknown or other
  misc_feature (608)..(608): n is a, c, g, or t
tcagtagtgtagatcacgaccggtgctcgatttagtctagcgactttgggtttgggggtagggcgttggtacagcctgggggtcccgtgagactctcctgtgcagcctctggtttcatctttagcaactacgccatgagctgggtccgccaggctccagggaaggggctgggagtgggtctcaggtattactggtagtggtaataccgnatactacgcagactccgtgacgggccggttnaccgtctccagacgacaattccaaagaatacggtntatctggaatgaacagcctgagagccgaggacacgcccgtctatactgtgcgagagatcagacggagtanagcagcagctcngactactggggccaacggaacctggtccaccgtctccgtcagccctaccacccgaagggccccaacttccgggtaccttcccccgtgacccaccctccctaccaacgacgtcccacctccgcggggccaccgacggccggccccgtgggcccgtcgcccgtcggtccaaacgggtaccttacctcccgaatcccggtaacaaccgttactcggtaacggccgggacgtcggacctaacgggccgaccgtanacgg

SEQ ID NO: 78929 - DNA, 637 bp, Homo sapiens
  misc_feature: GYAE6OF02IZ8DL.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtggacgggccggttccaccgtctccacgagacaatcctagaataacggtctatctggaaagtagaacagcctgagagccgaggacacggacccgtcctattactgtaggcgacggagactcagaacgggagtagagtcgagcagctctgtactacgtcggggaccgaaccggaacccgtcggtcaccgtctccgtcacgcctcccaaccgtaacgggacccgtacgtacccggtccgttcccccctcgggacccaccccgttaccctaccaacgaacgcctaacccgcgtcggggaccgacacggccggcccgtcgggactcggccgtcggtacgaaacggtacttaccttcccattaccgtaacctactacctggacgacgggcctcggaccgtaagggcccgtagaactaggg

SEQ ID NO: 78930 - DNA, 553 bp, Homo sapiens
  misc_feature: GYAE6OF02IK86P.37.26.C04.1.454.CMB.1.raw
  modified_base (552)..(553): a, c, t, g, unknown or other
  misc_feature (552)..(553): n is a, c, g, or t
tcagtagtgtagatcacgaccggtgctcgatttagtctagcgactttgggtttggggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaaattccaacagcacgctgtatttgcacatgaacagcctgagagccgaggacacggccatatatattgtgcgaaacttccttttgacttggttattatcccctagtgaccactggggccagggaaccctggtcaccgtctcctcagcctccaccaagggcccatcggtcttccccctggccaccctcctccaagacgccacctcgtgggggccacgagccggcccgtgggctcgcctggtcaaacggactaaccttccactctaacactactgacggcggctggcaacggcgacatagnn

SEQ ID NO: 78931 - DNA, 603 bp, Homo sapiens
  misc_feature: GYAE6OF02ICRFQ.37.26.C04.1.454.CMB.1.raw
  modified_base (313)..(313): a, c, t, g, unknown or other
  misc_feature (313)..(313): n is a, c, g, or t
  modified_base (598)..(598): a, c, t, g, unknown or other
  misc_feature (598)..(598): n is a, c, g, or t
tcagtagtgtagatcacgaccggtgctcgatttagtctagcgactttgggtttggggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctaggaaatgaacagcctgagagccgaggacacggccctntattactgtcgcgagagatcaggacggagtatagcagcagctctgactacgtcgggccacggaaccctggtcaccgtctcctcgacgcctacgaccacgggccctagtccggttccttccccgtgggacctaccctaccgtaccgaacgaggtccaccgttcggtcgggggaccacgacgggcccgggcccgtacggggcctcggtccgtcgggtaccaaacggtactaccgttaccacttccgtaactacctactcgacgtccggtctcggacacgggcaccgntacgg

SEQ ID NO: 78932 - DNA, 249 bp, Homo sapiens
  misc_feature: GYAE6OF02GJ2VR.37.26.C04.1.454.CMB.1.raw
  modified_base (246)..(249): a, c, t, g, unknown or other
  misc_feature (246)..(249): n is a, c, g, or t
tcagtagtgtagatcacgaccggtgctcgatttagtctagcgactttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcggctggcaaggcgcatagnnnn

SEQ ID NO: 78933 - DNA, 525 bp, Homo sapiens
  misc_feature: GYAE6OF02FW6XC.37.26.C04.1.454.CMB.1.raw
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaggcccatcgtctcccctgcnccctcctccaagncacctctggggcacgagcggcccgtgggctcgccgtggtcaaggacctacttccatctacactactgagcggctggccaggcgcagtacg

SEQ ID NO: 78934 - DNA, 545 bp, Homo sapiens
  misc_feature: GYAE6OF02I6LMU.37.26.C04.1.454.CMB.1.raw
  modified_base (542)..(545): a, c, t, g, unknown or other
  misc_feature (542)..(545): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatgggggactacgtggggccagggaaccctggtcaccgtctcctcagcctccaccaacgggcccatccggtccttccccctggccacccctcctcccaagacgccaccctcgtcgggggccaccgacgccggcccgtggggcctcgcccgtgggtcaaggacctacttccatcctacactactcgacgcggctggcaaggcgcatagnnnn

SEQ ID NO: 78935 - DNA, 583 bp, Homo sapiens
  misc_feature: GYAE6OF02GTNXK.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggagtatagcagcagctctgactacgtggggccaacggaaccctggtcaccgtctcctcagcctccaccaacggccatcgtccttcccctcggccaccctcctccaacgacgccacctcgtcggggccacgacggccggcccgtcgggccgtcgcccgtcggtaccgaacgggtaccttaccgttccactaccgtaacctaacctaccgtggacggcgggcgtcgggccgaaggccggactagtacgg

SEQ ID NO: 78936 - DNA, 544 bp, Homo sapiens
  misc_feature: GYAE6OF02G4U6J.37.26.C04.1.454.CMB.1.raw
  modified_base (353)..(353): a, c, t, g, unknown or other
  misc_feature (353)..(353): n is a, c, g, or t
  modified_base (539)..(539): a, c, t, g, unknown or other
  misc_feature (539)..(539): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctcngactactggggccacggaaccctggtcaccgtctcctcagcctccaccaacgggcccactcggtccttcccctcggccaccctccctccaacgacgccacctcgtcggggccacgacgccggccctgggcctcggcctggtcaaggactacttccatctacactactgacgcgggctggcaggcgnagtag

SEQ ID NO: 78937 - DNA, 550 bp, Homo sapiens
  misc_feature: GYAE6OF02F32ZW.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcagcctccacaggcccatcggtctcccgtcgcaccctcctccaacgacgcacctcgtcggggcgacacgccgggcccgtcgggcgtcgccgtcggtacgaacggaccttaccttcccatactacctacctactgacgcgggcgtcggcgaggcgcatag

SEQ ID NO: 78938 - DNA, 552 bp, Homo sapiens
  misc_feature: GYAE6OF02H7671.37.26.C04.1.454.CMB.1.raw
  modified_base (552)..(552): a, c, t, g, unknown or other
  misc_feature (552)..(552): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaacgggccccatccggtcttcccctcggccaccctcctccaacgacgtacctcgtcgggggcacgacgccggcccgtcgggctcgccgttcggtcgaaacggactaccgttccactctacactactcgagcgggctggcaggcgcagtagn

SEQ ID NO: 78939 - DNA, 552 bp, Homo sapiens
  misc_feature: GYAE6OF02G3V3C.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaacgggcccactcggtccttcccctggccaccctccctccaacgacgccacctcgtcgggggccacgacggccggcccgtggggcctcgcctgggtcaacggactacttccatcctacacctactgacgcgggctcggcaggcgcgatacg

SEQ ID NO: 78940 - DNA, 598 bp, Homo sapiens
  misc_feature: GYAE6OF02GFH3V.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccggtgacgggccggttcaccgtctccagagacaattccaagatacggtctatctggaaatgaacagcctgagagccgaggacacggccctctattacgtgtgcgagagatcagacggagtatagcagcagctctgactacgtggggcccaacggaaccctggtaccaccgtctccgtcacgccctccgaccgaacggcccacgtccggtccttccccgtcggccacccctccctaccaacgacgccacctcgtcggggaccacgacggccggcccgtcgggcctcgccgtcggtccgaacggtacctaccttccgacgtccgtaacctaccttacgtacgacggccggtcgtacggaccgaacggtccgacgagtacg

SEQ ID NO: 78941 - DNA, 545 bp, Homo sapiens
  misc_feature: GYAE6OF02IITD0.37.26.C04.1.454.CMB.1.raw
  modified_base (543)..(545): a, c, t, g, unknown or other
  misc_feature (543)..(545): n is a, c, g, or t
tcagtagtgtagatcacgaccggtgctcgatttagtctagcgactttgggtttgggggaggcttggtacagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccgatcctccagagacaattccaagaacacgctctatctgcaaatgaacagcctgagagccgaagacacggccgtatattactgtgtgaaaggctggggatggggggactacgtggggccagggaccctggtcaccgtctcctcagcctccaccaagggcccagtccggtccttccccctggcccaccctccctacccaacgtacgaccaccctcgtcgggggtccacgtacgccggcccgtgggctcgccgtggtcaacggactactccatctacactactgacgcggctggcaggcgcatacgnnn

SEQ ID NO: 78942 - DNA, 516 bp, Homo sapiens
  misc_feature: GYAE6OF02IXDFC.37.26.C04.1.454.CMB.1.raw
  modified_base (506)..(506): a, c, t, g, unknown or other
  misc_feature (506)..(506): n is a, c, g, or t
  modified_base (511)..(516): a, c, t, g, unknown or other
  misc_feature (511)..(516): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaagtactagtgctcctggtaatagagcagactacgcagactccgtgaagggccggttcaccatctccagagacaattccaagaacacgctctatctgcaaatgaacagcctgagagccgaagacacggccgtatattaactgtgtgaaaggctggggatggggggactacgtggggccagggaaccctggtcaccgtctcctcagctccacaaggccatcgtctcccctggccaccctcctccaagagcacctcgtggggcacgacgcggccctgggctgcctggtcaaggctactccatctacactactgagcggctggcaaggcgnatagnnnnnn

SEQ ID NO: 78943 - DNA, 593 bp, Homo sapiens
  misc_feature: GYAE6OF02I5VHN.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtcggggccacggaaccctggtccaccgtctcctcacgccctccaccgaacgggcccacgtccggtcccttccccgtcggcccacccctccctaccaacgacgcctaccgtccgtcggggccacgacgccggcccgtgggccgtcgccgtcggtacgaacggtacctaccgttccattcctaacctacttacgtcggacggccgggtcgtcgggacgaacgggccgacgatacg

SEQ ID NO: 78944 - DNA, 593 bp, Homo sapiens
  misc_feature: GYAE6OF02JHKPG.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgcctccaccgacggcccacgtccggtccttccccgtggcccaccctccctaccgaacgacgccaccgtcggtcggggccacgacggccggcccgtcgggcctcgccgttcggacgaacggtaccttaccgttacctactccgtaacctaccttacgtacgacggccggtcgtcgggaccgaagggccgtactagtacg

SEQ ID NO: 78945 - DNA, 530 bp, Homo sapiens
  misc_feature: GYAE6OF02GX9LQ.37.26.C04.1.454.CMB.1.raw
  modified_base (508)..(508): a, c, t, g, unknown or other
  misc_feature (508)..(508): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaaggcccatcggtcttccccgtggccaccctcctccaacgacgcacctcgtggggcacgacgccggccctgggctgcctggtcaagctacttcatctaacactacgngagcggctggacaggcgcatag

SEQ ID NO: 78946 - DNA, 561 bp, Homo sapiens
  misc_feature: GYAE6OF02GR0EX.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctgggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcacgcctccaccaacgggcccatccggtccttcccctcggccaccctccctaccaagacgccacctcgtggggcacgacggccggcccgtgggcctcggcctcgggtcaacggactaccttccactcctaacacctactgacgcgggcgtcggccgaaggcgacagtacg

SEQ ID NO: 78947 - DNA, 533 bp, Homo sapiens
  misc_feature: GYAE6OF02GBU5O.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagcttggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcagcctccaccaagggcccatcggtccttcccctggccaccctccctccaacgacgccacctcgtggggcacagccggccctgggctgcctggtcaagactactcatcctacactactgagcggctcggcaggcgcgatacg

SEQ ID NO: 78948 - DNA, 600 bp, Homo sapiens
  misc_feature: GYAE6OF02HBGMC.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaacctggtccaccgtctcctcacgcctccaccgaacggccactccggtccttcccctcggccacccctccctaccgaacgacgccaccgtcgtcggggaccacgacggccggcccgtcgggtccgtcgtccgtcggtacgaacggtaccttaccttaccgtactaccgtaaccgtaccttacgtacggacggccgggtcgtcgggtaccgaacgggccgacgtagtacg

SEQ ID NO: 78949 - DNA, 579 bp, Homo sapiens
  misc_feature: GYAE6OF02IRUBC.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctccctcacgccctaccacccaacgggccccacgtccggtccttcccccgtcggccctacccctccctacccgaacgacgccaccctcgtcgggggccacgcggaccggcccgtgggcctcgccgttcggtcaaacggtcctacttccatcctacacctactggacgcgggcgtcggacgacggcgacatacg

SEQ ID NO: 78950 - DNA, 173 bp, Homo sapiens; identical to SEQ ID NO: 78276
  misc_feature: GYAE6OF02GKRQW.37.26.C04.1.454.CMB.1.raw
  modified_base (173)..(173): a, c, t, g, unknown or other
  misc_feature (173)..(173): n is a, c, g, or t

SEQ ID NO: 78951 - DNA, 709 bp, Homo sapiens
  misc_feature: GYAE6OF02G7J0P.37.26.C04.1.454.CMB.1.raw
  modified_base (238)..(238): a, c, t, g, unknown or other
  misc_feature (238)..(238): n is a, c, g, or t
  modified_base (419)..(419): a, c, t, g, unknown or other
  misc_feature (419)..(419): n is a, c, g, or t
tcagtagtgtagatcacgaccggtgctcgatttagtctagcgactttgggtttgggggtagggcttgggtacagccgtcggggggtcccctagagactctcctcgtgcgacgccgtcttcggttttccatttcttttagtccaaccttacgcctatgagcctggggtcccgacctaggctccagggaaggggctgggagtgggtcgtcacggtattactggtagtgggtaatacccgngagtactacgcagactccgtgacgggccggttcaccgtctccaggagacaattccaaagaatacggtctatctcggaaattggaacagcctagaacgagccgaaggaccaaccggcccgtctattactgttgcgaagaagactacagacggagtactaggcagtcagctctcgactacggngggaccacggaacctcggtcacccgtctccgtcagtccctcaaccgacgggcccagtccggtccttccccgtgccacccctcctaccaagccgcctaccttcgtcggggtccacgacggtcccggtcccgtcgggtccgttcggccgttacggggtaaccaaacggggttaccttaaccggtttccccgtaagtttacccgttaacccgaacctttaaccggtacgggtaacggtccccggggtcccgttaggggaccctaaccggggtccgtacccgttaacgtacccg

SEQ ID NO: 78952 - DNA, 568 bp, Homo sapiens
  misc_feature: GYAE6OF02I2FGS.37.26.C04.1.454.CMB.1.raw
  modified_base (511)..(511): a, c, t, g, unknown or other
  misc_feature (511)..(511): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtggggtggccaaacataaagcaagatggaagtgagaaatactatgtggactctgtgaagggccgattcaccatctccagagacaacgccagaactcatgtatctgcaaatgaacagactgagagccgaggacacggctgtgtattactgtgcgagagaggaggcgagttagtgtaaaatgggctgggcctttctactactactactacatggacgttcgtgggactaaagggaccacggtcaaccgtctcctcacgcctccaccgtaacgggcccagttccggtccttcccccgtcggccaccccttcctacccaagacgccaccctcgtcggggccacgngccggcccgtgggctcgcctcggtacgaacggtacgtacctccactcctactaaccg

SEQ ID NO: 78953 - DNA, 537 bp, Homo sapiens
  misc_feature: GYAE6OF02F6M3E.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaacgggcccatcggtcttccccctggccaccctcctccaacgagccacctcgtcggggcacgacgccggccctgggctcgcctcggtcaaggactacttccatctacactactgacgcggctggcaggcgcatacg

SEQ ID NO: 78954 - DNA, 535 bp, Homo sapiens
  misc_feature: GYAE6OF02G8T7M.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttcacgactggggccagggaaccctggtcaccgtctcctcagcctccaccaagggcccatcggtcttccccctggccaccctcctccaacgagcacctctggggcacgagcggccctgggctgcctgtcaggctacgtccatctacactactcgagcggctggcaggcg

SEQ ID NO: 78955 - DNA, 606 bp, Homo sapiens
  misc_feature: GYAE6OF02G0TWQ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcagcctccaccaacgggcccagtcggtccttcccctcggccaccctccctccaacgacgccacctcgtcgggggccacgacggccggcccgtcggggcctcggcccgttcgggtaccgaaacgggtaccttaccgttcccacttcctaacctaaccttaacgttcggacggccggggtaccgttcggggaccgtaacgggccggaccgagtacgg

SEQ ID NO: 78956 - DNA, 541 bp, Homo sapiens
  misc_feature: GYAE6OF02IJ37L.37.26.C04.1.454.CMB.1.raw
  modified_base (520)..(520): a, c, t, g, unknown or other
  misc_feature (520)..(520): n is a, c, g, or t
  modified_base (528)..(528): a, c, t, g, unknown or other
  misc_feature (528)..(528): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccaacggaaccctggtccaccgtctcctcacgcctccaccaacgggcccatccggtcttcccctggccaccctccctccaacgacgccacctcgtcggggcacgacggccggcccgtgggctcgcctggtcaacggactactccatcacactcngagcggcnggacaggcgcatg

SEQ ID NO: 78957 - DNA, 535 bp, Homo sapiens
  misc_feature: GYAE6OF02G88IS.37.26.C04.1.454.CMB.1.raw
  modified_base (459)..(459): a, c, t, g, unknown or other
  misc_feature (459)..(459): n is a, c, g, or t
tcagtagtgtagatcacgaccggtgctcgatttagtctagcgactttgggtttgggggaggcttggtacagcctggggggtccctgagactctcctgtgcagcctctggattcaactttggtagctattggatggactgggtccgccagtctccagggaaggggctggagtgggtggccaacatacagggaggtggtggtacgaaaaactatgtggactctgtgcggggccgattcaccatctccagagacaacgccaaaaactcactgtatctgcaaaatggacggcctgagatcccgaggacacggctgtgtattattgtgcgagagatttagactacaaagtttcgagtgactggtatgatgcttatgataccgtggggccaagggaccagtcggtcaccgtctcttcagcctccaccaaggcccatcgtcttccccgtgcgccctgctccaggcncacctccgagcgcacacgcggccctgggcctgcctcggtcaacggactacttccattcactactactgagcgggcg

SEQ ID NO: 78958 - DNA, 173 bp, Homo sapiens; identical to SEQ ID NO: 78276
  misc_feature: GYAE6OF02IHEOB.37.26.C04.1.454.CMB.1.raw
  modified_base (173)..(173): a, c, t, g, unknown or other
  misc_feature (173)..(173): n is a, c, g, or t

SEQ ID NO: 78959 - DNA, 532 bp, Homo sapiens
  misc_feature: GYAE6OF02HO2FU.37.26.C04.1.454.CMB.1.raw
tcagtagtgtagatcacgaccggtgctcgatttagtctagcgactttgggtttggggaggcttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaaatgaacagcctgagagccgaggacacggccctctattactgtgcgagagatcagacggagtatagcagcagctctgactactggggccacggaaccctggtcaccgtctcctcacgcctccaccaacgggcccatcggtccttcccctcggccaccctcctccaacgacgccacctcgtcggggcacgacgcggccctgggctgcctggtcaagactactccatctacactactgagcggctggcaaggcgcatag

SEQ ID NO: 78960 - DNA, 172 bp, Homo sapiens; identical to SEQ ID NO: 78412
  misc_feature: GYAE6OF02FJ4H1.37.26.C04.1.454.CMB.1.raw

SEQ ID NO: 78961 - DNA, 568 bp, Homo sapiens
  misc_feature: GYAE6OF02HOSRU.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccagggcccatcggtccttccccgtcgccaccctcctccaacgacgcacctcgtggggccacgacgccggcccgtggggcctcgcccgtcggtacgaaggaccttaccttcccacttacctaaccaccttactcggacggccgggtctgggccgaagggccgacatacg

SEQ ID NO: 78962 - DNA, 173 bp, Homo sapiens; identical to SEQ ID NO: 78697
  misc_feature: GYAE6OF02H89QC.37.26.C04.1.454.CMB.1.raw

SEQ ID NO: 78963 - DNA, 562 bp, Homo sapiens
  misc_feature: GYAE6OF02HHMVA.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcaagacggagtatagcagcagctctgactacgtggggccaacggaaccctggtcacccgtctcctcacgcctccaccgaacgggccccagtccggtccttccccgtcggccacccctcctccgaacgacgccacctcgtcggggcacgacgccggcccgtgggcctcgccgtcggtacaacggacctacttccatcctaacactacgtgacgcggctcggacaaggcgcatcg

SEQ ID NO: 78964 - DNA, 546 bp, Homo sapiens
  misc_feature: GYAE6OF02FZHLD.37.26.C04.1.454.CMB.1.raw
  modified_base (540)..(540): a, c, t, g, unknown or other
  misc_feature (540)..(540): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggagtatagcagcagctctgactacgtggggccacggaaccctggtcaccgtctcctcagcctccaccaacggcccagtcggtccttcccctggccaccctccctccaacgacgcacctcgtcgggggccacgacgccggccctcgggctcgcctggtcaaggacctacttccatctacactactgacgcgggctggccaaggcncatacg

SEQ ID NO: 78965 - DNA, 600 bp, Homo sapiens
  misc_feature: GYAE6OF02GUOCZ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcagcctccaccacggcccagtccggtccttcccctggccaccctcctccaacgacgccacctcgtcggggcacgacggccggcccgtcggggcctcggcccgtgggtaccgaaacggtaccgttaaccgttcccacttccgtaacctaaccttaccgtacgacggccggggtaccgttcgggaccgtaacgggccgaccgtagtacgg

SEQ ID NO: 78966 - DNA, 616 bp, Homo sapiens
  misc_feature: GYAE6OF02IZ2KK.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaaatgaacagcctgagagccgaggacacggccctctattactgtgcgagagatcagacggatatagcagcagctctgactacgtggggcccacggaaccctggtccaccgtctcctcacgcctccaccgaacgggcccaacgtccggtccttccccgtcggccacccctcctacccaacgacgccaccctcgtcggggcacgacggcccggcccgtcggggcctcggcccgttcggtccgaaacggtaccttaaccgttcccaacttccgtaacctaaccttaccgtacggtacggccggggtaccgttcgggaccgaacgggcccgacgacgtaacgg

SEQ ID NO: 78967 - DNA, 642 bp, Homo sapiens
  misc_feature: GYAE6OF02JFR29.37.26.C04.1.454.CMB.1.raw
  modified_base (247)..(247): a, c, t, g, unknown or other
  misc_feature (247)..(247): n is a, c, g, or t
  modified_base (323)..(323): a, c, t, g, unknown or other
  misc_feature (323)..(323): n is a, c, g, or t
tcagtagtgtagatcacgaccggtgctcgatttagtctagcgactttgggtttgggggaggcttggtacagcctggggggtccctgagtacgtctcctgtgcagccctctggtttcatctttagcaactacgccatgagctgggtccgccaggctccagggaaggggctggagtgggtctcgaggtattacgtggtagtggtaataccgcatactacgcagactccgtgacgggccgttcaccgtcnccagagacaattccaaagaatacggtctatctaggaaatgaacagcctgagagccgaggacacgccctatattacngtgcgagagatacagaacggatatagcagcacgctcgagactacggtcggggacccaacggaccctggtaccaccggtctaccgtcacgccctccgaccgaacgggccctacgtccggttcccttccccgtcggcctacccctcccgtaccaacgacgcccgaccctcggtcggggaccaccgacggcccggcccggtcgggccgttccggaccgttcgggtaccgtaaacggtaccttacccgttacctaacttaccaaccgttaaccgtaggaccgggtaccgggtccgtacgggaccgaacggccgacgtagtagc

SEQ ID NO: 78968 - DNA, 617 bp, Homo sapiens
  misc_feature: GYAE6OF02HXK04.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcacgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcacgcctccaccaacgggcccagtccggtccttcccccgtcggccacccctcctccaacgacgccacccgtcgtcgggggaccacgacggccgggcccgtcggggcctcggcccgttcgggtaccgaaacgggtaccttaccgttacccaacgttacctaacctaaccttaccgtcggtaacggccggggcgttcgggaccgtaaacgggccgtacgaagttaacgg

SEQ ID NO: 78969 - DNA, 616 bp, Homo sapiens
  misc_feature: GYAE6OF02HUEKU.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccaacggaaccctggtcaccgtctcctcacgcctccaccgaacgggccccactccggtccttccccgtcggcccacccctccctaccaacgacgccaccctcgtcgggggccacgacggccggcccgtcggggccgtcgcccgttcgggtacgaaacggtaccttaccttacccgtaacttaccgtaacctaaccttaccgtcggtacggccggggcgttcgggaccgaacggggccgtaccgagtaacgg

SEQ ID NO: 78970 - DNA, 565 bp, Homo sapiens
  misc_feature: GYAE6OF02GOSAJ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctccctcacgccctccaccaacgggcccactccggtccttccccctcggcccacccctccctcccaagacgccacctcgtcggggccacgacgccggcccgtcgggctcgccgtcggtcaacggactaccttccactcctacactacctgacgcgggcgtcggacacggcgcgatacg

SEQ ID NO: 78971 - DNA, 589 bp, Homo sapiens
  misc_feature: GYAE6OF02HU60F.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggccaccgtctcctcacgccctccaccaacgggccccactccggtccttccccgtcggccacccctccctccgaacgacgccacccgtcgtcggggccacgacgccggcccgtcgggctcgcccgttcggtacgaacggtaccttaccgttaccactcctaactaccttacgtgacggcgggccgtcgggaccgaacgggccgacgagtacg

SEQ ID NO: 78972 - DNA, 543 bp, Homo sapiens
  misc_feature: GYAE6OF02F41CP.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagatggagtatagcagcagctctgactacgtggggccacggaaccctggtcaccgtctcctcagcctccaccaacgggcccactcggtccttcccctcggccaccctcctccaacgacgccacctctgggggccacgacgccggcccgtgggctcgcctggtcaacggactacttccactctacactactgaggcggcgtggcacggcgacag

SEQ ID NO: 78973 - DNA, 557 bp, Homo sapiens
  misc_feature: GYAE6OF02FNNWW.37.26.C04.1.454.CMB.1.raw
  modified_base (205)..(205): a, c, t, g, unknown or other
  misc_feature (205)..(205): n is a, c, g, or t
  modified_base (312)..(312): a, c, t, g, unknown or other
  misc_feature (312)..(312): n is a, c, g, or t
  modified_base (393)..(393): a, c, t, g, unknown or other
  misc_feature (393)..(393): n is a, c, g, or t
  modified_base (525)..(525): a, c, t, g, unknown or other
  misc_feature (525)..(525): n is a, c, g, or t
tcagtagtgtagatcacgaccggtgctcgatttagtctagcgactttgggtttggggagcttggtacagcctggggggtccctggagacgtctcctgtgcagcctctggtttcatctttagcaactacgccatgagctgggtccgccaggctccagggaaggggctggagtgggtctcaggtattactggtagtggtaataccgnatactacgcagactccgtgacgggccggttcaccgtctccagagacaattccaaagaatacggtctatctggaaatgaacagcctgagagccgaggacacggccctntattactgtgcgagagatcagacggagtatagcagcagctctgactacgtggggccacggaaccctggtccaccgtctccncacgcctccacacggcccagtcggtccttccccgtggccaccctcctccaacgcgccaccgtcgtcggggcacgacgccggccgtgggcctgccgtggtacaaggtactacgttccatcgtaacacttacgngacgtcggcgtaggccgaaggcgtacagtacg

SEQ ID NO: 78974 - DNA, 553 bp, Homo sapiens
  misc_feature: GYAE6OF02GW76D.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcagcctccaccacgggcccactcggtccttccccctggccacccctccctaccaacgacgccaccgtcgtcggggccacgacgccggcccgtgggcctcgccgtggtcgaaggactacttccactctaacactactgacgcggctcggcgaggcgcagtacg

SEQ ID NO: 78975 - DNA, 602 bp, Homo sapiens
  misc_feature: GYAE6OF02IIVRD.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggatatagcagcagctctgactacgtggggccacggaaccctggtcaccgtctccctcacgtccctcccaccgaacgggccccacgtccggtcccttcccccgtcggcctacccctccctacccaacgacgccacctcgtggggccacgacgccggcccgtggggcctcgcccgtgggtaccgaacgggtaccttaccgttcctactcctaacctaccttacgtacggacggtccggggcttcgggaccaacgggccgacgagtacgg

SEQ ID NO: 78976 - DNA, 542 bp, Homo sapiens
  misc_feature: GYAE6OF02HJGGA.37.26.C04.1.454.CMB.1.raw
  modified_base (213)..(213): a, c, t, g, unknown or other
  misc_feature (213)..(213): n is a, c, g, or t
  modified_base (513)..(513): a, c, t, g, unknown or other
  misc_feature (513)..(513): n is a, c, g, or t
  modified_base (520)..(520): a, c, t, g, unknown or other
  misc_feature (520)..(520): n is a, c, g, or t
  modified_base (535)..(536): a, c, t, g, unknown or other
  misc_feature (535)..(536): n is a, c, g, or t
  modified_base (539)..(542): a, c, t, g, unknown or other
  misc_feature (539)..(542): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattggtggcagtggtgagaccacatactacncagactccgtgaagggccggttcaccatctccagagacaattccaagaacaccctgtctctgcaaatgaacaacctgagagccgaggacacggctatttatactgcgcgagagaaggacgtgggcggtttcgactacgtggggccagggaaccctggtccaccgtctcctcacgcctaccaccgaacgggcccagtccggtccttcccccgtgggccgcccctcgcctccgacgggacgccacccgtccgagacgccacgacgcggccctgggctgcctggtcaaggtctactcatcacnctactgngcggctggcaggcgnntannnn

SEQ ID NO: 78977 - DNA, 620 bp, Homo sapiens
  misc_feature: GYAE6OF02JYW0Z.37.26.C04.1.454.CMB.1.raw
  modified_base (315)..(315): a, c, t, g, unknown or other
  misc_feature (315)..(315): n is a, c, g, or t
  modified_base (322)..(322): a, c, t, g, unknown or other
  misc_feature (322)..(322): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattacgtggtagtggtaataccgcatactacgcagactccgtgacgggccgttcaccgtctccagagacaattccaagaatacggtctatctaggaaatgaaacagcctagacgagccgaggacacggccctntattacngtgcgagagatcagacggagtatagcagcagctctgactacgtggggccacggaaccctggtaccacccgttctccctacacgccctaccgaaccgaacgggccccagtccggtacccttcccccgtcggaccctaccccgttccctaccgaaacgaccgccaacccgtccgtcggggacctacgacggccggacccgtcgggcctcggtccgtacggtacaacgggtacctaccgtttccacttcgtaacctacttacgtggacggtcgggactcgggacgacggccgtacagtacg

SEQ ID NO: 78978 - DNA, 569 bp, Homo sapiens
  misc_feature: GYAE6OF02HJZ3K.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgccctccaccaacgggccccaacgtccggtccttccccgtcggccaccctcctcccaacgacgcaccgtcgtcggggcacgacgccggcccgtcgggctcgcctcggtacaacggacctacttccactcctactacctactcgacggcgggcctcggaccgacggcgcagtacg

SEQ ID NO: 78979 - DNA, 614 bp, Homo sapiens
  misc_feature: GYAE6OF02HIJ7Y.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggaccacggaaccctggtccacccggttctccctcacgccctaccacccgaacgggccccaatccggtccttcccccgtggccacccctccctaccaacgacgccaccctcgtcgggggccacgacggccgggacccgtgggcctcggccgttcgggtaccgaagggtaccttaccttcccgaacttccgtaactaccttacgtacggtacggccggggtacgtacgggaccgaagggccgacgtagtacg

SEQ ID NO: 78980 - DNA, 609 bp, Homo sapiens
  misc_feature: GYAE6OF02GTMJT.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcagcctccaccaacggcccagtcggtccttccccgtcggccaccctccctccaacgacgccacctcgtcgggggcacgacgccggcccgtcggggccgtcggcccgttcgggtaccgaaacggtaccgtacctttaccctaactcctaacctaacccgttaacgtacggtacggccggggaccgttcgggaccgaacgggtaccggacgtagtaacgg

SEQ ID NO: 78981 - DNA, 615 bp, Homo sapiens
  misc_feature: GYAE6OF02HBJKZ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctggaaatgaaacagcctgagagccgaggacacggccctctattactgtgcgagagatcagacggagtatagcagcagctctgactacgtggggccacggaaccctggtccaccgtctcctcacgccctccaccgaacgggcccactccggtccttccccgtcggcctacccctccctaccaacgacgccacctcgtcggggccacgacggccggcccgtcgggccgtcggtcccgttgggtaccaaacggtaccttaccttacccgaacttcccgtaacctaaccttaccgtcggacggtccggggaccgttcgggaccgaacgggaccggtacgagtacgg

SEQ ID NO: 78982 - DNA, 580 bp, Homo sapiens
  misc_feature: GYAE6OF02HGLDE.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctcaccaaggcccactcggtccttcccctcggccacccctccctccaacgacgccaccctcgtcgggggccaaccgaggcccggcccgtggggccttcggcctcgggtccgaaacggtacctaccttccactcgtaacctacgttacctcgacggccgggcgtcgggaccaacgggccgacagtacg

SEQ ID NO: 78983 - DNA, 596 bp, Homo sapiens
  misc_feature: GYAE6OF02H1NUX.37.26.C04.1.454.CMB.1.raw
  modified_base (311)..(311): a, c, t, g, unknown or other
  misc_feature (311)..(311): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcgaggtattactggtagtggtaataccgcatactacgcagactccgtgacgggccgttcaccgtctccagagacaattccaagaatacggtctatctggaaatgaacagcctgagagccgaggacacggccctntattactgtgcgagagatcaagcggagtatagcagcagctctgactacgtggggcccacggaaccctggtccaccgtctcctcacgccctaccaccgaacggcccacgtccggtccttccccgtcggccaccctcctaccaacgacgccacccgtcgtcggggaccacgacgccggacccgtcgggccgtcgccgtcggtacgaaacggtaccttaccgttacctacttccgtaaccacctacgtacgacggccgggtcgtacggacgaacggcgacgtagtacg

SEQ ID NO: 78984 - DNA, 602 bp, Homo sapiens
  misc_feature: GYAE6OF02HMZIC.37.26.C04.1.454.CMB.1.raw
  modified_base (340)..(340): a, c, t, g, unknown or other
  misc_feature (340)..(340): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccagtctccagggaaggggctggagtgggtggccaacatacagggaggtggtggtacgaaaaactatgtggactctgtggcgggccgattcaccatctccagagacaacgaccaaaaactcactgtatctgacaaatggacgcctgagatccgaggacacggctgtgtattatgtgcgagagtatttagactaanaaagttcgagtgactggtatgatgactttangattaccgnggggaccaagggaccagtcggtccaccgtctcttacacgtccctaccaccgaacgggccctacgtccggtcccttcccccgtcggcccgcccgtcgcctccgacggaccgaccacccgtccgacgacgacgaccgacggccggcccgtcggccgtcgtccgtcggtaccgaacggaccttaccgttcctactacctactaccgtacgtacggacggtccggg

SEQ ID NO: 78985 - DNA, 174 bp, Homo sapiens; identical to SEQ ID NO: 78297
  misc_feature: GYAE6OF02HEPGQ.37.26.C04.1.454.CMB.1.raw
  modified_base (173)..(174): a, c, t, g, unknown or other
  misc_feature (173)..(174): n is a, c, g, or t

SEQ ID NO: 78986 - DNA, 559 bp, Homo sapiens
  misc_feature: GYAE6OF02HG6XW.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtgggccacggaaccctggtcaccgtctcctcacgccctccaccgaacgggcccaacgtccggtccttcccccgtcggccacccctcctccaacgacgcacctcgtcggggccacgacgccggcccgtcgggctcgccgtggtcaacggtacctactccatccgtacactactgacgcggcgtcggacacggcgcatacg

SEQ ID NO: 78987 - DNA, 590 bp, Homo sapiens
  misc_feature: GYAE6OF02JY583.37.26.C04.1.454.CMB.1.raw
  modified_base (352)..(352): a, c, t, g, unknown or other
  misc_feature (352)..(352): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctntgactactggggcccacggaaccctggtccaccgtctcctcagccctccaccaacgggccccagtccggtccttcccccgtggccaccctccctccaacgacgccaccgtcgtcggggccacgacggccggcccgtgggcctcgccgtcggtacgaaacgggactaccgttccgattaccgtaacctaccgtactcggacgccgggtactcgggaccgaacgggccgacgtagtacgg

SEQ ID NO: 78988 - DNA, 545 bp, Homo sapiens
  misc_feature: GYAE6OF02FL8VX.37.26.C04.1.454.CMB.1.raw
  modified_base (352)..(352): a, c, t, g, unknown or other
  misc_feature (352)..(352): n is a, c, g, or t
  modified_base (544)..(544): a, c, t, g, unknown or other
  misc_feature (544)..(544): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctntgactacgtggggccacggaaccctggtccaccgtctcctcagcctccaccaacgggcccatccggtccttcccctggccacccctccctccaacgacgtacctcgtcggggcacgacgccggccctgggctcgcctggtcaacggactacttccatctacactactgagcggctcggcaacggcgcatagng

SEQ ID NO: 78989 - DNA, 576 bp, Homo sapiens
  misc_feature: GYAE6OF02FXQZM.37.26.C04.1.454.CMB.1.raw
  modified_base (331)..(331): a, c, t, g, unknown or other
  misc_feature (331)..(331): n is a, c, g, or t
tcagtagtgtagatcacgaccggtgctcgatttagtctagcgacttttgggtttgggggaggcttggtacagcctgggggtccctgagactctcctgtgcagccctctggttcatctttagcaactacgccatgagctgggtccgccaggctccaggggaagggctggagtcgggtctcgaggtattactggtagtggtaataccgctatactacgcagacgtccgtgacgggccgttcaccgtctccgagagacaagttccaaagaagtacggtctaatctggaaatgaacacgcctaggagtagccgaaggacacggccctgtattacngtcgcgagagatcgagacggatagagcagcaagctcgtgactacgtggggccaacgggaccctggtcaccgtctcgcagcctcacacggccagtcgtctcccgtcgccaccctcctccaacgacgccacctcgtcggggcacgacgccggcccgtcgggcctcggccgtggtacgaaggacctacgtccgactacgtacgtactacgtcgacgcgggcgtcggacgaacggcgtacgtagtacgg

SEQ ID NO: 78990 - DNA, 606 bp, Homo sapiens
  misc_feature: GYAE6OF02GGWD4.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaacgggcccatccggtccttcccccgtcggccacccctccctaccaacgacgccacccttccgtcgggggccaccgacggacccgggccccgtcggggcctacggcccgttgggtacccgaaacgggtaccttaccgttacccattcctaaccaccttactacggacggccgggacgtcgggaccgaacgggccgtacgagtacg

SEQ ID NO: 78991 - DNA, 620 bp, Homo sapiens
  misc_feature: GYAE6OF02HVSBU.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctccctcacgcctccacccaacgggccccagtcccggttcccttccccgtcggccctacccctccctacccgaaacgaccgaccacccgttcggtcgggggaccacgacggcccgggcccgtcgggcctcggcccgttcgggtaccgaaacgggtaccttaccttccacttcctaacctaccttaccgtggaacggccgggtcgtacgggaccgaacgggtccgacgagtacg

SEQ ID NO: 78992 - DNA, 581 bp, Homo sapiens
  misc_feature: GYAE6OF02HA2M2.37.26.C04.1.454.CMB.1.raw
  modified_base (443)..(443): a, c, t, g, unknown or other
  misc_feature (443)..(443): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcagcctccaccaagggcccagtccggtccttcccccgtcggccacccctccnccaagcgccacctcgtcggggcacgcgccggcccgtgggcctcggcctcgggtacaacggtaccttaccttccacttcctaaccaccttacgtacggacggccgggccgttcgggaccgaacgggccgtaccagtacg

SEQ ID NO: 78993 - DNA, 580 bp, Homo sapiens
  misc_feature: GYAE6OF02GWEGM.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctgggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctccctcacgccctccaccgaacgggcccagtccggtccttcccccgtcggccacccctcctccaacgacgccacccgtcgtcgggggccacgacggccgggcccgtcgggcctcgcccgtgggtccaaggacctacttccattccgtaacactacgtcgacggcgggctcgggacgacgggcacgagtacg

SEQ ID NO: 78994 - DNA, 606 bp, Homo sapiens
  misc_feature: GYAE6OF02HFF1Z.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtaccaccgtctcctcacgccctaccaccgaacggcccacgtccggtccttccccgtggcccacccctcctacccgaacgacgccacctcgtcggggccaccgacggcccggcccgtcgggccttcgcccgttcggtacaacgggtaccttaccgttcccacttaccgtaacaaccgttactacggacggtccgggcgttcgggaccgaacgggccgacgaagtacgg

SEQ ID NO: 78995 - DNA, 531 bp, Homo sapiens
  misc_feature: GYAE6OF02IT19A.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggcctctattactgtgcgagagatcagacggagtatagcagcagctctgactacgttgggccacggaaccctggtcaccgtctcctcagcctcaccaaggcccatcggtccttcccctggccacccctcctccaacgacgccacctctggggcacgagcggcctgggctgcctggcaagctacgttcatcctacactactcgacgcggcgtggcgaggcgacatacg

SEQ ID NO: 78996 - DNA, 555 bp, Homo sapiens
  misc_feature: GYAE6OF02GJXN0.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctgggagtggggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgcctccaccacggcccagtccggtccttccccgtcggccgccctcgcctccgacggcgccacctccgagacgcacgacgccggcccgtgggcctgccgtggtacaacggactacttccactcctactactactgacgcggcgtcggcgacggcgacg

SEQ ID NO: 78997 - DNA, 626 bp, Homo sapiens
  misc_feature: GYAE6OF02G8LTL.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaagggctggagtgggtctcaggtattacgtggtagtggtaataccgcatactacgcagactccgtgacgggccgttcaccgtctccagagacaattccaaagaatacggtctatctggaaatgaacagcctagagagccgaggacacggccctctattactgtgcgagagatcagacggagtatagcagcagctctgactacgtggggcccaacggtaaccctggtccaccgtctcctcagccctccaccgaacggcccagtccgtccttccccgtcggccacccttccctacctaacgacgcctaccgtcgtcgggaccacgacggccggtcccgtacggggcctcggtcccgttcgggtaccgaaacgggtacttaccgttcccgtaacttaccgtaactaaccctaacgttacggacggtccggggacgtaccgggtaccgaaccgggtcgacgtaacgtacgg

SEQ ID NO: 78998 - DNA, 601 bp, Homo sapiens
  misc_feature: GYAE6OF02JRMD9.37.26.C04.1.454.CMB.1.raw
  modified_base (310)..(310): a, c, t, g, unknown or other
  misc_feature (310)..(310): n is a, c, g, or t
  modified_base (352)..(352): a, c, t, g, unknown or other
  misc_feature (352)..(352): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctntatactgtgcgagagatcgagacggagtatagcagcagcctntgactacgtcggggccaacggtacctggtccaccgtctcctcacgccctccaccgaacggcccacgtccggtcccttccccgtcggtccctacccctccgtaccaacgacgccaccgtccgtcggggccacgacggccggacccgtcgggcctacggccgttggtaccgaacggtacctaccttccacttaccgtactaccgtactacggacgtccgggcgtacgggaccgaacggccgacgtagtacg

SEQ ID NO: 78999 - DNA, 566 bp, Homo sapiens
  misc_feature: GYAE6OF02HWZ8B.37.26.C04.1.454.CMB.1.raw
  modified_base (400)..(400): a, c, t, g, unknown or other
  misc_feature (400)..(400): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (536)..(536): a, c, t, g, unknown or other
  misc_feature (536)..(536): n is a, c, g, or t
  modified_base (543)..(543): a, c, t, g, unknown or other
  misc_feature (543)..(543): n is a, c, g, or t
  modified_base (563)..(563): a, c, t, g, unknown or other
  misc_feature (563)..(563): n is a, c, g, or t
tcagtagtgtagatcacgaccggtgctcgatttagtctagcgactttgggtttgggggaggcttggtacagcctggggggtccctgagactctcctgtgcagcctcgtggtttcatctttagcaactacgccatgagctgggtccgccaggctccagggaagggctggagtgggtctcaggtattactggtagtggtaataccgcaatactacgcagtactccgtagacgggccggttcaccgtctccagagacaattccaagaatacggtctatctggaaatggaaacagcctagagagccgaggacacggccctatattactgtgcgagagatcagacggagtatagcagcagctctgactagcgggaccacggaaccctggtaccaccgtctcctcncgcctaccgaccgaacggcccctagtccggtccttccccgnggacccnccctcctaccaacgccgactacctcggtgggccacgcggaccggccgtgggcctcgccgtgggacaacgacctctccacttctaaccncttacgngacgcggctcggacaggcgnatg

SEQ ID NO: 79000 - DNA, 575 bp, Homo sapiens
  misc_feature: GYAE6OF02JY3LL.37.26.C04.1.454.CMB.1.raw
  modified_base (319)..(319): a, c, t, g, unknown or other
  misc_feature (319)..(319): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattacgtggtagtggtaataccgcatactacgcagactccgtgacgggccgttcaccgtctccagagacaattccaagaatacggtctatctaggaaatgaacagcctgaagagccgaggtacacggcctctattacngtagccgaagagatcgagacggatatagcagcagctntgactgngggaccacggaaccctggtcaccgtctaccgtcagccctacacgacggcctacgtccggtaccttccccgtgccctacccgtcctaaccgaagcgccacctcggtcgggaccacgacggcccggcccgtgggacctcggtcctcggtacgaacggtacctacgtcagtcctacactacgtagacggcgacgtcggacgtacggctagagtag

SEQ ID NO: 79001 - DNA, 614 bp, Homo sapiens
  misc_feature: GYAE6OF02IN9A9.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtgggccacggaaccctggtcaccgtctcctcgacgcctccaccgaacggcccacgtcggtcccttccccgtcggccctacccctcctaccgaacgacgacctaccctcgtcggggcacgacggcccgggtacccgtcgggcctcggccgttacgggtacgaaacggtacctaccgttacccacttaccgtaaccgtaaccttaaccgtggaacggcccggggtaccgtcgggaccgtaacgggcgaccgagtacgg

SEQ ID NO: 79002 - DNA, 534 bp, Homo sapiens
  misc_feature: GYAE6OF02IGGFZ.37.26.C04.1.454.CMB.1.raw
  modified_base (309)..(309): a, c, t, g, unknown or other
  misc_feature (309)..(309): n is a, c, g, or t
  modified_base (339)..(339): a, c, t, g, unknown or other
  misc_feature (339)..(339): n is a, c, g, or t
  modified_base (511)..(511): a, c, t, g, unknown or other
  misc_feature (511)..(511): n is a, c, g, or t
  modified_base (529)..(529): a, c, t, g, unknown or other
  misc_feature (529)..(529): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggctatctggaaatgaacagcctgagagccgagacacggccctntattactgtgcgagagatcagacggagtanagcagcagctctgactacgtggggaccacggaaccctggacaccgtctcctcagcctccacaacgggcccatcggtcttcccctggccaccctcctccaagacgcacctcgtggggaccacgacgccggcccgtgggctcgcctggtcaaggactactccatctacactacngacgcgggctggcaggcncatag

SEQ ID NO: 79003 - DNA, 584 bp, Homo sapiens
  misc_feature: GYAE6OF02GOXP5.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggattcaactttggtagctattggatggactgggtccgccagtctccagggaaggggctggagtgggtggccaacatacagggaggtggtggtacgaaaaactatgtggactctgtgcggggccgattcaccatctccagagacaacgaccaaaaactcactgtatctgcaaatggacggcctgagatccgaggacacggctgtgtattattgtgcgagagatttagactacaaagtttcgagtgactggtatgatgcttatgataccgtggggaccaaaggggaccagtcgggtccaccggttctccttcacgccctccaaccgaacgggccctacgtcccggtccttcccccgtcggcccgccctcgcctccgaggcgccaccgtccgagacgcacacggccgcccgtgggcctcggcctgggtcaacggtacttaccgttccatcctaaccacctacgtacgacggccggtacg

SEQ ID NO: 79004 - DNA, 566 bp, Homo sapiens
  misc_feature: GYAE6OF02I2GGE.37.26.C04.1.454.CMB.1.raw
  modified_base (474)..(474): a, c, t, g, unknown or other
  misc_feature (474)..(474): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaacaccctgtctctgcaaatgaacaacctgagagccgaggacacggccctatattactgtaacgaaaatggcctacggatatgactactattgggactggtacttcgatctcgtggggccgtggcacccgtggtccactcgtcctcctcacgccctccaccgaacgggccccagtccggtccttcccccgtgggccgccctgcctccgaggacnccacctccgagacgccacgcgccggcccgtgggcctcgccgtggacacggcctactccactctaccacgtctgacggccggctcggcaggcg

SEQ ID NO: 79005 - DNA, 567 bp, Homo sapiens
  misc_feature: GYAE6OF02GZH9Q.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggattcaactttggtagctattggatggactgggtccgccagtctccagggaaggggctggagtgggtggccaacatacagggaggtggtggtacgaaaaactatgtggactctgtgcggggccgattcaccatctccagagacaacgccaaaaactcaactgtatctgcaaatggacggcctgagatccgaggacacggctgtgtattattgtgcgagagatttagactacaaagtttcgagtgactggtatgatgcttatgataccgtggggaccaagggaccagtgggtcaccggtctcttcacgtccctaccaccaacgggcccagtccggtcctttcccccgtggcccgccctcgcctccgaggcgccacccgtccgagcgcacacggccggcccgtgggcctcgcctcgggtcaacggtctaccttccatcctactacctactgacggtcggcg

SEQ ID NO: 79006 - DNA, 529 bp, Homo sapiens
  misc_feature: GYAE6OF02GIW67.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaacctggtcaccgtctcctcagcctccaccaaggccatcggtccttcccctggccaccctcctccaacgcgcacctctggggcacgagcggccctcgggctcgcctggtcaaggactacttccatctacactactgacgcgggctcggcaggcgcatag

SEQ ID NO: 79007 - DNA, 558 bp, Homo sapiens
  misc_feature: GYAE6OF02GI5VB.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggatatagcagcagctctgactactggggccacggaaccctggtccaccgtctcctcagcctccaccaacgggcccatccggtcttccccctcggccacccctcctccaacgacgccaccctcgtcggggccacgacgccgggcccgtggggcctcgcctcgggtacaagggacctacgttccagtcctaacactactgacgcgggctcgggccaggcgcatag

SEQ ID NO: 79008 - DNA, 567 bp, Homo sapiens
  misc_feature: GYAE6OF02FLOCT.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcagcctccaccacggccatcgtcctcccctggccaccctcctccaacgacgccacctcgtcggggccacgacgccggcccgtcgggcctcgccgtggtaccgaaggtaccttaccgttccactccgtaccaaccttacgtcgacggcgggcgtcgggacgaacggcgccagtacg

SEQ ID NO: 79009 - DNA, 578 bp, Homo sapiens
  misc_feature: GYAE6OF02HKG5S.37.26.C04.1.454.CMB.1.raw
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccaggggaaggggctgggagtggggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggagtatagcagcagctctgactactggggccacggaaccctggtcaccgtctcctcacgcctccaccaacgggccccacgtccggtccttcccctcggccacccctcctccaagacgccacctcgtcgggggccacgacggccgggcccgtcggggctcgccgtcggtcgaacggactaccttccacttcctaccactacgtgacggcgggtcgtcggacgaacgggcgacgagtacg

SEQ ID NO: 79010 - DNA, 587 bp, Homo sapiens
  misc_feature: GYAE6OF02IO4VB.37.26.C04.1.454.CMB.1.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (314)..(314): a, c, t, g, unknown or other
  misc_feature (314)..(314): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcgaggttattactggtagtggtaataccgnatactacgcagactccgtgacgggccgttnaccgtctccagagacaattccaagactacggtctatctaggaaatgaacagcctgagagccgaggaccacggcccttntacttactggtgacgagagatcagacggatatagcagcagctgtgactacgtgggaccacggtaccctggtaccacgtctcctcgacgtccctaccaccgaacggccagtccgtccttccccgagtcctaccctcctaccaacgacgacctaccgtcgtacgggacacgacggccgccgtcggtcctcgtccgtcggtacgaacgtacctaccgttacacgttaccgtaactacctacgtgacggcggtacgcggtacgacggcgacgatacg

SEQ ID NO: 79011 - DNA, 641 bp, Homo sapiens
  misc_feature: GYAE6OF02HDLEL.37.26.C04.1.454.CMB.1.raw
  modified_base (315)..(315): a, c, t, g, unknown or other
  misc_feature (315)..(315): n is a, c, g, or t
  modified_base (346)..(346): a, c, t, g, unknown or other
  misc_feature (346)..(346): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctaggaaaatgaaacagcctgagagccgaggacaccggccctntattactgtgcgagagatcaaggacggatanagcagcagctctgaactacgtcggggacccaacggaaccctgggtaccacccggttctccctcacgccctacccaccgaacgggcccctacgtcccggtcccttcccccgtacggccctaccccgtcctaccgaacgacgccaccgttcgtcgggacacgacggccggcccgtcgggcctcgccgttcgggtaccgaaacgggtaccttaccgttaccctacgttaccgtaacctaccgttaccgtcggaaccggtccggggtcgtcgggaccgaacgggccgtacgtacgtagg

SEQ ID NO: 79012 - DNA, 589 bp, Homo sapiens
  misc_feature: GYAE6OF02GU691.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctgggtcaccgtctcctcacgcctccaccaacgggcccactcggtccttccccgtggccacccctccctccaacgacgccaccctcgtcggggccacgacggccggcccgtcgggcctcgccgttcgggtcaaacgggaccttaccgttcccaacttcctaaccaccttacgtcggacggcgggacgtcgggaccgaacgggccgacagtacgg

SEQ ID NO: 79013 - DNA, 597 bp, Homo sapiens
  misc_feature: GYAE6OF02JMC2L.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggatatagcagcagctctgactacgtcggggccacggaaccctggtccaccgtctccgtcacgccctaccacccgaacgggccccacgtcccggtacccttcccccgtcggtccctaccccgtccctacccgaacgaccgccacccgtcgtcggggccacgacgccggcccgtcgggccgtcgccgtcggtacgaacggtactaccttccactacctacgtacctacgtcgacgccggcgtcggaccgaacggccgacagtacg

SEQ ID NO: 79014 - DNA, 577 bp, Homo sapiens
  misc_feature: GYAE6OF02JF201.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggagtatagcagcagctctgactacgtggggacccacgggaaccctggtcaccgtctcctcacgcctccaccaacggcccatcggtccttcccctcggccacccctcctaccaacgacgccaaccctcgtcggggcaccgacgccggcccgtgggcctcgccgtcggtcaaacggacttacttccacgtcctaactaccttacgtgacggccgggtcgtcgggaccaacgggccacgatacg

SEQ ID NO: 79015 - DNA, 533 bp, Homo sapiens
  misc_feature: GYAE6OF02GUYSO.37.26.C04.1.454.CMB.1.raw
  modified_base (520)..(520): a, c, t, g, unknown or other
  misc_feature (520)..(520): n is a, c, g, or t
  modified_base (529)..(529): a, c, t, g, unknown or other
  misc_feature (529)..(529): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcagcctccaccagggccatcggtcttcccctggccaccctcctccaagacgcacctcgtggggcacgacgccggcccgtgggctcgccgtggtcaaggactactcatctaacactactgacgcgggcncggcaggcnatag

SEQ ID NO: 79016 - DNA, 768 bp, Homo sapiens
  misc_feature: GYAE6OF02J1KDY.37.26.C04.1.454.CMB.1.raw
  modified_base (293)..(293): a, c, t, g, unknown or other
  misc_feature (293)..(293): n is a, c, g, or t
tcagtagtgtagatcacgaccggtgctcgatttagtctagcgactttgggtttgggggtaggcgttggtacagcctgggggtcccgtgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccatctccagagacaattccaagacacactctatctgacaaatgaacagcctganaactgaggacacggctgtgtatcactgtgacgaaccgaagggggtttggagagtgcagcgtagggaggtgagttgggttttagagttttagtacggggaccgtaaaggggactaaagtcgggttacaccggttaccttcgtttaccgtaacggtccccgttaccccgaaccggtaaaccggggtacccctacgttacccgggttacccctttccccccggttacgggtccccctaacccccgttcccccgttacccaaacgggacccgttaccgtaacccccgttccggttaccgggggggacctaacccgggaaccggtcccggggtaccccgttaccggggtcccgttccgggtcccggttacggggtacccgttaaaacgggggtaaccctttaacccgtttacccgaaccgtttacccgtaacgtacccttacgttaccgggacggtacccgggtaccgttcgggaaccgg

SEQ ID NO: 79017 - DNA, 762 bp, Homo sapiens
  misc_feature: GYAE6OF02ICWJ9.37.26.C04.1.454.CMB.1.raw
  modified_base (310)..(310): a, c, t, g, unknown or other
  misc_feature (310)..(310): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggttattactggtagtggtaataccgcatactacgcagactccgtgacgggccgttcaccgtctccagagacaattccaagaatcggtctatctggaaatgaacagcctgagagccgaggcacggccctntattactgtgcgagagatcagacggagtatagcagcagtctcgtagaccgtacggtcggacccgaacccggtaaccgttcggtacccgtacccggttcccttcccgtacgtacccggtccccttacccgaacccgggtaaacccgggtccccgtaaccggtttccccgggttacccccgttttcccccccggtcgggaccccccttacccccgttcccgttaaccccggaaaggtacccgaccctaaccccggtttccggggaccgggggtaccaaccgtaccggggccccgggttcccggtcgggtacccgtccggtcccggtcggtaaaccgaacggttaacccttacccgtaccctaacgttacccgtaaccttaaccgttacggtaccggtaccgggcccggttaccggtacgggaacccggaaccgggtaccgtaccgtaagtaccg

SEQ ID NO: 79018 - DNA, 598 bp, Homo sapiens
  misc_feature: GYAE6OF02JMI44.37.26.C04.1.454.CMB.1.raw
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (358)..(358): a, c, t, g, unknown or other
  misc_feature (358)..(358): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctaggaaatgaacagcctgagagccgaggaccacggccctntattacngtgcgagagatcagacggagtaatagcagcagcttcgngactacgtcggggccaaccggtaaccctggtaccacccgtctccctcagccctccgaaccgaacgggacccacgtccggtccttccccgtcggcctacccctccaccaacgacgccaccgtcgtcggggccacgacggccggtcccgcgggcgtcgtccgtcggtacgaacggtacctaccgtcctactacctaaccactacgtacgacggcggtcgtcggcgaacggtcgacgagtacg

SEQ ID NO: 79019 - DNA, 577 bp, Homo sapiens
  misc_feature: GYAE6OF02I3W36.37.26.C04.1.454.CMB.1.raw
  modified_base (312)..(312): a, c, t, g, unknown or other
  misc_feature (312)..(312): n is a, c, g, or t
  modified_base (341)..(341): a, c, t, g, unknown or other
  misc_feature (341)..(341): n is a, c, g, or t
  modified_base (391)..(391): a, c, t, g, unknown or other
  misc_feature (391)..(391): n is a, c, g, or t
  modified_base (458)..(458): a, c, t, g, unknown or other
  misc_feature (458)..(458): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctaggaaatgaacagcctgagagccgaggacacggccctntattactgtgcgagagatcagacgagtanagcagcagctctgactacgtggggccacggaaccctggtccacgtctccncacgcctccaaccgaacgggccctacgtccggttcctaccccgtggcccaccctcctaccaacgacncaccgtcgcggggaccacgacggccggacccgtgggcctcgccgtcggtacaaggtacctaccttccatccgtaactacctactggacgcggtactcggaccgaacgggctccagtacg

SEQ ID NO: 79020 - DNA, 593 bp, Homo sapiens
  misc_feature: GYAE6OF02G9E5W.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctaggaaaatgaacagcctgagagccgaggacacggccctctattactgtgcgagagatcaggacggataatagcagcagctctagactacggtcggggaccaacggaacctggtaccaccgtctcctcacgtccctaccgaccgaacggacccacgtccggtcccttccccgtcgcctacccctccctaccgaacgacgccacctcgtcggggacacgacgccggcccgtcgggcgtcgtccgtcggtacgaacggtactaccgttccactacctaactactacgtcggacggcgggcgtcggacgacggcgacagtacg

SEQ ID NO: 79021 - DNA, 558 bp, Homo sapiens
  misc_feature: GYAE6OF02F6E15.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgattcaccgtctccagagacaattccaagaatacggtctatctggaaatgaacagcctgagagccgaggacacggccctctattactgtgcgagagatcagacggagtatagcagcagctctgactacgtgggccacggaaccctgtcaccgtctcctcacgcctccaccgaacgggccccagtccggttccttccccccgtggcccacccctcctacccaacgacgccacctccgtcgggggcacgacggccggcccgtgggctcgcctcggtacaacggacctactccatccacactactgagcgggctcggcgacggcgactag

SEQ ID NO: 79022 - DNA, 555 bp, Homo sapiens
  misc_feature: GYAE6OF02FI3V7.37.26.C04.1.454.CMB.1.raw
  modified_base (537)..(537): a, c, t, g, unknown or other
  misc_feature (537)..(537): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgaagggccggttcaccatctccagagacaattccaagaacaccctgtctctgcaaatgaacaacctgagagccgaggacacggccctatattactgtacgaaaatggcctacgtatatgactactattgggactggtacttcgatctctggggcctggcaccctggtcactgtctcctcagcctccaccaagggcccatccggtccttcccccgtggccgccccttgccttccgaggacgcaccctccgacgagccactacgccggccctgggctcgccctgggtccaaggacctaacttccatctacactacngacgcgggctggcaacgg

SEQ ID NO: 79023 - DNA, 595 bp, Homo sapiens
  misc_feature: GYAE6OF02IUJZG.37.26.C04.1.454.CMB.1.raw
  modified_base (432)..(432): a, c, t, g, unknown or other
  misc_feature (432)..(432): n is a, c, g, or t
  modified_base (454)..(454): a, c, t, g, unknown or other
  misc_feature (454)..(454): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtgggccaacggaaccctggtccaccgtctccctcacgcctccaccaacgggcccacgtcggtccttccccgngcccacccctcctaccaagacnccacctcgtcgacgggccaccgacgccggcccgtgggcctcggcccgtcggtccgaacggtaccttaccgttcctacgttcctaacctaacttaccgtaggacggccggggtcgtacgggaccgtaacgggccgataacgg

SEQ ID NO: 79024 - DNA, 553 bp, Homo sapiens
  misc_feature: GYAE6OF02FZP9G.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcagcctccaccaacggcccatcggtcttcccctggccaccctcctccaacgacgcacccgtctcgggggccacgacggccggcccgtgggcctcgccgtcggtccaaggaccttaccttccatccgtacactactgacgcgggctcggacaggcgacatacg

SEQ ID NO: 79025 - DNA, 584 bp, Homo sapiens
  misc_feature: GYAE6OF02IIIU9.37.26.C04.1.454.CMB.1.raw
  modified_base (311)..(311): a, c, t, g, unknown or other
  misc_feature (311)..(311): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctntattactgtgcgagagatcagacggagtatagcagcagctctgactacgtggggccacggaaccctggtccaccgtctcctcacgcctccacgaacggccccatccggtccttccccctggccacccctccctaccaacgacgccacctcgtcggggcacgacggcggcccgtggggcctcgtccgtcgggtacaacggtaccttaccttcccattccgtaactaccttacgtcgacggtccgggtacgtcggaccgaacgggcgacagtacg

SEQ ID NO: 79026 - DNA, 549 bp, Homo sapiens
  misc_feature: GYAE6OF02GW7DM.37.26.C04.1.454.CMB.1.raw
  modified_base (318)..(318): a, c, t, g, unknown or other
  misc_feature (318)..(318): n is a, c, g, or t
  modified_base (543)..(543): a, c, t, g, unknown or other
  misc_feature (543)..(543): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattacngtgcgagagatcagacggagtatagcagcagctctgactactggggccacggaaccctggtccaccgtctcctcacgcctccaccgaacggcccatcggtccttccccgtggccaccctcctccaacgacgcaccgtcgtggggccacgacgccggcccgtgggcctcgcctggtccaacggactacttccatctacactacgtgacgcgggctcggcacggcgnagtacg

SEQ ID NO: 79027 - DNA, 777 bp, Homo sapiens
  misc_feature: GYAE6OF02IWZ3O.37.26.C04.1.454.CMB.1.raw
  modified_base (210)..(210): a, c, t, g, unknown or other
  misc_feature (210)..(210): n is a, c, g, or t
  modified_base (319)..(319): a, c, t, g, unknown or other
  misc_feature (319)..(319): n is a, c, g, or t
  modified_base (365)..(365): a, c, t, g, unknown or other
  misc_feature (365)..(365): n is a, c, g, or t
tcagtagtgtagatcacgaccggtgctcgatttagtctagcgactttgggtttgggggaggcttggtacgtagcctggggggtccctgtagactctcctgtgcagcctctggtttcatctttagcaactacgccatgagctgggtccgccaggcctccgaggggaagggctggagtgggtctcaggtattactggtagtggtaataccgnatactacgcagactccgtggacgggtccgttcaccgtctccagagacaattccaaagaatacggtctatctggaaatgaaacagcctgagagccgaggacacggccctntattacctgtgcgagagatcaagacggagtatagcacgcagtcctntgacctacgtcggggaccaaccgggaaccctgggtaccacccggtttcctacccgtacgacgtcccgtaccgaacccgtaacggggcccctaacggttcccggttaccctttccccccgtacggtacccgtaacccccgttaccccgttacccgaaacggtaccgtacccgtaaccccgttaccggttaccggggggacccaaaccggacccgggtacccgggtacccccggttcgggggtaacccgttcccggtaccccggttaccgggtaccgaaaaccggggtaccctttacccgttaccccgtaaccgttacccgttaaacccgtacccgttaacccggttacgtaacccgggtccggggtacccgtaccgggtaacccgaacggggcccgtacggtaccgttaacgg

SEQ ID NO: 79028 - DNA, 532 bp, Homo sapiens
  misc_feature: GYAE6OF02H1RZB.37.26.C04.1.454.CMB.1.raw
  modified_base (205)..(205): a, c, t, g, unknown or other
  misc_feature (205)..(205): n is a, c, g, or t
  modified_base (420)..(420): a, c, t, g, unknown or other
  misc_feature (420)..(420): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgnatactacgcagactccgtgacgggccgttcaccgtctccagagacaattccaagaatacggtctaatctggaaatgaacagcctgagagccgaggacacggccctctattactgtgcgagagatcgagacggagtatagcagcagctctgactagtggggccacggacctgtcaccgtctcctcacgcctccacgacggccagtcgtccttcccnggccaccctcctccaagcgcacctcgtcggggcacgcgccggccgtggctcgcctggacaacgtactacttcatctacactacgtgacgcggcgtcggacgaggcgcatacg

SEQ ID NO: 79029 - DNA, 560 bp, Homo sapiens
  misc_feature: GYAE6OF02F7UBQ.37.26.C04.1.454.CMB.1.raw
  modified_base (533)..(533): a, c, t, g, unknown or other
  misc_feature (533)..(533): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtgggccacggaccctggtcaccgtctcctcacgcctccaccaacgggcccagtccggtccttcccccgtcggtccacccctccctaccaacgacgaccaccgtcgtcggggccacgcggccggcccgtcgggcgtcgccgtggtcaacggtcctacttccactctacactacgngacgcggctcggacgaggcacagtacg

SEQ ID NO: 79030 - DNA, 602 bp, Homo sapiens
  misc_feature: GYAE6OF02G3A0N.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggcccacggaaccctggtccaccgtctcctcacgccctccaccgaacgggccccagtccggtcccttcccccgtgggccctacccctccctaccaacgacgccaccctcggtcgggggccacgacggcccggcccgtcggggcctcggcctcggtaccgaacgggtaccttaccttcccattcctaacctaccttacgtcggacggtccgggcgtcgggcgtaacgggcgacgagtacg

SEQ ID NO: 79031 - DNA, 551 bp, Homo sapiens
  misc_feature: GYAE6OF02FGVB7.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaacgggcccatcggtccttccccctcggccaccctcctccaacgacgccaccctcgtcggggccacgacggccggcccgtgggctcgccgtggtacaaggactacttccatctaacactacgtgacgcgggctcggacaaggcgcatacg

SEQ ID NO: 79032 - DNA, 615 bp, Homo sapiens
  misc_feature: GYAE6OF02GWR3Q.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggcccacggaaccctgggtccaccgtctcctcacgtccctccaccgaacgggccccacgtccggtcccttccccgtggcccacccctccctaccgaacgacgccaccgtcgtcggggccacgacggccggcccgtgggcctcggccgtcgggtaccgaacggtaccttaaccgttcccaacttccctaacctaaccgttaccgtcggacggtcccggggacttcggggaccgaacgggcggaccgtagtacgg

SEQ ID NO: 79033 - DNA, 569 bp, Homo sapiens
  misc_feature: GYAE6OF02GFBW5.37.26.C04.1.454.CMB.1.raw
tcagtagtgtagatcacgaccggtgctcgatttagtctagcgactttgggtttgggggaggcttgggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccggtctccagagacaattccgaagaatacggtctatctggaaatgaacagcctgagagcccgaggacacggccctctattactgtgcgagagatcagacggagtatagcagcagctctgactacgtggggcccaacggaaccctggtcaccgtctcctcagcctccaccacggcccagtcgtccttccccgtggccacccctcctccaaacgacgccaccctcgtcggggcacgacggccggcccgtgggcctcgccgtcggtacaacggactacttccgactacgtacactacgtcgacggcgggcgtcggccgaagggcgtcagtacg

SEQ ID NO: 79034 - DNA, 564 bp, Homo sapiens
  misc_feature: GYAE6OF02JD4TN.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgcctccaccaagggcccatcggtcttccccgtggccgccctgcctccaggcgccacctccgagacgcacacgccggccctgggcctcgccgtggtccgaaggactaccttccactcctacctactacgtcggacggtcgggctcggacgtaacggg

SEQ ID NO: 79035 - DNA, 599 bp, Homo sapiens
  misc_feature: GYAE6OF02GFHV5.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctatactgtgcgagagatcagacggagtatagcagcagctctgactactggggccacggaaccctggtcaccgtctcctcacgcctccaccaacggcccatccggtccttccccgtcggcccaccctccctaccaacgacgccaccgtccgtcgggggaccacgacggcccggccccgtggggcctcggcccgttcggtaccgaacgggtaccttaccttacccgattacctacgaaccttaccgtaggacggcgggtaccttcgggaccgaacgggaccgcgatacgg

SEQ ID NO: 79036 - DNA, 595 bp, Homo sapiens
  misc_feature: GYAE6OF02JX4NP.37.26.C04.1.454.CMB.1.raw
  modified_base (395)..(395): a, c, t, g, unknown or other
  misc_feature (395)..(395): n is a, c, g, or t
  modified_base (560)..(560): a, c, t, g, unknown or other
  misc_feature (560)..(560): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatccagacggagtatagcagcagctctgactactggggccacggaaccctgggtccaccggtctcccncagccctcctaccgaacgggccccagtccggtcctttcccccgtgggccctacccctccctccgtaacgacgccgaaccctccgtcgggggccacgacggccggcccgtacggggccgtcgcccgtcggtaccgaacggtacctaccttccatcctaacactacnggacgcgggctcgggcaacgggccgtacgagtacg

SEQ ID NO: 79037 - DNA, 873 bp, Homo sapiens
  misc_feature: GYAE6OF02I5EPF.37.26.C04.1.454.CMB.1.raw
  modified_base (267)..(267): a, c, t, g, unknown or other
  misc_feature (267)..(267): n is a, c, g, or t
  modified_base (810)..(810): a, c, t, g, unknown or other
  misc_feature (810)..(810): n is a, c, g, or t
tcagtagtgtagatcacgaccggtgctcgatttagtctagcgacttgggtttgggggaggcttggtacagccgtgggggtcccgtgagactctcctgtgcagcctctggttctatctttagcaactacgccatgagcgtcgggtccgccgacggcgtccgaggggaaggggcgtggaggtgggtcgtcgtaggtagttacgtaggtaggtaggtaacgtaccgactactactacgacgacgtacgtaccgtacggtaccgggtaccncgtcggttaccgtaccgtaccgtaccgaacgtaacgtaacgtaaacgtaaccgtaaacgtcaatacggtacgtaaacgttacgtaacggtaaaacgtacggaaacgtaaggaccgtacggtaacggtaacggacccggtaacgggtaaccgtaaccgggtacccgtaccgtaacgttaaccgtacgtacgtacgtaacggtaacgaacgtacgtaaggtaacggaagtaacgtaacgacgtaacgtacgtacgtacgtacgtacgtacgtaacgtacgggtacccgtaaccggtaacccgtacggtaccgtaccgtaccgtaccgtaccgtaccgtacccgtacccgtaacccgtaaccgggtacccgtaaccgtaccggtacccgttaccccgtaccggtacccgtaacccgtacccgtacccgaacgtaccgtaccggtaaccgtaccggtaccggggtacccgtacccggtaccgggtacccgggtaccgttaccgggtacccggttaccggtacccggtaccggtaccgtaaccgtaancgtaaccgtaaccgtacctacgtaccgtaacgtaccgtacggtacggtaccggtacggtacgg

SEQ ID NO: 79038 - DNA, 661 bp, Homo sapiens
  misc_feature: GYAE6OF02JA9UM.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtcggggccacggaaccctggtccacccgtctcctcacgcctacccaccgaacggcccgacgtccggtcccttccccgtcggccctacccctcccttacccgaaacgacacctacccgttccggttcggggggacctaaccgaccggtcccgggtccccgtacgggggtccttccggccgttcgggtaccggtaaacgggtaaccgttaacctttcccgtaacttcccgtaaaccgtaccgttaccgtcgggaccggtaccggggccggttcgggaccgtaaccggggcgaccgtagtacgg

SEQ ID NO: 79039 - DNA, 576 bp, Homo sapiens
  misc_feature: GYAE6OF02F39N8.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcacgccctccaccgaacgggccccagtccggtccttcccccgtggcctacccctccctaccaacgacgtacctcgtcggggccacgacgccggccctgggcctcggccgttggtaccaacggtacctaccttcccatcctacaactactacggacgcgggctcggccgtaacggccgacagtagcg

SEQ ID NO: 79040 - DNA, 595 bp, Homo sapiens
  misc_feature: GYAE6OF02FVLOG.37.26.C04.1.454.CMB.1.raw
  modified_base (311)..(311): a, c, t, g, unknown or other
  misc_feature (311)..(311): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctntattactgtgcgagagatcagacggagtatagcagcagctctgactactggggccacggaaccctggtccaccgtctcctcacgcctccaccacggcccatccggtccttcccctcggaacccctcctacccaagacgccaccgtccgtggggccacgacgccggcccgtggggcctcggcccgttcgggtaccgaacgggaaccttaccgttacccacttacctaaccgtaacctaccgtcggtacggtccgggtcgtcgggacgaacgggcgactacgtagc

SEQ ID NO: 79041 - DNA, 583 bp, Homo sapiens
  misc_feature: GYAE6OF02GJ0JE.37.26.C04.1.454.CMB.1.raw
  modified_base (383)..(383): a, c, t, g, unknown or other
  misc_feature (383)..(383): n is a, c, g, or t
  modified_base (451)..(451): a, c, t, g, unknown or other
  misc_feature (451)..(451): n is a, c, g, or t
  modified_base (473)..(473): a, c, t, g, unknown or other
  misc_feature (473)..(473): n is a, c, g, or t
  modified_base (580)..(581): a, c, t, g, unknown or other
  misc_feature (580)..(581): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtggccaacataaagcaagatggaagtaagaaggagtatgtggactctgtgaagggccgtttcgccatctccagagacaacgccaagaactccgtgcatctgcaaatgaaacagtctgagagccgaggacacggctatttattactgcgcgagagaaggactgggcggtttcgactacgtggggccagggaccctggtccaccgtctccncacgccctcccaccgaacgggcccagtccggtccttcccccgtggcccgccctcgcctccgacggtcnccgaccctccgagacgacacgngccggcccgtgggccgtcgccgtggtacgaacggtaccttacgtccattacctactacctacgtcggacggtcgggccgtacggcgaacgggccgacgaagtacgcnncg

SEQ ID NO: 79042 - DNA, 610 bp, Homo sapiens
  misc_feature: GYAE6OF02F1KSE.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaacgggccccagtcggtccttcccccgtcggccctacccctccctacccaaacgacgccacccttccgtcgggggccacgacggccgggcccgtggggcctcggcccgttggtaccgaacgggaccgttaccttcccgaacttaccgtaacctaaccgttaccgtcggacggtccgggctcgggaccgaacgggccgaccgagtaacgg

SEQ ID NO: 79043 - DNA, 614 bp, Homo sapiens
  misc_feature: GYAE6OF02INNLU.37.26.C04.1.454.CMB.1.raw
  modified_base (359)..(359): a, c, t, g, unknown or other
  misc_feature (359)..(359): n is a, c, g, or t
tcagtagtgtagatcacgaccggtgctcgatttagtctagcgactttgggtttggggggaggcttggtacagcctggggggtccctgagactctcctgtgcagcctctggtttcatctttagcaactacgccatgagctgggtccgccaggctccgagggaagggctggagtgggtctcaggtattactggtagtggtaataccgcatactacgcagactccgtgacgggccgttcaccgtctccagagacaattccaagaatacggctatctaggaaatgaacagcctgagagccgaggacacggccctcgtattactgtgacgagagatcgagacggagtagtagctagcagctcgngactacgcgggaccacggaacccttggaccaccgtctcctcacgccctccaaccgaacggcccattccggtcccttccccgtggcccacccctcccgtaccaaacgacgaccacccgtcgtacgggtcaacgacggccggccgtacggctcgccgttggtacgaaacggtaccttaccgttaccacgttaccgtaacgaaccttacgacggtacggtccgggcgtacgggtacgaacgggcccgtagtacgtagg

SEQ ID NO: 79044 - DNA, 579 bp, Homo sapiens
  misc_feature: GYAE6OF02I24M7.37.26.C04.1.454.CMB.1.raw
  modified_base (339)..(339): a, c, t, g, unknown or other
  misc_feature (339)..(339): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (418)..(418): a, c, t, g, unknown or other
  misc_feature (418)..(418): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccagtctccagggaaggggctgggagtggggtggccaacatacgagggaggtggtaggtaacgaaaaactatgtggactctgtgcgggcgatcacatctccagagacaacgaccaaaaactcactgtatctgacaaatggacgctgagatcgagacacggctgtgtattagttgtgcgagagatttagactaanaaagtttcgagtgagtgtatgattatatgatacgtgggacaaggctagtgacncgtntctnacgcctccacgacggccntccggtcctccccgtggcctcctcgcctccgacgtacgcctaccgtacgacgacgaccgacgcggtaccggcccgtagggccgtcgtaccgtccggtacgtaaccggtaccttaccgttaccagtcccttaacaccgttaacgtcggtacggtcgggtacg

SEQ ID NO: 79045 - DNA, 664 bp, Homo sapiens
  misc_feature: GYAE6OF02H8KJR.37.26.C04.1.454.CMB.1.raw
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccggttcaccgtctccagagacaattccaagaatacggtctatctggaaatgaacagcctgagagccgaggacacggccctntattacngtgcgagagatcagacgagtatagcagcagctctgactacgtgggaccacggaacctggtcaccgttctacctcgacgccctaccacccgaacggccccagtccggttacccgttcccccgtacggacctacccctccctaccgaaacgtacgaccgtaaccgtcgtaccgggggtaccaaccgtacgtacccgggtcccgttcggggtacccgttcggtcccgttacgggtacccgtaaacgggtacccgttaaccttacccgtacttacccgtaaccgtaacccttaacgtaccggtacgggaccggtaccggttacgggcgtaacgggcgtaccgagttaacgg

SEQ ID NO: 79046 - DNA, 666 bp, Homo sapiens
  misc_feature: GYAE6OF02IZ7F0.37.26.C04.1.454.CMB.1.raw
  modified_base (207)..(207): a, c, t, g, unknown or other
  misc_feature (207)..(207): n is a, c, g, or t
  modified_base (307)..(307): a, c, t, g, unknown or other
  misc_feature (307)..(307): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctgggagtgggtctcaggtattacgtggtagtggtaataccgnatactacgcagactccgtgacgggccggttcaccgtctccagagacaattccaagaatacggtctatctaggaaatgaacagcctgagagccggaggacncggccctctattactgtgcgagagatcagacggatatagcagacagctcgtgaacgtacgtcggggcccaacggaacccttggtcctacccgtcctcctcgacgccctacccgaacccgaaccgggccctacgttcccggttcccttcccccgtcggaccctaccccgtccccttaccaaacggacgcctacccgtcggtacggggccacgacgggcccgtaccggtggggtccgtccgggcccgttagggtaccgaaacgggttccttaacccgttccaaccttaccgtaaccctaaccggttcggaaccgggtcccgggaggttacgggaccgtaacggggacctacgtacgtggac
